United States Patent 8,781,750 (CELL-TYPE-SPECIFIC PATTERNS OF GENE EXPRESSION) - sequence listing, part 32

SEQ ID NO: 37173 - DNA, 93744 bp, Homo sapiens
cagccgaggaaccggacgcggacaccgccgccccgcgagcctccagcccctcgcctgttgccgcgcgagtcccgggcccggagcgctaggagcgcgcggtgagggagcgggaccccgccgggacccgagggggcgcggcggggaggggaacggggagtcagcccgcgctgtgtctcggggccggccggcaggtgaagccctccgcggtccgctaggcggggacggtgtggggcgggcggcgccgggaccgaggaacgctgcggggcgagcggggcgtagggtcctcccgcagccccggccgccgccgccctcccgagtttctgccgaaagccccgggtcctccaccacctcccagcccgtggccggcgctgcgaattcggtgggattcgcctttctttgggggagtgacgcttacgagagccatttcctccgcgctcgcaggaaggagccatggctctggacgggataaggatgccagatggctgctacgcggacgggacgtgggaactgagtgtccatgtgacggacctgaaccgcgatgtcaccctgagagtgaccggcgaggtgcacattggaggcgtgatgcttaagctggtggagaaactcggtgagtagcatcccagccgcgtccaactaatgacttcccagaattggtagggggaggaaagaggctcacgacgggggaggggcccatttgagaaatcttggcatctcgcaaatgctttttggagatgtaaaatctttcagtatttaagcagatagacctgttcccctttgcgtcttattttgttttgctattctctgaattttcatatgtaatgattcgagcctcccaattataaccttaattgcgtagttacgcgggacgggggatgtgtgccggggaactcgttaattcttaacatttactgacagaacgataaaagaatgaggaaagtgtgttgggagggtgatattacagtgtccgtggttatctatgtcttcagcatacctgaatgttagtgacgtttggtatagagaatgatgcaaaatccatttaagaaaaatctgtgctggaaaatgtgcaactactggcgccagtgtgaagtttctgtggctgttctacgtggtggagtgcattaaaatgttccagtcatccactcttactaggggtggggcagtgcttgacaaacttggtatccatagtccatgctcgatgtaagccgtttcgagcgttcggttttatattaataacaagccaaggaaagaactttgtgttaaaaagcagactttgttaaactaatttgaggttgacggtgtttgcttgagtacaaatatgtattggattgatatccgatttaaaataataaggtatcttacagtatgaagtgtgtgaagagtgtgcagtacacatttttgtgatgaatgaaaccattttcatctggaagagtcagctaaatagatgatttgatcataagagaaatgctcagagaactatcttcctgagctttaaagagccttttgtacataatacagttgtgataagatgattatctgtgtggcattgtctttttaggctggaattgttttttgttttggtgaaggggggttggggactttctgggggtttttttcgtctttttttttttctttttttttttaaacacagcattcgttttcaagctacactgggaaagtagagaagtgcttatttgtcaggaaatctatttcttaccaaaggattattgtatgtaaaggtactgaaatagcactctgatgcattttgcaaaataaggcaggattcatttgggtggacctgctttgtacccctgcaggaagttttattattgaaggaccaaagtgaagctccttacaaggtagcctcttccttaagactgcattgtttggctccctgagatacagctcaggaaagaaaatcctcctaggtagcccagtgaaaattagattttgctgtattgattaaccatttaactggcagttaacagtatttttatctgatttgaataaatcagtcactgtttgcaaaatatgtatgaaccttttttgtccagctctggtatgagattatttaagaaggaaaatagcaaatatttggatattttgttttcaaagaaaacaagcatttttgttagagcttttctaatttatggtaaatggaccatattaatacattggtctcaataggagatattttttatattgcaaaaaaaggagctgttgaaggtgactgagacaacttgtagttctcgaaagccaggctgtagctaatgaataaataatggtttctatatttattttgcattgcttaggactgtttattatagaatcacagtaataaatagaaatatagagaataaactgcagacagaaatgatgttaatttaaatgactataatcttaatcttttaatgctgatacatttttaattttttatgcagagaaaagaagcccaacaaggtaggaaatgctgtgcgtatggaaaccttacatcttttctgaactgaattcatactgattcctcttatattttgaattccaaatagaaagtgcctctgactttcctgtttggtaaaagtagagctaagtgatgcttttggtttttaggattagatgctttgaatggtaagctatttcgttgcctatcagcaagtaaatagaggagagattcggtagggcagcatttaaaacatccacaaatcaggctagtcaaattagaaaagaactttgtaatttttcagagttgcgtaaaactggaatgacctgccttctgaagccctgacttatgtcactgaaggtattaaagggcagactggatgactacttgccaacagtggctagagaggatcaaagcagcttgcagagtctagataaaaggtggagatggtggtagggatgagatggtacaaagtctgttgtctcaggtttgcagagcagtgatggaaaattagcagacttgggctactgtggccttgaagcagttatgaacagaagacaccagagcattcacttacattttcaaactccagactgtctgatatccttcttaatctgttggacggtatatgaataccaaaagcattatattttaaggtgattttcccagataatgttcagtagcagcaattatttccctgaagtcgatagatctcaggatgacctattccctcaacattgtattaaaattgtgtgtgtgcacatgtggaagtttctaggaagaggcttcttcactttaatttctcaaagaggtctgtaacaaaagaagtcatgacacaattttatggtttggcccttgtgtgtcaggttcatcttgaagctagggttcatcccagagtgcggcattttaattaagcacgacataagtgtaaataatgtttccttaatatgtgtcagtaatatctttgtgtttagttagacttttattataaataacgtgtacactttgcttaaggccattaaaacacaatttttagaattttgactttaattcaaagatctgaaaagtctcatttatttatttatttatttattttttactttttgagacgggagtctcactctgtcgcccagactggagtgcagtagcgcgatcccggctcactgcaagctccgcctcctgggttcacgccattctcctgcctcagcctcccgagtagctgggactacagacacccgccaccatgcctggctaattatttgtgtttttagtagagacggggtttcaccgtgttaaccgggatggtcttgatctcctaacctcgtcatccgcctgccttggcctcccaaagtgttgagattgcagacgtgagccaccacgcccatcctaggtctcttttaaatctcagtataaaacacatttgtcatttgctattaatcttttaaaagaaagcaaaagcatatgtcatgaagtgggctttggggaattatatcgtaatgtgacaaagtttttgcatttgtgacttagtctaggctgatacttcataaataattgatcccctcagtgtttatacttcatccagaaagtgaaaaacaccctaaaatccagtttaggttgggtacggtggctcacatctgtaatcccagcaggcagggaggctgaggcaggtggatcacctgaggtcaggacttcgagaccagcctgaccaacatggagaaaccccatctctactaaaaatacaaaaattagctggatgtggtggcatgtgcctggaatctcagctgcttgggaggctgaggcaggagaatcacttgaacctgggaggcggaggttgcagtgagccaaaatcacaccacccagcctaagcgacagagcaagactccgcctcaaaaaaaaaaagaattgtgaaaatttagtactgtttggtttggtttgaggcaaggtcttgcactgtcacccaggctggagtgagtgtgtgttcatggctctttgcatcctcaaacttctgggctcaagtaatcctcttgccttagcttcctgagtagctggaactacaggcacgcaccaccacatcttgctgacttttaaaatttttcgtagagatgggtcttgctttgttgcccaggctggtcttgaactcctggcctcaagcagtccttccaccttggcctcccaaagtgttgggattacagatgtgagctgccatgcctgtttttttttttttaatcaaagacaaatttcaaacgtgtatagtgttttttaaaagaaaaattttaaatatgaaatatcagggataaggattataaaaacaagacatcaaaataaaattgtcttcaaaaataaattttgtcaagaagaggcccaattttatgggattcctctggaggtcattgagaagtattaaatccttggctgggcacggtggctcatgcctctaatcccagcactttgggaggccaaggcgggcagatcagaaggttaggagctcgagaccagcctggccaatatggtgaaaccccgcctctactaaaaatgcaaaaattagccgggtatggtgatgggcacctgtagtcccagctactcgggaggctgagacaggagaatcgctcgaacccaggaggcggaggttgcaatgagccgagatagtgccactgcactccagcctggcagacgctaaataccaagtggatctgttcactgagttttagtatcactttttaaaatgtctttttaaaacttatgtgtacaattaaatttccacctttctataaaaattcattttaaacggagaataaggaatttattataatctggagctcactgaatggaaatctccagccagctctgtgagcagagaggaaaaaataggtgatctctaagtttcctctagctctgattctatgagtagagagaatgtagaagttgggttagatcaagtcacacaatctacaagggaaaaaaatgcaaattggaagactcaggagtaactaaaaagaaacatatgaagttgctttagaaagattgaggattaggccgggagtggtggctcacgcctgtaatactagcaccttgggagtctgaggcaggtggatcacctgaggtcaggagttctagaccagcctggccaacatggtgaaatccccgtctctaccaaaattacaaaaaaaaaattagccaggcatggtagcgggcgcctgtaatcccagctactcaggctgagccaggagaatcgcttgaacctgggaggcggatgttgcaatgagctgagatcacaccactgcactccagcctgggtgatgagcgagattccgtccccccgcccccaacccacaaaaaaaaaacaacaacaaaaaaacatagaacaattgaggattggctgggtgcggtaacttacgcctgtaatcctagcactttgggaggccgaggctcagaagttgtttgcttgagctaggagtttgagaccagccgggcaacatggtgaaatcccgtttctacagaaaaacagaaaatacaaaaattagccaggcgtgatggcacgcacctgtagtcccagctactcgggaggctgagacaggaggattgcctgaagctgggagtttgcagctgcagtgagctgtgattacaccccagcactccattcctgggcaacagagcaagactctgtctccaaaaaaaaaagaaaaagaaaatctgaggattatatttctgaacgtggcctttagaaagaagtccttgctttaaaagtgtgtcatgttcttgccatataataatgaaaaaagttcatttatgttggagttgcatgttaggatcaagttagattgtgaacttagcacatgtgaccaaaaaaagaaatagattttaataaagttaccactaaaaatcccttaacgtgatcattaagtatggtatacgttcattgcatctcacagaagtggaaaatagctagtttttcctctaggaactccaaaaataagtttcattaattgagcaccagatgaagaaactggcttacatgaggggcttcgttacacaaaaaaatactttaaacactaggattagagcttggcaagatgcacactgggaaagaggcatacgtaactggacagctcccttataccctggcttagtgctccctggggaaggtgtgtgcttatttggtggaatggtgcctatgcagttgaaatccttagtttttccccttgagggctcacaactgaattcatggaaattaatgcctacatgatgcatcctcattgcattcatagtgaaatacattaacattataagaaatttttttaaatcttgggggtggagtaggaaacaatgttaaaatcttattaaagtgaattaagttttggttaaatctgatagtaagtttactcagtgtttaaaacactgttcatgatccataggaagtgaattaaattgtatcagtttcttagcaaattttaagttctttaaaagtggaggacagtactcaagttttactgtaatcctgtgacagctaataaagtatgagctattccttagagtatgtgctatttgctgccttttgtttttgttttgctgctatgttttatacccagttttttaaagtaaaaaactgtttgtttccaactagagttaacttatttatagagatgctaaaaatatgtttattcaattacttataaaaggccttgttggaaatgtctaatcgctcgctattgaagagaatggaaagaaaatatgtaaaattttacctgttatctttggctcttaatttttaaaagtttcaaacatctaagttcaagagtaattgagtgaacactgcgtaatcttcatctagacaccagttagtattttgccatttgaattttctatacacacaaacatacacatgttggggagcagttggatgaagtttcagacttactcataacctttgattcctaaatatttaaatatgtatcacctaagaacaagaaacttctcttgcataattacagtatagtgatcacattcaggaaattcaacattgattcacttctgtcatctaatatgcatccattttcaaaatttgccagttgtcccaataatggcctttgtttttttcccatccagaatctcatttcgcatttagttgaaagggcctcttaatctcctttgatatacagaacagccaccaagtgtggagctacaggagattatataataaatggcttattgacattacattaagatacatgtaaaatgatagtatctgtttgtaaactttatggccaccctgtagaacagttcctcagccttggtcttttaagacattgtttaacctttttaaaataaggttcttagtatcagtgcaaatttcacttcagagtgatttttttttcttttgagacagagttttgctcttgtcacccaggctggagtgcagtggcacgatttcagtccactgcaacctccgcctcccaagttcaagtgattctcctgcctcagcctcccaagtagctgggattacaggcacccgccaccacgctaatttttgtatttttaatagagatgggatttcaccatgttggcgaggctggtcttgaactcctgaccttaggcgatccgcccacctcggcctcccaaggtgctgggattacaggcatcagccaccacgcctggccaagagtgatatttttataggttctttttcacatactttatttttaaaatttagtttacttcttagcttactattaaataagctgttaataatagttttagacatcattggatgtaggtttcccataatgtcagctgttctcagactgtagtaggtgctgatggaggcacagattattaagaaataacaggttgcctagtgtgtcagaagatctggattcaacttctggctctgtctgctactttactggttagtatgacctttggacaatgaatccaacctgagtgggttttgacttctataaaatagaaattgaaaaaaattttcttggggcgggcggggtggctcacgcctgtaatcctagcactttgggaggccgaggcaggtggctcacgaggtcaggagatcaagaccatcctggctaacacgatgaaaccccgtctctactgaaaatacaaaaaattagctgggcgtggtggtgggcgcctgtagttgcagctactcgggaggctgaggctggagaatggtgtgaacccagaagggggagcttgcagtgagccgggatcgcgccactgcactccagcctgggtgacagagcaagactccatctcaaaaaaaaaaaaaagaaaaagaaaaacattttctcacaggttttggtgagaattaaatgagataatacatatatattgatactacatgtatatatactttatataaactatttgtgttatgcaaatgagagtggatacttctctgtggcattgagtctctgagtatatgaaagtaggaaggaaaaaaaggaaaagtaggttaaaatataatctagtatatttaataagttccagctttactggtggggaattgcactcctcaaaaaaagcttagtttaggattgctttctgttcccaccctctaaacaacaagaaaaaatagctgtcattttactttcccgccaacttccaaacacacacctgcctctgcagtgtaagagagctatttaagtaccattttaataagatttctgaaatgcaggggaccaataagtggatgatggtattccaggtatttgaaaaatctaaaaccatgaaagcatcagtagtaaattaattctctacttaatatattctataagagcagtgtttttagttcatttatagcaaaggcacatgaaaacattgggcctatttagaaactaatgaaagtagtttcagaaaaaagctaatgtatgcagtattcctatttaaataattattttactgacaaattaatgcttatgccatggaacatttaaaattggtatatatgcccagtgagaagtaaacaaatacatctgaaagtgtatttttaaataattcttttattttgtaattaagaagtgtgacttctgcacttgggtttgtggttacaaattcatattcgttataattcattctttaacaaattagttgcataattactatataattgtttttcctgttaattttttttcttagtgtcaggctcattgaggtctgattgacatatagtaaaatttatccttcttagtataatattctgagttttgacatgtaaaactaccacagtcaagatagaaaacttttacagtactcccaaaagtttcctttgtaaccgtctcatcgcctcaaacccagatcctaaaaaccagtgataatttgccttttctagaatggcctgcaaatggaaccattcagttctagctctttgaatctggtttctttcacttagcataatacatgttagcttcgttcatgtgtttgtatcaatagttttttatcactgagtagtagtccattgaatggattatttcacagtttgtccatttagcaattgaagggcatttgggttactcccagttttaggagatgatgaataaggctgctgtaaacatccgtgtgaatgcatattttcatttttctggggtaactacctaggtgtgggattgctgggtggtatagtaagtatatgcttgaagttagaagaaactgccaaactttttcatagtggccacgtcactttactttcctgtcagtattgtatgagagttccagttgctgtcaggtctaccctacccttgttactgtcagaatttagtgtcgtttgttttaattttagccattctaataagtaagtagtactatctcattgtgattttaatttgcatttccataatgactaacctactggctaagtcagtttttcaatttctagaatctcagtatagataacacagaataaactatcatttaagtttgttcctgtctctttggaatgtgtaatgtattaggattctttgaaaatagttcttcaaatgtggtaactctaaagtagaagatacataaacagtatctgaagatatctgaatgtctttaaatatatctacagccatactcttgtggattaaagggtcagtatacaaatcctgatctatttcccttctttgagaatattatgaataattaattgttcatagtaactcacctagagttacatagtaaaacattttgaaagttaattgaaaatgatgtcttatggtattttctctcaacttcattaatgctgcttggaagtgaattcgtgtatatgagaaaaagagataagcagtaaatgattaaaatttgaggtttacgttttgatttccttccatgattcaggtttcaggtttcagacttaattatctgtcatttagatacataaggaccagccagtgtcagtgcatccttggggtgacctttctacacatatcaaggttattgggctgataacctccagcccagagaaggtgacatctactttagaatcggaagggagtcttttctcagatatttaactgtcttatttttacatcatgttgtaactaaaaaatacattaggtatttaaaaaatcaattataatttcaaagcatcagtgtaatgatgtttttgatatctttttcttaatggaatactcagggttatgaataaaacaccaataaagtgctagcattattgattgtagatgaagttgtctactgggtaagtgcttcccagcttaatgttccttaatgtagttcctgggttcagatctaagaattttataacctttgaaattaaaaataacttgaaaaaagcagatgattcctgtatcaatgttaaaagtcttatgcaaggtggcaatgatttctgttgccaagatggaatgcccttggtatggagcatagactgagaggcagcccacccacgtcagaatcctgacttgaccatatactagctgtatgaccttgggctgtgtgacctgtctgtgcctctggttcctcatctggaaaatggggataataacagtatctttggattattataaggattatgttagttaatacacatgaagtgtttagaatagtttttgtaaatgtagctatgatgataattacagttccagctattttagtgtttgtagattttctccctgtgctgagccagataaataccagtattataaaagattgagaatgtgccttttaaaaggaagccaaatagttctttgtttttttttttttttttgagaccgtagtctcactctgtcgcccaggctggagtgcagtgatgtgctgtcagctcactgcaaccttcacctcccaggttcaagcgattctagtgccccagcctcctgagtagctgggattacaggcacgcaccaccatgccctgctatttgttgtatttttttttttttttttttttttagtagagatgggatttcaccatgttggccaggctggtcttgaattcctaacctcaagtgatccacccacctctgcctcccaaaatgctgggattacagacgtgagccaccacacccagccagaagccaaataggtctgacatactctttaccatattaggaattgattttaagtttattgtgctactttgcatcattattagtaatactataaagaattaaagtatgaagatcatctagaagcagattttatgcttccacatatacaaaattatagactcactatgctaagatagggagtgtttccataaattcaatattctggttagacaaataccttctttaaaaggtgaattttacagcacttagggaggccaagatgggcagatcacttgaggccagagttggagaccagcccagccaacatggcgaaaccctgactctactaaaaatacaaaaattagctgggtgtggtggttcatgcctatggtctcagttacttgggaggctgaggcaggagaatcacttgaacctgggaggtggaggttgcactgagccgagatcgcaccactgtactccagcctggttgacagagtgagactgtgtctcaaaaaaaaactaagtgaactttgttagcgactaagaacttactctaagatgtggccaacttattggttacatatgaccttgggcaagttattttaacttctgattatttagtctcacttagctttagtttacttgttttgggggctaatgtattgactaaatatggtatttaaaggattaacaattcttgataattagtagaatgactatactaagagctcaataaaatgtaatctacagttatccttcaaataccatgtaaacttaaaatataaatttcaactgtgattttcagtattctgattgctttgttttcattttatttatgtagtatttaaccataaaccccttcttatttaatctcttgctgaaaccattttaaaagattttcttgcctttgtaaattctgtttagtggttgtgaagtgtctgaatacattccttgaagtcactgactgggtttgaataccagcttcagtacttacaagctttgtgaccctgtgccacgttatttaacatcttcgcaacttagtgtccttataaacaaaataagtgtagtaatcttaccacttagggttgtcgtaaggattaaatgcagacacatgtgtaaagcacttagagcagttcttggcacatagtaagtagtagttagactaataattgttttattgaggatccttttggagtttgggcagtaaatttattgaggatccttaatgagtttgggcagtaaattccttacagaacttaaaatagcaaagaaggcccttaggtgagatgggacattgatgtgtaaacattcctgcatagagataattctatacattcatgctctatttttggtaggttatagaggtataacatgagacgtgtgggaatataaggtacatgaactggactgtagtagcagcaacaaacatttacggagagccaactattatatggtgaggcatagtcccggctctcaatatgagcagcttgctagtaacaaagtgaaacaagaaaattactttgagtcaatgatctgattgagaagtgccaaataagtagcccttgaatacaggaagacagaggtttagagtcgtgagtaataactggccttatttaaagagagacagggtggaaagttaggaagaaaggcattccaggttggggattgcagtgttcatggtgtattatagactagcttagagaaatagaagaaaagcttatagagaagaaagacataggtaactgtgaaacgatattctgttattccttaacttatccacttaatatttataaatgagagcctattggatgccagagactatactacaaactggggtgaacaaaattaactcattccttaaccctcactctatttgcagtcgtaaggtaaagacagtctttattattattatcattattattattattattttaagacagagtcttgctttgttgcccaggttagagtgcagtggcacgatctaagctcactgcaacctccacctccagggttcaagcaattctcgtgcctcagcctcctgagtagctgggattacaggcacgcaccaccatgcctggctaatttttttgtattttttttttagtagagatggggtttcaccatgttggccaggctggtctccaactcctgacctcaggtgatccgcccacctcagcctcccagagtgttgggattacaagcatgagccactgctcccgacctaaagacaatccttaaatagtaattactataatgtagtgagtattatggtaattgaaatagttataggattctgtactgggcaactggaacctagcatataggataggatttgtggagggagggaaatgacttttaagctgagatctgagagtaggaattagccaggcaaaaaatgggaggagatgtgggtaagggataggatgacagaacaacaggctgggaagaggatgagaattcccagcatgggaagtggagcaagggagtgtggccagttgaagaactgaaagaagtctggtgatgatgggggagcaatcctagggaaccagtggcttgacgtgaggctcaagaagaaataatgctaaagtgctttctgaaccaggtttaaaagatttagcattatccccagagctgtgagatgcccataaaagactttaaatagggggagacatcagatttttacacattggaaattcatcagtttcatataaaataacttgcagataaggtgtaagcaatgataatcctcttggatttcaagaaataatttttccagtatacattgaagttttatattagaatttgttaatattttctgagataagcttacaacataaaagccaattaaatattcttactaaattgcttttcttttgaactttagaatagctagtgtcattgatcacatttaaaacacaaacacaactaatacttctctaagtccaatactaactggtgaattttgtcctgatgttactctcttagaatttgtcagaccttttcattgcatggactccgagccctgtcttctaggaatgaagccaggttgaaccaaattagcaataagccagccttcaggattggatagaaagttacccaccctctggaaattaataattggcatactttctgtttatgcattctgtaactgcttgcatggcttatgtgatctgaaaaaaacttcttaactgctttgagttagtatgtcttatagtatcggataatagattgaaattgatagacattatctcagattcgtaacttcaaaaggctatttgtaaacttagttgatctctttattttgaagagtgaattccccagttttcaactagctatgtagaagaaattgcaatttgtcacttttcgttagaggtttagtttctgtcttagtctgcttgggctgccataacaaataacatatcctgggtggcttaaacagtaagcacttatttctcacagttctggaggctgccagatctaagatcaggatgtcagcatggttggtttccagtgaggaccctattcctggtttcctcacatggaggagggaaagaaggagagataggaaaccagctgtcttctgtctcttcttctaaggataccagttccaccagaagcactccacctccatgacttgatttacctccccaaggccccatcttcagataccatcatattggggattaggatttcaacatatgaatttggggggacacaaacatttagtccatagcagtttcccataatttgacactgcctcagttagccattggagccttaatgtaaaataatttccttaacctaaaatggaatggggtaccttaattgaaatatgtttgcagtttgaatgatatgtaaactttgaagtttacagcttctgctagcagattaaaaactttttttttaatatgacatcagacatttttgaaaacagcactttggacgttgcaatttgcacgtttacttattaaataacactaattgtctaacaacatggctcacattttagttgccaccatactttatcttttaactttatacattaactaagatgtaactgcataaagtacaaaacttgctggctaactcttcagtccacaaagcactatgtaaataacagaagctcatcacagtcagtgacaagtcatgtcacttatttcaaagtctatctgtgattggccactgtgcatacagttcacacacagaagtgttagtgttgcctctctgtcccccatgagaaactcatgatgttttaaaaaaatggataattgaaagagttgaccaacagagataaaactgcaatgaattaacaaaaagtgttcatgaaatactagaagtgatagttgaatcaaatataaatggagttaaagaagaaatagctcaccatggaaatgtggatgctttcaccatttgaaagactatagatatacagccaaaggaatttagtgaaggtaaacttacatacatgatacaagtggtatgacaaaaaggatgaagatgtcccagaggaagtgacactagcaaaaactttgcatactgaaggagctgtcagagatatttcatgatactgaaagagcaaaggacaaaatgttttaagttgatccagacttaggaaggagtgtgacagcttgccaaggcataaaagatacttgctccacatcataaattatatgattagaagacaagcactatttaagctattcttgttaagttttcacaaagaaaagtaacacttctcaatgtttttaatgttttaattacagtacactaaataaacactagttttgctattttttccatttccatatgtacatttataatcaacagtaagagtttttaatgtttttaacatgaacttttatcttggaataattataatttttcaattgattattaagattgctttacatgctgcctgtatattacaaatatttgtatattacaagtagtagtttataaatatttattagttctggtctctgcttttgagacacaggataaagacttaatctagtggggaaattagttacataaatgaattatatcattcaaagtgctaaggtatactttgctgctttgacaggtgggtcagtgaagattcagaggtggtaatatttgagctggtactggtgcatgattttgccagtttgataaagggggaaaggaaaaggtgcctatcaaggagatctgaaacaccagcttgttccacaaactaggccagaacaaaagctgcatctgggtgtggtaagagctactagaaaaaggcaatgtggggcacagatttgtggaacctgttaacggattataagatacttcagtaacagactcggaaagttttggggtttttttcttttccctttttttttttttttttttttttttttgagacggagttttgctcttgttgcccaggctggagtgcaatggcgtgatctcggctcaccacaacctccacctccagtgttcaagcaattctcctgcttcagcctcccaagtagctgggattacaggcatgtgccaccatgcccggctaattttgtatttttagtagagacgaggtttctccatgttggtcaggctggtctcgaactcccgaccttaggtgattcccccccacctcagcctcccaaagtgctgggattacaagcgtgagccaccgtgcctggcccagacttggaaagtttttaagtggacaaataaactgatcaagtttgcattttaagagacaactctggatagtgttgtaaaaaatggtgttatagtaattcagggtagagatgttggggacctgaactaaggcaatgtaaaaggaaaggaaggaacaaattaacagctgcttaagggatagactccgtaatacttggatggaaagaaaagctgagggagaggaaaaagtaaaatataacttgtagagatacatattatctaatttcaaagatataaggattagattactataatgactgttctgtgatcttggtgtaggcctttccttactttgctggatggggtgggggcagaagtatagggaggaaatatttgtatgcttcatcgccagtgtttttttttgttcatttctttgttgttttacattttgttgattaataataacgctatatgagagaataagattcagcagagttcaaaagtatatgttgggtattcttttcctgtttttcatggttgtggaaactcatattataaaaacttcagttaggtcctggatgatagtgttgtagattgcactgttgagaattcttttcctctagaatacagagtagttctagaagggagggttgtccctctagaaatagattaagagtaatttaggaattcacttctggtctttctagaataatctaattaccaatgaacagtcttaaggaagagaggaatgactcagaagttattccaattatttttggacagtagaagtcttaatttctagtataaaaccaaaagtgagtacattattgttattatttttcttaattgcttctttgcattcatagccatttgtgttctttggttgtttcaaagtctgtttaattttgcatattagtatatgcattcttcaagtagttatatggctgctaaccataacctctttgagtttgtctgtggttgccattattaaatcagagaaagacatgcataataaaaatattcctttatttaataatctctttgcctccttgtggatgttctatcttctttctcctaaatacctatttccttaagagatgtgcaggataatcatcaggattttactgtgaaatgtaaatgagtcctaacattagtcttttggcctcatattcaacatacccagacttgcttctcttctgcgtaactttatcttggctaatggcatgtaatttaagagtgccacctctgaaatcacactcatctagagtcaaatcctaattcctacatatgctaactttatgaactttagccaagttatgtaacttctctgtcctttggctccaccccccgttttctcatctataaaacaaagagattataatagtatttaccttttaacatttttttctttttcttttttgagacggagtctcgctctgtcgcctaggctggagtgcagtggcacgatctgggctcactgcaacctctgcctcccaggttcaggtgattctcctgccttagccccccgagtagctgggactacaggcgtgtgctaccacacccagctaattttttgtatttttagtagagacagggtttcaccatgttagccagaatggtctctatctcctgacctggtgatccgcctgtttcatcctcccggagttgctgggattacaggcgtgagccaccgcgcccgccccttttaacattttttgttggaattaaatgagaatgtgttaagtgcttggtacatactaaatgttcagtaaacaaatcttagtgctattatcatctatttaattatcaagctaggaactttctagcttcccctcttcaccttccagctgtcctctctcatctgaaatcagtgtccttgagacccatgattctagcttagacaactccctcatatttgcctccttctcttcaccttctgccttatgtcaggccctgctctctagaatgttgtggtaaattttctgccagactctaatttgtgcttcataatcaaatcaaaattatgttaataaaacaatctgagagcctccattgtctacaggatggtttctcttagcacatttgaactcccacatcttttaagacccaggtaaaaatgccatgttaacctaattaatctttcacgtttaatgttggttgcctctgtgacattttgttcttttatatttttagctcattttacttgtctgtgtctctcacttggactgtaagtgccactgggatggtaattcttattaatttttatattccattgcccaacttagtgcctggcatatgatagttacttggaaagtatttattaattagtgcattgattatacacctgaagagccacactcttcatctgtttgcctcctctttcgctttttaaaggtctgagtgactaaagagatcagaacaggagggcacatcctaaaagcaggatgccccatgatccccaactctaaaatcgaaagagaagtttgggaggagaaagacctaaaggggtcaagagtaaagacaatgtatgattgaatattgagattaatgtctagtgtcctttacatttcaatcaatattaaggataatattataaacatcgtttttacaaacttaagcattaattttacttgtaggccctgtctttacacattattggcaatagagtctcagtagaaacatcagaagagtttcaggcattggaaaggaaagcaagttaaaaactcttctattgtcatcgtttagtaaagaaaagaaacccaggcctaagacaacaacaaattgtatctgggaaactggaaataggttaattcttggtattctgggaaagatgactagggagtagccaggtgccctacaatttgatattcctcaggaagccattgtctccctcacaacttggcagcagcattccctttcttaccccatccaactcactctctgcaggtgccattgcttgcagtttttcttacttctcaagttgaaacattctgcaaaaggctttatgatacagttggtaaggtagagtgttgctagtcatataggtcaggttatttttggttgggtaatttattgtatgatttggaacctaactatgtagtgtttttctgtgatgaatctgaattctcagacttacaagtggacttttagaacataaacactttgcacaatagagattgtcttgagcaaagaaattcattctttttagaagatgtgagagagaacaggatgtctgttcagttttatttcctttttctaggggaatctctgccactcttctagttagtattgaagtatattttaattctgaagttgaagataaaatggattcttcagacatacaacttgtattagtaaattataattttactaattataaattagtaaaacttgtatttgcttttattgatggtttaaaaataagtttcttgttgagattgttttgagtaatgagagatctttaaaattttcaaaaggaggattaattcatttgttaaatatttcttgcctgcccagcactgtgctaggtgctgaaaatacaatggtgatcaaaatagacattgcctttgtcttcttagacagtttataatctattaggaaagaaagatagcaccctcctcccccacccaccaacaacaaacaaaatgaatataaattttgatcagtgatatcacaggatactgaaatacaacagtatggggggacataggacattggagggctagggtagctaaaaaaggcttctctgagaatatggaattaatgctaaaacctgaaagatgagagagagttagacattccaggagtggagtagcatgtacaagggcactgcggcaggaaagagcttagttatatgattcttagaactaaaaaaggccagtgtggctggagcaaaggaagagtagcacaggataaatttggaggagtagataggctgtattgtgtggggctttgtagacctgatacggcatttggattttatttaagtgcagttagaagcagttgcaaaggattttcagcaggggaatggcatgaaagcgctgaaaagatgactctggctgttgtatgcaaagtgctgaatggaatgaaggagaccagttaggaggctgtggcagtagtcagtgcaagagatgatggcagcttgaaatagggtggtgccagtggagactggagtggagatttttggaagtggatttgacagtttgctgataaatgtaaggaatgagggaaagcgaaaatcaatgactttcagattcctagcttgagcaactgggttgacggttggtgctagttagtataataagagtagggataagaaaaaaaattgggttacattttagataaattgagttatctgtgggacatcaagaagagatgtgagataggcagtagggtgtataggctggcgtctgagtagaaggttgggctgctgacaccagtgacgaaaataagtgtcttttaaagctatgagaatggatgagacacctggagagccaatgtaaggaaagaagcacacggttcctagaagatgggaagggcagcagagcgtaggaggtgggattggctttagatagacaggaagagacactttttcatgttaacacaaagacaggaggcccatctgggtacaaatttaagaaggcttatagatgggttggcgtgaaggtgaaagagtttgaatctgatggcttctgtgttttctgcagtagaatccatggttgtctactgagaaggaggaggattctcagaagtgtgagaagttcgaaacaccgtggtagacagaaaaaaatagtaggtttccccaagggtgtcttgggcagtctgcctggctatgaaatgaaagagggaaaagtcctctaagtttaatagatgagcaactaagtggtataggtaaatggtatgagcaagtagcctgaaaagcaggagaaagacgttttctggtctgctgagtctgcatggcttgcttacagtaggtcagaaccagcttctttagtggctttgtcactagaacactgggattgtagtgttctttacctccagtcaactcttgattatggtaatagttatatctcatttggggctcaagaggatcctaaaacaaaagtaaatggtacagagaattacaatattagcagagtacaaaagtatatatttatcagaaataagtcacgtgcccagaaaagttatctgtgcttataagtcacaatgacatgttgccttagcaaagattatctaatgtaaactttgcttctagtttatggacgtgtgagaatactaaacaaattttgcatttctttcctgaattagtactttaaaaatatgcaactagaaatttatcctccctaaaagtaatattttaacctcctcttcattccaaactctaagttgcttacttatttttaagatgtggttacttaaggtaagaaaaagtaagttatttgatcaactttctttttttaaaaaagaattacttcatttttctctttagtctgacaacattatggcattaaataaagtccaagaggtattgggctggtctttgtttggtctctggtggtttagatgaggcagaactgagtctccaggaatctgaatattatctcaaaaagttagtagcagccactgtgcaaagtttgaaggcccaagtcaaatctggggcatatccatggatgtgtggtaaggcataggctccagctctcgtgcagaaacaacaggagtgggatttgatcaactttctatgcaaccttgaccacccagagtcaaggggtcctcccacctcagcctccaggtagctaggaccacaggcacaggccaccatgcctggatttttttttttttttttttttttttttttttatagggatgaggttttgctatgttgcccaggctggccttgaacgcttcggctcaagccacccacccacctcaaacctcccaaagtgttgggattacagacgtgagcctggccaataattgcgtcttagtagcctgtatccaaacagtcaagtaggaattggtaatcttattaggaaaacattaaataggatgttttcaataatgtctcccttctctgtgctcatattttctaagtgtaagcaagctggaattgcataaagtggggcataatattttctctagcaaaaagctttgaaatatgtatttttttcttttttttctttttggtgactcatggagtgggagagcactgtgataccaaaagctgtttggtagactaagcaatatttactcagcctctaatgatgagaaacccaagccttctgttccttagaatacacagatgtttatttgtaaagcaagtgtacgaccactttctgaatttgaggagcattctgttacagttgagggaggatatttttgttgattcagtcaatgttgtagcaatttgcaatgttaatgataggagtttgagtgtctgtcagatactgttatgtgcacgtgatacggtgtgatgggatctgttaaataagggaggagggacacagaaataattctttccagaatgctggcaaaatgttttgaagaattaagatattttactaaaatttattatagaagttagaattttgctaggtatagtaaactataagtagttcttgtcttaaaagaattactaaacaagccaaatttataagtaaatcataaaatcccttttcttccccagagaaggaaaacaagtgatggcttcataatagtacagctttttaccccccacgccccacccccgagcctttttgagaaagcttgtatttgtgatgggttacttctgaaagtttaacatcaaaatttaaaatataagatatactgaataaaagttggcctgtacctggaggataactgaaaatcatgaccttggagaaatggactctcagagcaagtttttgagcgtagtctatgccttgaatggttttataatgcagatgaatgaatctactccggtgatgtttgctaacttctggccaagtgccaggctgagtgtgtgtgtgtgtgtgtgtgtgtgtgtgtgtgtgtgtgtgtgttgcacttggtcatctaatgtttgaaataccaagcctgccattctggaaatcagaaatgtttatttagaacatagtccagagtctagattagaacatgtaagggagttcctgtatggaaagttttccaaagctttagtttatgcaaattcagggaatatcaacagttatttcattatggattttgatgccacatggaaaactaaaccactactttagtgatacagtagtattttcatttgcttgccattattcgtaagtattttaaagtcatcataatgtgttcatgcttctactcagtctttagctagaggaaagcttcaatgtgtggatgtctgaaatctgttctgcacatagtgggtttttcaagttacagttgcatagtctgttatgatttaacttgccactttagagacaagctgtgctgtaatacactagataactaagtgctttcaagagttaccgcatctgtgccgggcgcggtggctcatgcctgtaatcccagcactttgggaggccaagggggttggatcacttgaggtcaggaattcaagaccagcctggccaacagagtgaaacccagcctctactaaaaatacaaaaattagctggactgggtgtggtggtgcctgtctgtagtcccagctactccagaggctgaggcaggagaatcacttgaacccgggaagtggaggttgcaatgagttgagatcacatcactgctctccagcctgggcaacagagcaagactccatctcaaacgaaaaaagagttgctgcatcgagataaactacctcacacacacacctatatacacaatttgtgcagttaagtgcttttttttttttttttttttgagacagagtcttgctgtgttgcccaggctggagtgcaatggcacagtcttggttcactgcaacctctgcctcctgggtgcaagccattctcctgcctcagccttcccaagtagctgggattgcaggtgtgcaccaacaggcccagctaatttttgtatttttagtagagatggggtttcaccatattggccaggctggtctcaaactccaacttctgacctcaagtgatttgcccaccttggcctcccaacatactgggattacaggtgtgagccaccgctcctggcctttaagtactttttgatgtgcagttagtttttatgcttgcctgggcaaatgcttctcagttggtgtaccatcatttttctcaggattttcatcagtgtatacaatttgtttttgctactaatgaatagaataggtatgttcttgtgatagtctgagcagagccaattgtgtgacttgatatggagatactgttagtttcaaaataagataggtagtgtgatataaagccagcaccaaagaaagagctaattttctggaagttgggaaaacattgctttgcctgtttgagggggctcagtcgggtctttaggaagttttgaagtgatactctgctgaagggcaaattagtgaatgataattataaataattataaatgatctgaaatacgaaatcatttcagccacttttaaaataatgctgtaatagctttccctttttaaaaatgaagctaaaaatactccttgggtctgccatttcctttctatctaccagctattattctgtgtatttaccagctattattctatctattgatcgctattattctccttgctgcagtaaaatatccaggaaaagttttctgtatttcttatttgtacttcctcacctcccaaccattataactgaaatggttgtcatttccactctcacattaacttcttgcacactctcttgcaagagtgaactcttgcatacccccatcaccacacttcttcaaaattatcagtaatgattttgaaacaagtgactactgcttaaaaccatttcctagacccacagagattctgatatatttggtttgagagatgtcaccaaggtggtggagtatctgcccataaaaaaaatacagacagctgttcacaaaccaaaatagccctagtttagggtggggccaggcatcagtattttttaaaagctgctcagatgattctaatgccaatcaggcagaaaactactgctctagggccttatctcatacatagtaacacctaaaccatgcactgtgacctacaaggctcctgcctggctctctgatgccacctcctgctgatctccatttcctctcctctagccaccttggtctccctcaatggtgctggaactttgttttgttcatcatcatatctctagcactagaacagtgccttcttgcacacagtacatgttcaacaggtatttgttgaattcacgaattcagcacgtctgatgttcttattctgtggtagtgattactctgcaagtagtgctgactaggttggtagtgtgttgagtcttcaggaatgctactgaaaagcccagtatttgaacataagtcacaagcccccacagtccagcttacccatcttctaacactgtcttctacttcgctgtcagaacacctacttttctgtttttatcttttgccatgagtggtattgacacttctgatttttttctggtctcctatttctgcttttattttgtgtaattttttttctatattgttactcatccactagtttctctgggtaaaaaagactagttttaccagcgttgccagtcagtaagagagcttattttttttctgtgggtaaacggaccactcataggatgtccagtatgtaatctttggatcctatccccttctcttggtgggtgcaggttgatagctcctttgatgagaaactgaggtggaattcatgggggagggacaggttttaaagggaaggatgagtatcaggggagatatatgtttctgaggtcacagttggaagcctaattgatggaaaattgagattttattgtaccattatctaagtgcaagataacactgcttacaacaggggcctgcaaagttttcttttcttttctttcttttttcttaagtatggatagtaggtattttgggcttttgggctttgtgggccgccatgcagtctgtgtctaatgttgtggtgcagaagtagacatagacaatgtgtgaacagagtagtgtggctgtgtttcataaaactgtttatgggcattgaaatttgaactttatataaaattatgtaaaatactgttctttggattccccccccaacccccaccagttaaaaatacagtcaggagccatgtaacagtgtttcagtcaactacagcagactatacaaccgtggtcccataagattaataataccttaattttactataccttttctatgcttagctacacaaatatttatcactgtgttgcagttgcctacagcattcagtacagtaacatatgtacaggtttgtatcctagaatcaagaggccataccatataacctaggtgtgtagtaggctatactgtctaggtttgtgaatacgctcgttgatgttcacacaacagtgaacttgccaaacatcgcatttctcagatcttatcccccttgttaagtgactcatgactgtacaaaaactgttcttagctagtgagccataaaaaggcagaaggcaggatttggtccttgggccattcatagtttgctaacctccagcttcacatttatgtagttttgacttggaaagtcgagttcttgaccagtagtccttttcatacctcacattataaaaattctttagattttgtggttggtggcacattacctctttattagtgtccatatgtaaattttgtacccaaaagctccttatcacgttagtgtctttgccctctatgttttagcacctactcctgggccacattgtttgagcctgtcttttattatgtctttgcagcgccctgcttctacaataaaacagctgttttttttttttaatttaataaacattcctttcaggctgtaacaggtgctatggaggcccccctctttcactgtagttcacctgcactcctggtgggcagatccccaacatgctgacaagctcttttccttaggtgcagggatctctgagcttgctctgcctgagtgcagggcagccagccccatgctggcagccaagaagtgttaagagtttttaatgtaatggccccaggagtaacccttaacaaggaagtggagagatacctcatctttctcctctgtgggagagttctgaggcatgccctgaaggactgaactgcaggtgctcacagcagtgaggaacctccagttggcttttctccccatctcactttcactgatcccctcaagtgtgcttcctgggatttccttcccacaaataagctgcttgcacccaagttcttaggtcagggatgccttctggaggaacccaagtgacatgtgctggtggactcatagtgctcttacagctctttttctccttgcctccccacggggagtatatgatggagcttccttagtgggtgacattgacactagatgtgagaaagaaagtattacaggttgaatattccttatctgaaagcttgagaccagagtgtttctgatcttgaattttgaaatatttgtattgtacttaaccggttgagcattcgtaatccaaaaatctgaaatctgaaatgttctaaagtctaaaacttttttttttcccctgttttctgagcattttggatttcagagtttcacattagggaggctcagcctatatatactacctaccgatcattcagttcagctcaacagtaactctacttgattaccagcattctttgcaggttatctttttctgcccttagttttctgttcctggaaagaaaagtaatatgtgatcagtcatctaaccttggttgtcttctataaggtagatcagaattttctgtttccaaaagttagttggcaaattctgtgctagaaagtagggtgtagggtactatatacaattaagtatcactgttaagcaagtagttataaaatagcagttacatgcattcttttgccaaacttcaaataacatgattggcaggactttgccaaaaccacagatgttgaaatttcaaaatggtaatacgatcacaagtagctgtagccgtaattctcccattaaaatacttattgattaaaataggtttttaatgtctggagaattgaaagtctttttctacctgtggcatgtttcttccataatgagaacttcagtcgtatcaagtaaatttcaccattgtagaaggtgtttcagccatataatcaatgtggaaatctgattttttatttagggatagactagttatgtgtgtgtgtgtttcaatttctagattaatacatacttttaaatgtcttaaagttgataaactctttttaaaggtacgactatattaaaatgagctttatctcagaagcatgatagttttaatttttatttgcaaaaaattattcacttttttttttcttgaggtaggatctcgctctgtcacccaggctggagtacggtggtgcaatcacagctcactgcaaccttgatctacctcccaggttcagtccatcttcccacctcagccacctgagtagcagggactacaggcacatgtaccatgcccagctaattttttgtagagatggggtttcaccacattgtccaggctggtcttgaattcctgggctcaagtgatctgcccgcctcagcctcccaaagttttgggattataggcgtgagccactgtgcccagcattcacatgtttttccttcccctggaagttgttttccttgagacagagtctcgctcccttgcccaggctggaatgtagtttcacatcacagctcgctgcaaccttgaccttatgggctcaagtgatcctcctacctcagcatcctgagtagctgggactacaggcacatgccaccatgcctggctaattaaaaaaaaaaaaattatagagatgggacttcaccatgttgccttgcctggtctcgaactcatgggctcaagcgatcctccagcctcagcctaccaaagttctgggattacaggcatgagccaccacgctgggcctgttctttttgtgtgtgttttgttttgttttgttttttgaaacatcactttccctttttttggcacttagtaagtttaacatacagttgatcccagcagtctttactttgattgcagctttaaaaaccaacttcctatcctagtcataagtaaataaataactagttgaagttggattttactgctacaagtttattgttacgacctgccttatctgggggtagctaaatcttgtgtaaattacattcttttctttatttggtttcatttagttgcataaggctgttaaatagttgaacagatattaatgtttcctgttatacttgtaccaaaacgtgctcagagaaaaatgttgggcagtgtgactttagatccattttcggggatctatttgggagagcacatgtggccagaatgtagttttttatttttttatttttagagctttctcttaagttatagtgtttctcatgggtgttttccctgttcctcctcttcacctaggatattggtctctgttcactttggttccccatcttttcaccacccattattcaccttcacacatttctgcaacttcataaaccacagtctgttcagtttctcatcagaatgttattgtccattcctataggacgagttccaagcccaccaactccttgtctttattaatccttcctattctagccctcaggattctgttttctgagaataagagggtactttctctgtcatccatgtgtcccattttgtagttgactcaaacattcttagttgccctatatattctgcctcagctgccttgtgtactggcttttcaggacagagcgtgttttctcagctgttaatgtttcttttgtacctgtcacataacagtaacttagtagttaattattgctgttaaatacccaattatctagttttctgcttttaatttctcaaaatcaccttggtgatttttaagtgatttgtttattgtttgttttttatagatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttagtaagtattacataaattcttcttaaaatacgagttatgtgatgtacagatgaccgatgactgacatagcttatcccaagggatggggcatgggctgaactatctgtatatatgtatgtgtgtgaaatttctacttcattaaagtttttatattaagataaatgctgggttaaggtggaacaggaagaacctagtagagattctttccttactagaattgtatctgatatttaatactttatttttatggagaggttaaaggaacaggcactattttcaggggaacatacatggctttgcaatgtttccttcacataagtcactatttgattttagtgattcaggcagattgtgtcacttcctccattgaaggcctgacacagctcctaaggaaatgactatgagtgttgtcttccttcaccagtctacaatttgaacatctctgtagtatttctatttatgcattctgaaatgagatgtgggttactttggctgacccagttatgtcatatgacaggaagtattcaaccatctgagaaaatgtgaactgctgtcactaccactagtgcagaactctgctgtattttttcctatttgagaaattcttggttaaagatacatttagtgacttctcatattttaattccaaataaagtactgcagttttttattcatgttaaatttttaaattatactagtaatttataaatacactctgttgtaaaagaatcaatgaatatagacatacatagtaagctcccccttcccctaagtaatcattcttgacagtttggtgattttctatgcatttatttgtccatacatatcggattttttttaataaataggagcattttatatgtattttttaaacttagtaatgtcttagagatctttctatgtgttatacattcttttaagctgtaattcagagtatagacgtactattaatttacatccaattacttcttggcctttttggctaagatcaagtataatttataaccacatttccctgttaatgatcagttaggttgcttcactcttagagcaaatgctgcaacattttcaaatgttttaaatattgctgaaaacatttgaaaatattttagttgggctagcgccagagtacccaatcttccttgctggtgtcagcacccacactcactgctagagcctgtgggcaaatgctgctcctgtacaatgcctcaagcactgacctgtggacagtatggaggtgctgagactacctacctcttaacccagagccctgcctgctgcttatgcctgtaggcttggagcttggaggagtctgaatcctcacccatttcttgtgtttagtttgggctgtggcttcccttaaaccaataccaacttttttctgtcttcaagaatcactcattatttaccctcttactgtagtttcctgtctcctagcactgttatggatgttcatcttccctccccgcctacaatttttaaatatcttttgctgtcatttcaggggattcgggatgtaggaggggagatacaggtagattcacattgcctttttgatctaatgcccttgaaattttttttaaagtgaaacagggtttttattattattattaaaatagagaaaaatacaaagaataccaaattcccattatctggaattaataattgttgatattttgtcattttgtcaaatgacaaatatgacttgaagtcaaagtaatactggtaaaattcttgagtctcattatcctaacttccctttacaaagcaactactatcataagttcagtgtgtatccagtactgtaaaatacacagacacacacatacacacacacacacacacacacacgtatctctgtgtgtatatatccataaactgtatatgttattgccattaccacgtaggtattttcttactaagttttgtacgtgtgtgcaagaatttctctcgagtatccacctagaagtagaagtaaaattgctgttttaaatatatacataattcatttcagagtactgtcaaattgtctcccagttggttataccagtttatattccaactagcaatgtatgaaaacccgttgccacaaatcctcactaacacttgattatggtctgttttgttgtttttgtttccaagagaaaaagacagtattttgttttagtttacaaagctaaatatgtttttaaatcattattggacatctaagttcctttttttaattgtttatatcatttgtccatttttgagaaattaataaactgtagtttttacaggagttgtaggttcacagcaaagttgagcaaaagtacagagaattcccacataccctctgtcctcacacatgcacaaccttccctactctcaaagtctgtaccagaatggtacatttattgtaactggtgaacctaccttgacataccattatcactcagtgacagtagtttatgttagggttcacttctggtgttgtacatgctgtgggcttggaaaaatatatactcgtgtatctactgttgtggtattgtacagaatagtttgactgtcctaaaaatcttctgtgctctgcctattcatccctctctcctcatcaccaccactcatccttttacctagttttgccctttccagaatatcatatgtttggactcatacagtatgtagccttttcatattggtttctttcacctcgtaataggcatttaagtttcctccatgtttttttgtggcttgatagcttatttcttttttttttcttttcttcttcttttttttttgagacgagtctcgctctgttgcccaggctggaatgcaatggcgtgattttggctcactgcaacctccacttcccgggttcaagcaattcttctgcctcagcctcccaagtagctgggattacaggcacctgccaccaaaccgggctaatttttgtatttttagtatagatggggtttcatcatgttggccaggctggtctcgaactcctgacctcaggcgatccacccacctccgcctcccaaagtgctgggattacaggtgtgaaccaccaagcccagccagctcatttctttttagtgctaaatagtattccatcgtctggatgtgtcacagcttgtttatccactcaccaaacgatatcttggttgcttcattttgaataaagctgctgtaaacatctgtatgcaggctttcaagtggacatatgtctgttcgtccattcttcttttgttttatcgttcaccattgatttgtagttctttataaattctaatatgtgctgcagataatttctcctggtctattataaacctttgttcgtgattgattttatgtactttttatttttgtcttttttggtcatgtagaagttaacattggtttgtgtttgtggggtattgtttaaaaaagctattcctattttgaattacaggtatcatctatattttctgctagtactcttagagttttgtttttcatgtttactgcttttatctacttagaatttacttttgtgcatttggtgaaatagagatgtagtatagcatattttaggagaaaatgctagccaacactgtttattgaattgtctgttatttctccacataagcataatgtcagctctgtcataaaccaaaattccatgttgtgtggatctgtttttgtatgctctcttcttttccattgatccatttatatgtccttacatggatagtacactatttgaatgtctgtagcctcataataaatctctatatctgatagagcaagtacctcttctttgctgtttttcagaattgcgtgggttgattttggaattgtatgtttctatatgaaatttgaaacagtttgttaatttctagggaaaattccatagtaattgattggaaatgcatgcattaatgttatgtagatcttaccattcatgaataaaatctgtctccttttgttgaagtaatcttttttgcccttaaatcacattttgtctagaaagatattgtgctttttaaaaaaagttttcttccaggggctttatactttttctaattggatactgctattaggaatgctgtttattttttttcttataatctaatatctgataccttactgaactctttgataaattctgataatttattgattctcttggattttcttgtttttttaatttttatttattttttgttatgtatttattttgagacagagtctccctctgtcacccagtctggagttcagtggtggtatcttcgctcactgcaacctccacctcctggattcaagtacttcttctgcctcagcctcccaagcagctgggactacagttgcgcaccatcatacttggctaatttttgtatttttagtagagacggggttttgccatgtgggccaggctggtctggaactcttgacctcaggggatccgcctgcctcggcctcccaaagttctgggattgcaggcatgagccaccatgcccggccttctcttggattttctatgtaagcaatcatgtctcttctaaataataacttttctctcttcctttcccatttttatacatcttatttctttatcttatggtattggattaaacctctagtacagtattgcataatagcggtaatgatgactgttgttgtgttgttcctgacttaaatggaaatgcttttaacatttgacattcagtttaatatttgttgttgttttggggggagatcttttcctgttttgttttgttttttgctttttgagatagtatcttgctctgtcacccaggctggagtgcagtggtgtgaacacagcttgttgcatccttgacctcctgggctcaaatagtcctcctgcctcagcctcccaagtagctgggaccacaggcatgcaccaccatgcctggctaatttttatatatttttttttttgtagagacagggtcttactatgttacccaggctggtctttaacttctgtgctcaagcaatccacctgcctcggcctcccaaagcagtaggattacaggcagcagccaccacatctagcctgttttttgttttaattgctagcgcctttaactcaagaatgcatgggaattttaaccaaatggagcttagggagtgacttgcccaagatcacgcagagacagacaagaacctacctatgtggttcttgtcactctctgagacaagaatctggagctccttataccttacttccttatacctatcttcactggcatcctgtcatcaaatctcgtcacttttttcctataaaatgttttatgcattaattcttcattccacactctgctgtatagaatgaagttagatgttgagaagattttcaggttgttacgctaacactgctccaccttcctaaatatatctgtagtgggtggttggtctttcattactactactactactactactactactactactgtttttggctgcatggcattgaacttctggctctgtgtttggaaatgtcatatcttatgacatttccaaaatgtgagacaaagcccacctccctcctacagaaaccataaagtccagatagttgtttcccaaccctcctcatagatagagtgcaggcagttggccaagtctaggttacgtgcacatcagaaaatgtctcctagaactttgaatcaggaactcgtgactcaagccaggataacaaatacctcattctagtggcagaagtggtagcaacatctagcttctaaggacagagaagccatatccagtgagagcgctcatccatgcattgagtatattggcccatttactcccgagggatctcatagtgttagaattttgtgtttgcaatgttagaaatttaggttacaaaaagatactatgtagtaagcatgtctacattatcccatttatgtttaaatatccacctaaagatatactcagaggtatttcactagaatgttgacagaggttatctcggggtgatatttcaagtttgtgctttttatccccagttgtgttcttacacttttgcaatcgtttgttgttgctgtttttaacaatttaatatgtaatatttgtataaacaagaaaagaaagctatctttcattcaaggatcaaaatcacttttagctttttatgtttttgtttatctctagaatgtaaacttctaaagtcagaaacatgcctttccatctttgtattctcagcatagggcatgaccttagagaacattaattgaatgaataagaggaaaaaaatgatggaataaagaaataaggatcagttaatcctatcactgggatcgaatggaaagtaatgatctatggccaggcatggtggctcacacctgtaatcccagcgctttgggaggccaaggcaggcagatcacttgaggccaggagttcaagaccagcttggccaacatggtgaaacactgtctctactaaaaatacaaaaagtagccgggcatggtggcacacacctgtggtcccaactgtttgagaggctgaggcaggagaatcgcttgaaccgggaggtggaggtcgcagtgagccatgatgacaccactgctttccagcctgggcaacagagtaagactctgtctcaaaaaaaaaaaaaaaaagtagtgatctgttacaggatgttcagggaatttctgcttcactgggtagttacattatatttcctctaaacagtcttaacagctgttaagggtctgtgaactgtcagtattaatgggtagaaatttacataatattttgacaaattataagactaaagtctttcctgcagaaaagagagggtcttaatgagtggtaattttatttgtagatatattagagaatactccaagaactaaggcacttgattatgaaattgtcgaaaacaaaaggggttgtgctttatagactagtcgtgtttacatgaaggagcagataccaagggcacagatttcagaaatctaggaggtacataaaatttagatgatcacagtatttggtgagagtccaagtacttgacatgtgtgaatagatagatgtcttctcatgctggcagcacgacagggaaggggggtatctgatagcaggctctgtgctgcagtctacttaacatcatgaagaactgggggtagggtgggggtcaatatcacagagcagggttcctaggatggggtctccatttggaggaaaccaggagaaaaactagggtgtaaagatccagtcaaacagttacacaattgaggtttggctacaaaagtaaataagaaaacagctaattggtcttaaataataatgtaatatatatttaataaatgcatatttaatacataatttaacactgttattgctataaatattcctcagaagtctataaaattttcatatgtgtgttagaaaagagggaagggtatttgatttgccaagtgattaaactgtgttggcaaactctggcctgcagcctgctttttttttttttttattttgagatggaatctcactctgtcacccaggttggactgcagtggcgcgatcttggctcactgcaagctctgcctcccgggttcacgccattctcctgcctcagcctccctagtagctgggactataggcgctcgccaccacgcccagctaattttttgtttatttagtagagacgggttttcaccatgttagccaggatggtatcaatctcctgaccttgtgatccgcccgcctcagcctcccaaagtgctgggattacaggtgtgagccactgtgcccagcccacagcctgcttttgtgtagctcaagaactaattataattaggctcttatatttttttaatggttaagaaaagttaaaataatattttatgctgtgaaaattataaaaattcaaattcccatgttcataaataaagttgtattggaatatggctacattcattggcttaggtattgtctgtggttgcttttgcgttatagcagcagtattgagtagagctgcataccctaaaatatttactatctttacagaaaaagtttgccaaccccggaattacattatgggaaacattagtggtttatttttttcttttttcaccactgaaactgaacactgaagtgacagtatataactcttcccaggaataattagggttttttctgttaattattttggattagttgattttcaacccaagttattaaatatttccccttaattaatttaactctcttgtatctactcttgtggcttttgcttacttactgtacgagcagtagaattaaaactaagaaagatgaggacatttccattgctaccaaaatatattgttacctaaggttaccaagtaaatgtgaagggtgtgccaaacactgaaaaaggacagtgatccaagaccagcagaacactatttaaagggaaataacctacttttgctgaacactgacatcatttccaagctttttatttggtaaaaattatctttcttttataatttaactcttgagaaaatgcttctgtgtaataattttttcttccaaaaacgcactttcagatcagtgcttctgtgtaataattaaatgaagtttttgttgcattttccttttcttttggacagaaagactgttgtcaaagaacgtcatttttttttttaatgtaacgtattctggcacacaggcttcacaaatgaagagccttcttaagaggaaaggaaactttttctcccaaaatctgacaacagagagctactataaaataacatattttgtgtttagagcttgttaccattctgtgttatcaataggacatgtcatttgggtctttcggctttagatacatgctaattcattcctattttttctctttctgttctagccttatgaagaagaatctatttgatagggatggagaagcacaaaatgctagtggaacagaactcagattgactaaagctcagttgtgtttaaaaaatttttgtaattataaaagtgatttaggtaaattaagctgtacataaggactctgtacaaaagcttttagtggtaacaataaagattggatttttatttactctattttaattaatttatttatttttgagatggagtctcgctctgtcgccaggctggagtgcagtggcgcaatctcagctcactgcagcctctacctcctggcttcaagcgattctcctgcctcagcctcccgagtagctgggactacaggtgcgctccaccacgcccagctaatttttgtatttttagtagagacagggtttcaccatgtttgccaggatggtctcgatcccttgacctcgtgatccacccaccctggcctcccaaagtgctgggataacaggcatgagggatttttaaataaagatgaaaaggaaatgaaggatcacttaaactacttttttgtactgcagcctccacctcccgggttcaagcagttctcctgccacagcctcctgagtagctgggattacatgtgcccgccaccacacctggctaacttttgtatttttagcagaggtggaatttcgccatgttggccaggctggtcctggactcctgacctcaagtgatctacctgcctcagcctcccaaagtgctgggattacacgcattagccaccatgcccagccagaaatctagatttaacagtgccttaaactaataagagccttctttttcacataagaagttacttgagaaaatgaagtggttgctggaactggatttgttgttcagttgtgtcttcaaggacaagctctttccatccctcagttcctcacccctcagcatgtcaggttggcctcatgattgtaagatgcttcctagagctccaggcatacgtgggttgagtagccctcatctgaaatttgaagtgctccaaaattcgaaactttttgactgccaatgtgacattcaaaggaaatgctccaatgagcattttagtaaggttaggggtgctcaacctagagctgcattcaggaggcacctctctctctttcacctctctctcttccacacctgtgtcctaacagcaaagcagaacatcccagaagcccccctcacatcctcctggcccaccttgggtcatatggctgcccttagctgcaagggagactgggaaaacatgaatatgacttgacttttccagtttccttatgctagccgcaagcaagagggctgagaaatggcaggtcagttagcccatcagcagacatgccacatgcctttttaagtatctagtcagtcaaactgagcaatagagccaggagtttaaagaaataaaaaatgaaatttttattgaggacccaaggggcgtcttataagccatgtcctttaattttatttatccttttgatcagctttgttaaggtataatttaaggcaaaataatcgtaatggcaaaattcagtgcattttgaccagtggaccaccagcaagatgtaggacagttccctgatgcccctctgctggcagtcctctttacccttccgacctctgccaaccatttatctgccctctgctactatagtcttgccttttctaaaatgttagataaatggaatcctatagtatttggtcttttctttatggcttcttccacttagcataatgtgtctgaccttcatccatgttgtgtgttatcaactccatcttattactgagtagtactctgttgtatggatataccataatttgtttatccattcaccagtcgaagggctgggctcattattttaaaaaaaagcttctatgaccattcacttacaggtctttgtgggaacataggtatttactcaagaacaataaaaactacggtaggtttctgggtcatatgataagtggatgtttcagcttgtaataaatagtcaaattcttttccaaagtggctgtactattttgcattctgccgggcagtacttgagagttccagttgctctgtgtccttgaaacatttttcagtttggggtattctagcaggtgtgagagcctatctccttgtggctttaattcgcattaccctagtgactaatgatgttgagcatctattcatgtgcttaattgccaccccatataatggtgaggtgtctgtttgagtccttcgcctgtccgtctttaaattaggctgtcatctgattgtgttgtaagcattctttgcatatcccagatatggacattttattggatatgttttgcaaatattttctcacaatctgtggcttaccatttcattaacagtgttttctaagagcaaaagttttcattttggtgaagaccaatttatgaactctgttgtcccatttcttttctgtttccctcctttctagtagattaaggggtttttggtggggttttttttttggtggggggtggttgttttgattatattcatctccacttgtgaattactagctattacgaccttcgttttgctattttaatggttgctctagggtttacagtatatgactttaacttattcagcctaccttcaaataatatactacttcacacatagtataataaccttacagcagtttagtttcatttctcccttcctgtcctttttgtgtcatgtattttactcctatatatgctaaaccccacagtacgttattttcgccctaaagcagtgaagtatttaaaaatgagcaaaatggtttttcatatcacgtatttaccatttttcagtgctctttataagtatcctttccatgtagtctcctttttcttctacctgaagaacttcatatgcctctcttcttatagtgcaagtctactggttatgaagttttgaccttttgtttgtttatagaagttttgatttggtccaggcacagtggttcatgcctacatgtagtcccagcactttgggaggccaaagatcacctgagcccaggggttcaagaccagcctgtgcaacatggcgaaaccccatctccaaaaaataccaaaaaattagctgggcatggtggcatgcacctgtagttccagctgctcaggaggttaagcggggaggatcgcttgagcctgggaagcaaaggttgtagtgagttgagattgtgtgactgcaccccaacttgggcaacagagggagaccctgtctcaaaaacattttttttttaattttgccttcatttttgaaagacactgcagctgggagaagaattctaaattccccccccccccccaataattgatgtccctcagttgtcttctggtttgcataatttcagagaagtctgttattgttcctctgtatgttttctgtctgccttggaagattttatctttaccttggttatcagcaatttgattatgatgtatcctgaaatagtttttttaagatttattcatatcttcaagtccattgatctttctgctgctaatttgctgttaatcccatccagtgcctttttcatttaagatgtttttttcatcactagaagtttgattttggcttcatttttatatagatttttcatttttctattatgtgtgttttcctctagtttcttaaacatatggagtatttttatatagctattacaatattctttatcatctgagttatttgtgcttccccacccccaccctttactcctgactatgtgtcattatgcgtcatagtggctggatttttttgtattgagtagtcttgaatttttttctgatcaccaaattacttggaattagttggattcttttgctttgaagctttattaggatagaccagaggcaacattagccttagcactaatttagcctcattactgaggtcatagtcttctggggattcttctcagtactctgtctttctgttctccttgacaggaacattaactcttttagccgtcggttctttccacagtctctggtagctagactccaggaaacacctctgcagacctccagagcactctctgtggagctcccttctctcctgtcccctgccccacacattctagccaccttgtcatccctgaatgccatcccagatctctcaactctgcaagaccaggccccatgcgcccctcccctgcccataggcagtaagctggtgcactcagctcatccttctggtctttatttcgtgcatcttgttgcctaatgtctgaaagtgtttctttttcttttcctttatttcttattgtttaaataaaacaggagagtaaatcaagttcctgttaccccaacttacttgaaatcctccattcttaatttttcctagattttcttctagccgtgcatcttagaaagccatcatatgctcactgaagcattacatataataacaaaaccatttctttaaccaaaattttaaactgaacatgctcaaggctgaactcatggcattcctttccaaatctctgtgctccctcttccctcctttctgcccttcctccaggcaatcgccatagtagtaaaaggctcttccatcccaggtacacataccagacacacgggagaaatccttagcattgccctcttcctcacctacacatctcatcacctcgaaatgttcattttgtctcgaggatatgtcttcagtctttccacgtctctccatctccaccctccactgctccggtagtctattcgccaccacctcttcctgctccaggagcctcctaagcactctcctttatccattcttgttctttccaatgcattctttattcagtaagcagaaagatttttgaaattattttttaatcaaagcaataaatgctgaattaaagtaaaaaaggcttataccatgagactactttcctgcccaatttctccccagtgcctgcttgcattccctaccactttctactcgtttactgtttctggcttttattttcataattctaaatatgtgcttatactgttacttcttgatttatcaattttaggtatctgttgatgtttttccactcaactctttctttttttttttttttgagatggagtctcgctctgttccccaggctggagtgcagtggcgcaatcttggctcactgaaacctctgcctccccggttcaagcgattctcctgcctcagcctcctgagtagctgggattacaagcgcacaccaccacacccagctaattttgtatttttagtagagatgaggtttcaccatgttggtcaggctggtctggaacacctgacctcaagttatccacctgccccagcctcccaaggtgctgggaattgcaggcatgagccacctcacctggcctcaaccctttcttctttattataactattataatttttggccgaatcactgtcattgtttacattaagaaagcagacatttttacttcctgagccaaaatgtgtatttttacctttcctgtctcgtatgcctttttttttttttctcctccttttagagattaggtctcatcatatttcccaggctggtttgtttgtttgtttgtttcttttttttgaaagggtcttgctctttcacccaggctggagtgcagtggtgcaatctcggctcaatgcaacctccacctcccaggttcaggcgattctcatgcctcagcctcccgagtagctgggattacaggcacatgccaccatgcctggctaatttttgttgtttttgtttgttttttctgagacagagtctttatctgtcacccaggctggagtgcaatggcgcgaccttggctcactgcaacctccacctcccaggttcaagcaattctcctgtctcagcctcttgagtagctgggattataggtacatgccaccatgcccagctaattttttaatttttagtggaggcgtggtttcaccacgttggccaggctggtctccaactcctgacctcaggtgatccgcccaccttggcctcccaaagtgctgagattacaggcgtgagccactgcgcccagcttactttttgtatttttagtagagatgaggtttcactatgttggccaggctggtctcaaactcctgaccgcaggtgatccacccacctcggcctcccaaagtgctgggattacaggcgccaggctggtttctaactcctgggggctcaagcagttttcccatctttgctttccaaagtgtcatatatcttttttatcatttgctgcttttgcaacatatatttgttgctgattcgtttactttctgttattctccttaattttcaacatgatcaaatacatttttggattatagtcaatctccccacttttctttttttcttcctagacatcctcttgcactctggggtgaatattttcttggccaaggtgtacagtcacagccctaggatttcccttcagcatcatcttctctcttgtatttgatctttgagttttcctcagtgttgatttgctctcttattttggtggaatatattctccatcagggtagtaagaaaaaggtgaataggatgtaaatttttgagatactatatttctctttattctgccctttgatagaattgttggatcaaaaattatttttctctcagaatttggaagtcattgttaaattatcttttggcttccaatgttgctattaatagtcctggtagtgttttttttttcttttttcttttatttattttcttttcttaagagacagggtcttgctctgttgcccaggctggactgcagtgacacaatcacagctcactctaatctctaactcctggcctcaagtaatcttcctgcttcagcttctccagtagctgagactacaggtgtgcaccaccatgcctgcctaatttttaaattttttgtagagatggggtatcactatgttgcctagactggtcttgagctcctgacctcaagcagccctcccaccttcgtctcccaaagtgctgagattacaggcatgagtcaccatgcctggcctcctaatagtgttcttgatttttatttttaatcttctttgtagactgccttttctcactggaaacttttaggatcttttcttttccctgccattttgaaattttgtaacaatgtgccctgcctggttagggttttattttcattcattgtgatggagacttctgaccaggggatatttcttgtatttatgcagagttgtttcataatattatttccttggtaatttcctcctctttgttttctctgttctcgctgttactgttagtcagacattgttcttggatcgatccacttgcttgactttatattggattttttttttttttttggtggctatcacattttaattttcagtgttttggggtttttttttttttttttttttttgagacggagtcttgctcagccacccaggctggagtacagtggtgtgaccccagctcactgcagcctccacctcctgggttcaagtgattctcctgcctcagcctcccaagtagctgggattacaggcactcacaaccatgcctggctcatttttatatttttagtagagatggggtttcaccatgttgcccaggctggtctcgaattcctgactttgggtaatccacccgcctcggcctcccaaagtgctgggattacaggcatgagacactgtgtctggccagttttcagtgttttatatttctatctggatgtttgttatataggtattcttaaatatatttaagatttgtggactttatataagttatacttcaacagaatagtgaaaataatggaaaggacccttccccctctgttgttaatatctaaagtctcttaatctctctctctcttttttttttgtttttgttttgagacagagttttgctgttgtcgcccaagctgaagtgcaatggtgcaatctcggctcactgcaacctccgcctcctaggttcaagcaattctcctgcctcagcctcctgagtaactgggactacagatgcacgccatcatgcccagctaatttttgtatttttagtagagacagggtttcaccatgttggccaggctgatcttgaattcctgacctcaagtgatccacccacctcggcctcccaaagtgctgggattacaggcgtaagccaccgtgcccggcctctcattgttttttatattatcctgtttatctcttctagatgtcattgtctttttctcagcctcttcattaagcacgttgtgttttgttctctgtagtctgcattgtgtctgtttctcataagttatttttctttttgtttggtctctgtctttcctgttagaaggtttgttggtgttgcattgctgccataacaaattaccataaatttagcagcctgaaacaacacgaatttatctcacagtcactgtaggttaaaggtgtgtacacgtggctcacctgtgtcctctatagactcttaagtggctgaagttaaggtgtcagcagggctgcgttccttcctggaggctgtgagaatgaattttgcttggtagaatttggttctttgtgattgtaagactaagattccctctggcttgtctgctaggggtcattctcagctcctagaggctctccacattgcttgttgcccccttcctctatcttcaaagccagtaacagcaagtcaaggtcttctgtctgaatttatctgaccactccttctgtctcatctctcttcttcctgcctcttctgtgctggaggcctcatgtgattacgttgggctcacccagataacccaggataatctccctaaaatcatttgataagtgatcttaattcatttgcaaaaactcctcacagcagtacctagattggtgtttgtgtaaccatgggtagggatattaaacttcagtattctgcccaccccagaagcctttctcaagtgtctagtaatcattggctggctgttcctatgtttaatgctggggcttttttttttttttttttttgagacagagtctcgctctgtcgcctaggctggagtgcagtggcgcgatctcggctcactgcaagctccgcctcccgggttcaagccattctcctgcctcagcctccggagtagctgggactacaggcgcccgccacaacgcccagctaattttttttttttttttttttttttttgtatttttagtagagaccggggtttcaccacgttagtcaggatggtctccatctcctgatttcgtgatccgcccgcctcggcctcccaaagtgctaggattacaggcatgagccactgcgcctggcctggggcaatatcagtacctaataggaagctctatattgggtggagtttagctcatcatccctctgtaaggtatttagacatattgagcaagctttttcaaacatcactatctaaaagatcttttccctagggctattcaggttctgtttgtaaaggatcctaaagggtgtgtgtctgtggagtaggttacctgagtttaattcagtaatggaacaggaaagggatgctggggcggactaaattttttcaggtagtctatctgttttctgtgcctcagtttgatgattagaacagtgaatcagggtgttacccattggtacctccttctacaaacaccttggttttatatttctccagtttacaaagttactgttccatctgacttctgcttcccaaaacttttctgagatttcttatcccatattttcttccattttgggggcccttataggtttatgttttctttattttttacgtgattttgaaaggagtgaaaataaatgcacgtattcaatatacttttttaaccagaaacgctttatcttccctgagaacccttctttacctcagtttctcaattcccctcaccctcatgcttttttatatgtatagtatttatatagcctgtgtagattagactagattcatcttctgtttgataacatgctaattataatgaacattaaatttcgttgctatcactgggtgtagtggctcaggcctgctgcattcccagtattttgggaggctgaggcaggaggattgcctgagcctgggaagtcgaggctgctgtgacctgtgagcacactaacactacttcattccagcctgggtgacagtgagcccctatctttaaaacaaacaaacaaacaaaaaaaaacattgctatatattctgttatagaggttctggagcattgctttgtgtagtgcctcataaatgctagcttatccttattgaaatgtaaaattgagcataaattagtatagtattttggtatggctattttaaagttttcatgtctcacagtcctctgggtatgttttattttggtataaatcttgtttacttacttatgttcttctccagccccactcttacacatttagaaatcttatacagatttctaagtctgttaattacttcttgatacaaggcatacagtaaatcagtaagtcctaaattctcatgtcagtgaaatgatcagtatcttaatgtggagagttaggtttactttgttattgttgtaatgaaatgcaaaccactttttcacacttcatatgcagccaatggctacccagttccaatatggaactacctaccattagaaaaataagtcattcttgctacccttcattctctcccttccctaaactagtgattatcaagaagctggaggctaggtgcagtggctcacacctgtaatcccagcactttgggaggccgaggagggcagatcactaggtcaggagatcgtgactatcctggctaatacggtgaaaccctgtctctactaaaaatacaaaaacttagctgggtgtggtggcgggcgcccgcaatcccagctactccggaggctgaggcaggggaatcgcttgagcccaggaggcagaggttgcagtgagctgagattgtggcactgcactccagcctgggcgacagagcaagactccgtctcaaaaaaaataaataaataaaagctggaatcagaattgcctacagaacttatataaaacaagccgctagagccctgagctactgcaaaaatctggggatatggtcccagcatgtatttttaatattattattattgattttacaagcaattctcatgggcccatctagttaagaactgctttatctacttaagacagacaaaaaagctacttaacaatattcttttactaatgtaaatatgcatattaatatacatttaatactacctggtttgtgagccagacagaaaatgacctaggaacaaaaatacatttgaatcatgtagtacagtgactctcaaacctgggggatatggcggaaacatttgggagaacttttcgaaatgtaatgcttgccttactgtctcccactaaatagtgcctgtggtgactttgttagaagcatatcatatctcaggcatgagatttgttatgtaaggatttgttatttatccttcaatactttttagatttttcaccacatactagtacttgatttactttggagaaatgaatgggtggagagagagtaccaccaccaccctgcctccacttaatgttgaagcagtgtagacaactgcttattcagaggcttggaattttctaatgcctttattttatcccagtatggccccactggcatttaaagctgagggtacgttgtgaattaaaagtagaattcataaaccattagatctcttcacatgttaaatcttactcctttaaaaataactctaggaagtaatgatgcagttgtattagataaatcttaggttcaaagaatatacttgaaatcacttctgagtttctgaacctacctaattatagtaattattgctaatccatgaaaccccaaaaattacatttgaggataagtggattaactttatatcttaaatatacaagaatgaagaaaatatttgatttttaattgtgtaactttagctgaaaaatgctgtagtatgttttttaaaaaaaccagatatgcctagatgctttcaagaaagtggcagaatttaaggagcaggtatttacttaacatgatttctgctctttattagatatacttaccccaaatttattaataattaaagagcagttatatttacctactctgtggtcacatattcgttcaggatagttcttctgctaattccattttcaggtttcagaaaccgatcagaaaatagcctgtaaaatacagaacaaaatgaaaacctagttatgtcccacagtgtttctttctttgtggggttttttttttggttgttttttttttttttttttgagacggagtttcactctccttgcccaggctggagtgcaatggcatgatcttagctcactgcaacctccgcctcttgggttcaagcgattcccctgcctcagcctcccgagtagctggaattacaggcatgcgccaccatgcccagctaattttgtatttttagtagagacggggtttcaccatgttggccaggctggtttcaaactgctgaccacaggtgatccacccgtctcagcctcccaaagtgctgggattacaggcgtgagccgtcgtgcctggccgagtgtttctaagagtaacgttgaaataaccaacagaaaacctgaccaaaacccacatacttattaaaataatttatttggacttcttatttaaacatggacaatgtttatataaaaattctttttaaaaaagaaagtccagtgtggtttgcagtaattgctcccatgttaatttttacatgcaaattaactttgatttgaagaaatcttacagaaaaatgagaaaaggaagaaaatatatataaattattaaaaacacgagatgtacgttactactaatcaaagacataaaacaagaacatatatccatcttgttccatctttgccttaaaattattataacctttaatccagtaattctattccagtgaattctgaaataaaatatggaaaaagatggacatagatgtttgtagaattattaaatattatttataatgggctcagtattagaagaatgattaaattatgatttatttacatagaatattatgcagttgttaaaatgatttgctagtcatgtttcaccttttatgaaaacattttattttttgccctgtcttatggtactgaaagaacacattttaaatgattcagttatttatattttttgaggagggaggtaacttccaaatttctaccatggtgtgtgtgtgtgtgtgtgtgtgtgtgtgtgtgtgtgtgtgtgtgtgtgttttatttgttttgcagatggtcttgctctgtcacgcaggctggagagcagtggcccagtcacggctcactgcagcttccaggctcaggcagtcttcccacctcagcctcctgagtagctgggactctaggtgtgcaccactatgcctggctaatttaaaaaaaaattttgtttgtagagaaaaggtcttcctaggttgcccaggctggtcttgaactcctgagctcaagcagttctcccactttggcctcccaaagtcctgggattacaggcgtgaaccactgtgccaggtctctgttgttagccattttataattagaggaaaaacattaagacacaaatacttacaaagcatttgttatgtatcatttaatttatacaactacctcctgaggcactgttgtcattttagataaggaaactcagacaccgacaggctgagtagcttgtccagagtcacacagctaataaatagtggaactaggatttgaatctaggtagtttggctgtgtgcttccaccttaaattgtgcctcatcaactctgtagcagcatggtaggatcctagtttcaggtcccctacaaacaaaaagctttctgaatttataatattgggttgaatctagtggatgtcatgggctcctaaagctgtaaactgccacatgtaaaattttgatccagtaattagcaatctacagctttacaagttttgtagtgatatgaattgtgttgtctgttctcttcatactctgacatatagtatagtgctgccagacattgtgatacacagtcacgtgctgcataacaatattttggtcaacgatgaaccacatatccagtgatagttccttaagattataatggagttgaaaattttccgtctccttgtgatgatgtagcttttgtaacatcatagtgcgattactttattttttaaatacattttaaaaataagtgcagtggctcacgcctataatcccatcactttgggaggccaaggagtttggagaccagcctgggcatcatgacaagaccctatctctacaaaaaaataaaatgaaattgcctaaggacacatttctcagaacacatccccatccttaagtgacgcatgactgtagacctattgcttctcctttctgcggcttttcttttttattgttaatttttgggttcttcatcgtttcacagttttttaattaactttattgtagtataatagatacaccataaactgtatctatttaaagtgtgaaatttgagttgtgacagatatttatacctctgaaaccaccacaatcaagattcagaatatttctgtcacctgtcaaacttcagctaccagcaaattgatctgctttctgtcactatggatttgttggcattttctggaattttgtgaatggaatcacatatactcttttctaatttatcttccacttaatataataaatttgagagtcattcattttattgcatgtgtcagttgtttctttttactgattggtgagttgtgttccattgtctaagtagtataccgttggtttgcaaatatcacatttttgtttatccatctgggttattttcagttttggcttttatgaatcaagttattacaaatgtgcttttcatcttcttgggtaaataactaggggtagaatgtctggagttgtgtggtacatgtatgtttatacagaattgctgagctgttttcaaaaaattgtctcatttaatagtcctaccagctgcttatgagagttcaagttcctcttcacatcctcactgacactgagtagtaacgtctttttaatgctggcctctttgatgtatgggtactgctatctcattgtggttttaatttgtatttccctgatgactgataacgtcaagtatcttttcatgtgctgcttggtcatatttctttgatgaagtgattgtccagatcttagttcatttgtcttcttgagttgttagggctctttttatattcagaatacaagacttttgtcagatatgtgtgctgcaaatatgttgtcccactgtatgcttgccttttttgttttctcaacagtgtcttttaaagagtaggtaggttggggttttttttttttttttatttttaaataaagggcaattttttgtggttccttttttgtgtgtcctatctaagaaatctttgtcgtcttatgctttcttctagtttcattattttgactgttacatttagatcagtggtcatttagaattaatttttgctattgttataagggttaatggtctttaaaacatatatatatgaatcattgttcagcactttgttgaaaagatttttctttctccttggattgccttggtacctttgtcaaaaaattctgatcacccatatgtaggtctgttttgggggccctcttctgtttcattcatctgtacgtcttatcatttagccagtaagttcagtgtcttgattgatacagctttatgatgtcttaaaatcagttagtgtaagtcgtccaattttgttctttttaagaatgtctttgactattctaggattgttctcattttcatataaattttacaatctgtcaacttctacagaaaagcaaattggaattttgactggcatctcattaaatctttagcttaatttgaggagaattgacttcttaacaaaattgagtcttgaaatttgtgaacatcgtgtgcaatatatattgtgtgtgtgtgtgtttaattgggtcatttttaatttcttttgttattttcatttaaccattttccttgttatcagactcctcaaatgaaaatagatcagaaacttgtagccatttgatacagggcagaatatttgaatcaattaaaatttgagatttggggccgggcacggtggctcacgccggtaatcccagcacttgagaggccgaggcaggcggatcacctgaggtcaggagttcaagaccagcctgatcaacatggagaaaccctgtctctattaaaaatacaaaattagccaggcgtggtggcacatgcctgtaaccccagctgttcaggaggctgaggcaggagaatcacttgaacctgggaggtggaggttgtggcgagccgagattgctcaattgcactccagcctgggtaacaagagtgaaactccgtctcaaaaaaaaaaaaacaaaactgggatttggtaatgatttaaaagtatcattacatttacttcatttatcacgtgtaccttatgacatacagaatgagtgaaggacatataaactcaatttttcttccagttttagataaaaaataaatatataaataagggcttctaatattttctttccgtaccctagtagattgttatttccactttgaggtcattacatttattatatagttacgaattaagaatgctttgggtagtttaagtgtcataatcagtgttttgcatgacatcaatgtctgacacaactcagacatacagaaggaagttacacattcttatcttgaaacaatagatttactaagtgtaaaatgtttaaattttcctttgttctagtaaaacaatctattttattaacagatatcagacaccccgaagaactttctctcttaaagaaacccagagatccaacaaagaaaaaaaagaagaagctagatgaccagtctgaagatgaggcacttgaattagaggggcctcttatcactcctggatcaggtaagacttttaccaagcaatggactcaaagtaagaactgtggactgtgtacctttgtctttctggtggtgggtaaatggatcatgtaggtcaggaagagtggtcaagttaaaaaaacaaaaacttcaattagccaggcatggtggcacacacctgtagtcccagctacttgggaggctgaggcagaagaatcgcttgaacccgggaggcagagttgcagtgagccaagatcgtgccactgcactccagcctgggtgacagagtgagactccgtctcaaaaaaaacataaactctccttcagcatttttctctgtcctgaaatcactatccagtgtcagtttctctcatgtgcaaatcatcatgtcaggtgttaatagttgaatcaataaagaggaagcccagttctcttgttcagagagtcaaaaaggaatagtatcataattggactcaggcagaaattggaaatttttttagtatctagttcatgaaaaccaccactatttggttaatgcattattccttaaaaccttacttaaggccaggcgcggtggctcacgcctgtaatcccagcactttgggaagccaaggcaggtggatcacgaggtcagagagcgagaccatcctggctaacacagtgaaaccctgtctctactaaaaataccaaaaaaaattagctggacgtggtggcacgtgcctgtagtcccatctacttgggagagtgaggcaggagaatcacctgaacccaagaggtgggagttgcagtgagctgagatcgtgccaccacactccaacttgggcaagaagagcaaaactccatctcaaaaaaaaaaaaaaacaaaaaacagcaccaggcggggtactgtggctcacacctgtaatcccagcactttgggaggccaaggcaggcagatcacctgaggtcaggtatttgagaccagcctggccaacgtggtgaaaccccatcttgactaaaaatacaaaaattagctgggcgtggtgacaggcacctgtaatctcagctacttgggaggctgaggcaggagaattgcttgaacccaggaggcggaggttgcagtgagccaacctgggtgacaactccgtctcaaaaaaaaaaaaaaaaaaaaacaaaaaacagccttctctctgctttgcatattctggtttccgggccttcctaccttttttccttaaaggttttgctcctttgaggagctttcttagattccctttcattacttttccaatctgaattaggcatctttctgtcatgagtcagcagacttttctgtgtttggtattgttatactgtgtgttcttccttgctaatgtgagctcactgcatgaaggggctatgtcacctttttgtcaccagaacctaactcagcatatggcattcagcaggcatgcaggtgatgtctgttgggaagctaagtggctaattaattaggttatattgttctttaatcgtgggcatatacctggactgaacattgcagtttcctacatttccatcagccacaaatgtataaatccattacttaggatgggtcccctcagcaaatatctaaattaatcttactaatttagttcattctggttttttaaattctgagatgatgatgatactaataatgaaagcagcactcacagagcacttactgtgcagtgcccaccactatttcatgcactttacccatggaaacccatgtaattctcactacagctctttgcagtagatattgttaatacccacattttgaggataaggataagaaattatggcacagtaaaaagtcttctaaggtcacaagccttctaacttttctgttttatgtactgattgcattttgaaagatacaaagaagtaagacaatccttactcttaagtagtttataggttagtggaaaaacagttactatacttaaggaggtaatatataaatgttaaatgacttttatagaagatagtgtttttgaaattcagaaaacaattccaaacaaagtttgtgaattcagcttttaagttccagtggctaggtttttgatgggaaaaggcagtccaagcagaaagaatgatactaacaaagaacatccttgcaaaaatacaagatgtgaataaatgagttgagccagtttatgggggaagagacctccgagctccttcaggataacattggaacatatttaacaacagacgatggaatttagactagggcattgtagaaccattggtttctgaatattttacaaaattatcaaatcattattgtagaaagagtatcaaatttacttccagtcagtaatttgtacaggagggaatatggggaagggttgccgatactggtggaagcctgtaggttgaggaagaggtaaaagagaataaaaggggccaggcgcgggtggcttacgcctataatcccagcacttttgggaggctgaggtgggtggatcacctgaggtcaggagttcgagaccagcctgaccaacatggtgaaaccccatttctactaaaaatacaaaattagccaggcgtggtggtgggtacctgtaatcccagctactctggaggctgaggcaggagaatcgcttgaacctgggaggcggaggttgcagtgagccgagattgtgccactgcattccagtctgggcgacagagcaagactctgtctcaaaaaaaaaaaaagaggataaaagattatgtctatgtaatattgtgacatagtaagaaatatatatagtcatgtgctgcatagtgatgttttggtcaataacagatcacatatatgactgtagtcccataagattaaaatactgtcttcttttttttcttttcttttttttttttttcagacggagtgtcactctgtcgcccaggccggagtgcagtggctgcgatctcggctcactgcaacctccgcctcctgggttcaagcgattctcctgcctcagcctcctgagtagctgggattacaggcgtgcatcaccacacccggctaattttttgtatttttagtagagatggggtttcaccatgttggtcaggctggtctcgaactcctcacctcctgacctcatgatcgatccacctgcctcggcctcccaaagtgctgggattacaggcgtgagccaccgcacccagccttctttattttatgtatttttttttttttttgagacacagtctcactgtgtcacccaggctggagtgcagtggagcaatcttggctctctgcagccaagatacaggcaattctcctgcctcggcctcctgagtagctgagactataggcgcacaccaccatacttggctaatttttgtatttttagtagaaatggggtttcaccatgttggccagactggtcttgaactcctggtctcaagtgatccacccaccttggcctcccaaagtgttgcgattacaagcatgagccaacacctggccctgtattttcactctaccttttctatgtttagagatgtttagatacacagatacagatacttaccattgtgttacagttgcctgcagcattcagtacagtaacatgctgtacaggtttgtagcctgggagcaatagactataccatccgtatagcctaggtgtgtagaaggctataccatccaggcctgtatgagtacactctatgatgttcatacaacagtgaaatcccttaacgacacatttctcagaacttatccctattgttagtaggtgcatgactgtactaacttgcacctttgtcattgcatcattgggctgttcctgtgctgcccagtttttggctagcttgtgcccaagcagagcatccttaccaattcttacactccccaatcttggcttcccttgttctttttcacccagttcccttttcacccagactgcagctgcttttatttctggtctgtgtactattcctcagttctttcctttcagaggctagacctttggacagctttgaatgtcctaagggacatttgtggcctctttatttgtaagagatccttttcagaaagaaaaccaatgtttttattaaaacgttgctattactgacaaccacatttattgagcaacttcttgtccaaaacactacatgtaatatatttaatccacacagtaaaatatattaattaattgagcaattctgaaaaattggtagcatgagaagagaaacccagagtggctaaatcacttgcctgggagctaatccctggtaactggtagagctgagctgtaagcccaggctcatcccgcttccaagctagagctttcaccattgcactgtgcacacacccgtctccttctcccttctgtccctcatgagtacacacagacccataattttagcaaatacgtcagtggccagagatgccacaacctagcttttacttaatttttgtagccttgtttaccttaaagaaaaaaaaaattaattaaaatttaaattctccaacaaatccttatactgtactctacatgagtagtggcaatcagagtcatcccatatcaatattagaagcgataacgctgaatgtttctataagtcttagagagttagaatttgggaagctgaggaggttttgttgcctggaaaccataggtgaagaccggtatgcatagaaattcttgagagtatgctagtccaggaagcaggaaatcttaaaatttttacatcatacggaaatggctagaagcaaaccctgtgagtatgaaaaataaaattatcagcttagatcttacaaaacaaaaagacaagaagctactggtagaattggaagcattggataattttgtaatagttccagaacttactaaattttgcttctcttcccttcagcttggtgataatgacaaattgtaggaaagctggttagtatataacttaagctaatgaataatcgtgattgagttagcatcagtcttttcactgaattcttaagctgggctgccttgattaagacatagtaatttagattgagcaacccactaatacttttccttttataagtcacatctaatacgaatactaatccgtattttaaaaatactttcgtttggtaggaaagtgggttgcaaaccaaaatcacaaataagccttatggtttgtttttttcctcttggttgtctctgatttttaatggttggagagtagtgtatattgttgatataaacaaaataaatatatgaatttatattctaggagaaaatttagccacatagaaataaacgtatataatgtcaggtttttcctcctccatggtcaacaattacatacatagtaaataagttataagtattattgaatacataatctttcacttaatcgccacaaaataccagcagttttggtgatgtcttcattttacttctgaggaaataactccacaagggttaagtggagttattttcccaaggttaagtaattttatttaaccttttagttaaataaagtttaactttttttaactaaagttaagtaattttagttaactttagttaagtaattttcgttacttagttaagtaattttcccaaggtcacaaaggtaataaggagcagagctagaattcacatccaggctccggtgctcatgcttctaaccattaagtaaccaattcttttttttttaagagacagggtctctctgtgttgcccaggctggtcatcaactcttggcctcaagtaatcctttcacctcagcctcccaaagtgctagattatgggcatgagctaccatgcctggccataatgtttattttatgaattataataggaatgtttgctaaattttttctttcttttttttttaagggacagggtcttgctatgttacccagtctggtctcagacttctgggctcaagtgatcctcctccctccgcctcccaagtagttgggacttcaggcagatgccagcatggccagctaatttttgtattttttgtagagatgaggttttgccatgtttcccaggctggtctcaagcaatcctcctgccttggtctctcagaagtgctgggatagctactagggaggctgaggcaggagaatcacttgaacccgggaggtggggaggttgcagtgagccaagatcgcaccattgcactccagcctgggcgacagagcgagactccatctcaaaaaaaaaaaaaaagtgctgggatcactgcacctagcctcaaaacattttttaaaactattcttttaagtacaaaagtatcacatgcttatagtaaatattcaaatattacaggattacatattcattttttttctaacaaaagtgggactgtgttatacacacattgtgttttctcacttgatgatacatactgatggacctcatatattttttaattacaaaatttatacatgaatacagtctctttatcataaactcaagtaatataaaaaatgtattaaaattaaggtgagttccttttaaacttattccctggctactccttctcaagagggagccatttcttgattactacatataacgaggttgtaagtttggagtccaacttgacagtaccgtttctgtgtgtttatatgcacaagtgggtataaaatttgcacatctagtcttattttaataacataaatgagatcctaatatatattttatgctctgcaatttgatttttggtgatcagtgttttagtgatttgtgtcaaagcagagaagtctccctagttcttataaatgacttcagagttttacctatagaaaaagtatatttacctgtttttctacctaggtggtatctaatttttctgtcacatatatcccagagctgggcgttgtggtgtacacctgtagtcctagctacttgggaggctgagacaggaggatctcctgagcccaggagttcaacctgggtggtcacactgctgcattccagcctgggcaacagagcaagaccctgtctctaaaaaaatacatgtatgtgtagatacatatatatctatacattatatcacacacactctgtctgtctctctctctctctctcccccccaagagtttctgtggtttatacttccatcagtagtacatgaaaatgccccatttcctacattctgctcaatattgaatgttgtaaatctgtgtttttgccagtttgacaataagtagtatctcggttattttgcatttccctaatactaggatagttgaataatttatatgtttattagccatttatattctattaattttcaaatgatagattctttattttatttatatttttgcttttagtgatattaaaattttaatgtgttacttccctttatatactggcattttgtttgtggccttttttttttaaaaccatattgttttacatttttatgtggtcttatatctgttagccatttactttatagttctaggtttactcttgcttgggaaaattttctccaaaaatataaaaataataccataaaaattcttttgataaaatatggtataagataggtattttggtgaaaattttttaaaatgtattactttagtactctttttaaaaaatatacaatttataataagttaggtaaattttactgtgttaaaatatagcaatatttaggagttgtttgattatatcgggttttaaatatctacagtaggtggactcagactgtagtgctttttgaactctatttctcccccttagagtttttaagttatctttccatgtcatttagtaagctcatattttgttgctaaatctgctactttatcttacactttactagtttgctgcctcagatgcattttaaaccagacattcaagaaaacaacttagttgggattgtctctgaaccacgatgaaggaatttaaaatacccataccctctgacccagcagtgctgctagaattgggaaataactacaaaaatgtttgttgaagcattggtttgcaataatgacattagtaacagatttttttttttttttttttttttttttgagactaagtctcgccctgttacccaggctggagtgtagtggtgtgatcttggctcactgcaacctctgccttctgggttcaagcgattctcctgcctcagcctcctgagtagctggaactacaggagcatgccaccatgcctggctaatttttgtatttttagtagagacggggtttcaccatgttggctaggctggtctcaaactcctaacctcaggtgatccacccgccttggcctctcaaagtgcgggcattacaggcatgagccaccgcacctggccagaattttatttttttatttttatttttcgaaacacagtctcattctgtcacccaggctggactgcagtggcacaatctctgctcactgcaacctccacctcctcggttcaagcgattctcctgtctcagcctcccaagtagctgggactataggcgtgcaccaccacacccagcttattttttatatttttagtggagacagagtttcaccatgttggccaggctggtcttgaactcctgacctcaggtgatctgcctgcctcggcctcccaaagtgctgggattacaggcatgagccaccttacagtaacagaattttaaaaaataggtgcacaccaattgggaatggcttacgtaagttatagtacatggaggcagtgtgtagccctacagccagactggctggggtttttttgtttgttgtttttgagacggagtttcgctcttgtcacccaggctggagtgcaatggtgcagtctctcactgcaaactccgcctcccgggttcaagtgattctcctgcctcagcctcccaagtagctgggattacaggcaggctgccaccatgcctggctaattttttgtatttttagtagaggcggggtttcaccatgttggccaggctggtctcgaactcctgacctcaggcagtctgcccaccttggcttcccaaagtgctgggattacaggcttgagccaccgcgcctgcccagactggccgatttatagcttggctgcagcttacttgctcttgaccttggacaagttatttaaccttgctttgcctcagtttgctcctctgaagtgagaataatagagttgttgtgaacgctaagtgagtttattatcacatagtgcctacagaacaaataagaacaacgaagtgattaagtatgaattgaagaagatacaaactataggaagttgaaacgcagatttgggtgggtggctgattctattaaatgtgtgattgtatttgttcattcttgaattgctataaggaaatacctgagacttggtaacttaggagaaaagaggtttaattggctcacagttctgcaggctgtccaggaagcatggtggcatcagctcctggggaggcctcaggaaacttacaattacagcggaaggcggaggaggagccagcacttcacgtggctggaacaggaggtaggggtgggagtggggaggtgccacacactttaaacaaccagatctcatgagaagtcactgactatacagtaccaagcggggatggtgcaaaaccattatgagaactccacccctgtgattcagtcacctcccaccaggcccctcctccaacattggggattacaattagacatgcgatttgggcagggacactgatccaaaccatatcagtgatttagggggagtatcttttctatattagaaactttataaagcaaattgtccattctaacttgactcagttttggatagaaattataatctcaccaggtgcacattttcagtatactgacattcttcgtaacagatttatttaatagatctttgaaagaaacaagactttgcctagaagttaatgttttttcacactttatctacatgcacactctgtagcagaaataccctttgcccaactgagttggagtaatgtgttcagcacatttaataagtgtggggtgcccaattagtcctttcaaaaggtgtcacacaattttaagtttgaaaaatacctgtctagtttaaggatctagcttttaaagccccaggactaacgatcccagtattctttaaatgctgataaagagttcacaactttgctttgtgttttaggattaacagtgttcggattttagagggttttttgtttgtttgtttgtttgtttgtttgagatagagtcttgctttgttgcctagactggagtgcattgatgcaatcttggctcactgcagccttcgcctcccgaatagcgtgcaccaccactcctggcaaatttttgtgtttttagtagagacagggtttctccatgttggccaggctgatctcgaattcctgacctcaagtgattcaaccgcctcagcctcccaaagtgctgagattacaggagtgagccaccacacctggcctagattttacaggttttttttagtactaacattggaagaacacatgtcagggacataaaatcaaatatcctgtgtccagcaagagattacatattttcagtaaaaactttttttttttaactttgcttcctagactaggtcatgacagctacaaaaatctctagcattagcaccactttttcacaggcagtgtttctatcattgcatggggagaagagttaaaaatagtaggaaaggagatggatttctaagcttaaccctaaatttagggaatggaaaagccattttctttacattaacagtgttatgcccattgcacattttcttttgaaaaattatgacaacaggacaaaatataatttaacagagctaggacttgggggagctgcttgtccttaatgtcattctgaacatttttagatgccttaaattcatctccttaatttttgtagtttaaataaaggagcacataccatctgttgactaatgtaacaaattgttatttacgtaacctctactatatgtctagccctaatactaagaaatcagaagataaataaggcaatatcccttccttttgagatttgactattaaatatatctctgtttagactctttctagggcagacttttatctccccttttacattaatactttatttgttgtaccccagaacttaaaaattaaaaaaaactttatttgtaaaattgttgaaacctgtttattcactgagaagactttactataaaattattcttaatctatatgaattcagttctattgtgttaccttcaaattgtatggatttcaaatggtggtaaaagttgtagacatatttgtcactatatacttgactacagcacaacttcattcttttaaattgaacaaaaaaaaccgttttacttaggttgtagcttctaaggttctttactctgaaatccacttgaaatgtgtacttcagtttatgattcacaattagggaaaatctgttttttctttttctcattttcttttcattcttttgtttctgtcctctgttgtggcctttcctttaccttctgaattcctttctttcctttcctataggcactgatgttctttacattggccctctgaaaggtgagccttgccacaatttaaagacaaaaagtgttggtctgtctgcttcagctatatccttattttctaattctcttgaactgattttttttccccagaatttctgccaacttaattatattcttaaggctttattacgtgttttaatgttatacaaggagaattaattacacatgttttcataacaggtaaaataatatactaagctttcctttcagaataaaacttttgtttcacaatgtgctttatatcataatatgtgttattattgaaaaataagatgctgtactgcatacttactacctgtttttcatgttacttattaggaagtatatattcaagcccaggactgtatagtaaaacaatgacccccacttatgatgctcatgatggaagccccttgtcaccaacttctgcttggtttggtgacagtgctttgtcagaaggcaatcctggtatacttgctgtcagtcaaccaatcacgtcaccagaaatcttggcaaaaatgttcaagcctcaagctcttcttgataaagcaaaaatcaaccaagggtaagttttaagatatagataaaattgaatttcttcatccagctagaggtagaaatattgtcttcattctgtgttgttttgttccactgttcttaatttgtccagatggcttgattcctcaagatctctcatggaacaagatgtgaaggaaaatgaggccttgctgctccgattcaagtattacagcttttttgatttgaatccaaaggtaccgagggtttaaagggatcttttttttttccccattaatttgttttgttcacatggatgtttgtttttggaagtcggtggaataaggaattatttgtatataggaaatcttgaataattattaaaaacccaaacttttaggcaaaggtatttgtattttaaataagtctattttagtaggttggaagcataactaaacctttttattgttgttattaagataatgaaacttttggctgatttggttttatcttttttttaatctctaagctcttagagtgtcatgatttgtattttaaaggtactcttttggtactatagaactggcaaagtttaggccgggtgcagtggctcaacgcctgtaatctcagcactttgagaacccaaggtgggcggatcacatggtcaggaattcaagaccagcctggccaacatggtgaaaccccgtctctactaaaaatacaaaaactagccacgcatggtggcacacgctggtaatgccagctacttggaaggctgaggcaggagaatcacttgaacctggaagacggagcttgcagtgagccgagatcatgccactgcattccggcctgggcaacagggcaagactccatctcaaacaaacaaaaaaaagaattggcaaagttcatttttaaaatataagacctctcttcaactatatttaaataaaagtttcaaaaaggttaccttttcaattacttttagattactaattacgtgccaaaagatgttgcttcaaaaaaacgtttttttcttgagacagggtctcactctgtcctccaggctggaatgcagtggtatgatcatggctcactgtaacctcaaagtcctggactcaagccattctcccacgtcgcctcccaagtagctgggactacaggctcacccagccacacctggctttcttattttctgtagagacagagtctcactatttcacccaagctggtctcaaaactcctgggctgaagccatcctcctgcctcagcctcccaaagtgctgggattaccggcctgagccaccatgctcagccaaatttttcttaggtctacatttttttcctctgtaacagacaaacactgttacttgtctttactatgattggtattatctctgctaccatagtacttcacttttctggtaagatttaactttaccataaatatctggagcttttttcccccgtagaaaacacttggcacagaggtttgaatcttttacttctctttcagcctggggaaagaaacctctcttggctaccctctcatccttttcatgtttagagtatagtctagattttaatgttatgtttacattcttttattatatgcttaagtaattctttatacaacagtaaaatctctataataaaattatagaaaataattttaattcattttcaggccacatcatacctacttttagtaaagccaaagctactttgggaatagttacatttgtgaggggaatggagatgtattttgtcaacgttctaaaatacatgttgagcattcctaatttgaaaatgtagaatgctccaaaagctaagacttttgagggctgacatgatgctgaaaggatatgctcattttggatttttatgttagggacactcaactggtataatggaatattccatcatctataaaaattctaaattcaacacagaaggtctcaagcattctggataagggatactcaatctgcagtattcttaaggcattactattgacttttatttatataattaaatggataattgaataacatataagtaaacattttccacaagtatatttgccctgtattttgcatacttaaaataactgccgtttccaaggacttgccactttatctgggtatgcttctccacagtgaacaaaatgttccccagaataatttgctttctgattacatgtttgtatggcaagttgcagtaataacactgaaaaataatcggtagttccgccttactttaatgtcatcaaattagatttcttatgttaaaggctataatgtctagtggttatttccctgaaaaataacatacagaatctactttttaatactgtacaatcaattattctctgtcatattttaatgtcatttttaatggaaaattagatgtgggcatatataggcatgtctgaccccataggtatccttctaataatacttgattgtaaataaaaattcttgcttgtaaattaagatcccaggaaaaaaagcattaaatttttcttgtcaattgaatattcagagtttgaaatttttcaatggtaaaggttatatattacaaaagaactatttctcttgttgcagtatgatgcaatcagaatcaatcagctttacgagcaggccaaatgggccattctcctggaagagattgaatgcacagaagaagaaatgatgatgtttgcagccctgcaggtagttgaaaggtctagtaaatgggacttattccggtaaagggtagggaggtatttttaaacagtaaagtggaatagtaattccagtaacatttcacgagacagaatttttgccatgaagaaagtgagtagacacttaggaaagcaaaacaaatacattttagtttgattttttatcttttccaagagttcagtggtatacttaagtacttttctctattttgtaggaaaaaaattatcctattttgtaggaaaaaaattatcctctcacccccaaatataaatctgctcaaagctcctcagtttttccttggaaagaaaatatttattaaaaatcagatttctgaaatctaatctgaagcttacctgtataatttcataaatagccagggatgatacaacacactataaaatgggctgtagcaaagcgatgcttttaggtgataagatttagagagactagtggaaccaaacctttttctacaatgataatccttaagtagatagctaacattgtccttagattaaaccagttttttcatatgtggttcttacataccacctccttcagaattataggggagcttatttaaaaattaattatccacttcatgaataactttaaggtggcatccacacatccacattcttacagatactgaggtctgatgaccaaattaattcatctttcttaaatttcagatacccgagtaatgctttggcaagtattcccagttatgacgggattctaggttcagcctaaagtcctgatgaagttggtgttctataaataacagaagtacaggaagcagagttgacattcagttgaagaacttttcactgtagaagggattttgtttttccttagaacacaaacaaaaatgctctcagtcttccaaatgcctcctttatgcatccagaaaagttttcagttgtgacccaaaaagttgacattagaaagcaagaatggggagtgaggttagcaaaaaaaaaaaaaaaaaaaaaaaagcaagaacagctaattttcaccttagttttacataatgaaaggagtggcaaagaagcatagacaaggaaaataaatcccaggtgacagatggattaatcagttattttctaggaacttgattaatgagccagttaggatcccgtattgtgtttccagataattctgactctctggtgaatttcttgaattaaattctggagcagtttgttgggagtcccctcacgtggttatggctttcttcctgcatcctcctcactttgatacaggcttatgattttctagtggaggttttgccaatgatagaataataatacctgtaaaatatgtgtgaaagaccacagattttatactgttgctttatttttgtattaaaaaatagtacatgtttatggttattgtttttaaaaccaacagatgcctattatatgcctggcacatagtaggtgctcaaaacgtgtttgtaaaatgagagtacacacagttgtgttctcacaggaatggcatgattctgcagcccacctccccgagtgtatcttgggcattccatatcactacagaaggaacacctcagagaccacaggttttaattcatggaaatggaatggtctcaaaccatagccctccaagaccattttagaatctagatataatgagagtattttgacatacagatttgagttgttggaggctttctcagagactgaccctaaggttgtaggaagccaactagtaccagaataaggaaactgtgaaagtatggtgaggaggagatgcctagaattttttctttcagagagaacctatactccgaagtatactctccttgggacatctggatccttgtgtaaagtaaatttacaatagtaaaaagaagcagaataatacaaaacaagaaggtggggataaaaagtaaagtagatgaattagtaacattgtttttaaagcatttaagtcagagtatgtattaagaaatttaagatatcccttgcacttttgaaagcaaagctggattttttaagtcccattcacagccaggatttctccggtatgactcataaagacattttgcatcagaattacccagagcagtgagtaaaaatgcagattccaggctggaccccagacttcctgaatcaggatctctggagtaaacctaaggatctgtatttttgaccaattcttcaccagactcttaatatactctgacatttgggacctgagggcctcaacctctacctcatttcccataatttatgaacattgacatttctacaattgtaagatctcatttcagcacaattgaagtagtcagagactattcattaccaatcaatcactaaatcttaaaacacagaacattggtaagtggcctcagattagttcactaaatgttcccatgaaatgaatgtattaaatgaatactttagacatttggagtgccacttgttgctttgaaaggtaattgattaagatttaaaggttctgctgacctttgtagaaaacctaaggcttaacataatatttgttctaagtcacttactgaagtatatttaaaatcagtaactattctgtatccaaaaattttcctgtctacatatgagtagtcatcactactcactactctctctctgcccccaccccacccacgtatatgtgggtgtccatgtgcgtactcacgtacaaacattcttagatatgagaatacagaacatgaagcaaggatggggaaaaagtggagttttagctttcgacataataatgatgactttctcctgggtaataggagcagtgtacagcattcagtgttcatcagtttctacaaaagaccttatgcatattctgtatgttcattcaatatttcttgataacaggccctgttatagacacagggcagattacaatgaaaaaaaaaaaagtcaaaaatctctgttaatgtgaagtacagttgaggaccagttaactctcttaagtcttagagcccgcaaatgatgaattcattggtatgtgtccaaagaccctacttcttttggataagtatttattagcaggtttaggatattgatttcaggtatttatttcctatcgttctagttcctagacgcttctgtcttttcaaattaggtcctgaaaagcattaaatatagattcagatagtaatttcattttagagttttacagttatagcaattattttaataaaataattctggtttcagtatcatatcaataagctgtcaatcatgacatcagagaatcatttgaacaacagtgacaaagaagttgatgaagttgatgctgccctttcagacctggagattactctggaagggggtaaaacgtcaacaattttggtagggtgaatctttttttttacctactaatttagcttgaattgatgcattccattttgtggatttaggttcaaagtatttgggggtggtggagagaaatatttaatgctttagagagagaaatcagatgttaatttttcaggaactttgagcaaagtggtttattttgagacagggtctcgttctgttgcccaggctggagtgcagtggcacacgtcataggtcactgcattctcaaactccagggctcaagccatttcctacctcagcctcctgagtagctgagactacaaccatgcaccaccacacctggctaattttttatttttttaagagatggggtctcactgtgttgtctagtctgatctcaaactcctggccttaagcagtgctcccgccaccactgggaagtttgtttttaaagtaataatgtattagtctctagtgcattcaatacagtaagaatagatctaatactctaatactctgcaaattcttttacaagtggtgggaagacatttctgcagaggaaaataatctcaagtcatggtaaaaatccacttagtgatgtgcacatttgaaatactacaaaaagaagaaaatagatctcgggaaaattgtgaaacactgggtttggtttttaagtatagggattagttactgctgaagaaacacttcaggccttttacaatgtacagatttatatgcacctacaaacagtttcagcactattaaagatagcatattctcatgggttgtataaattgccattttgatgaaaattttgttaaccttttatgctatttgaaaatgcctttgtaccaagaagaatatggtccacaagactatgtaatgtgattttgttgtttaaatctttatcattgtattttatgtcattctgtttattaagtaagctagttcttgatatcagataccaaacattagaaagaatttcaaatattaaaaaaattaaaaaaggatttaactctctcctagggtgacattacttccattcctgaacttgctgactacattaaagttttcaagtaagtacaaaaaggagggatgccaaatattaataactgtcagctttatagtcatggtcacattattgaaactaactgttaagtttgactaacaaacgcatctactgtaaaaggatttaccagttaggtgaacaccaaattaccacgagagaaaataaccacttttacaaaattaaaatcacaatgctcattcttttatcagatttttctttaaaaaaaaaaaaaaaagattgtgaaacctagattgcatcatacagatgctgaaacatagtaatacagtggcacagcccctccgggcctcagttggaagcagtacataatgaactgtgtcactgccagcgattatttcctcgttcagagcgcaagattctattgaactctgttcatttgttcatggaacattttatgtaaagttctagtatatctgatcaagatttttaacactctatccagctatattccacagaatcaagagagctcggcattaaggcagagaggagaaaaaggaaaaggaggtgatgtggaaagtactattttctactatataagatacaaaactactctagaataaaccatttaccatagctgaacatacagcagttcaaaatatggaacttctgagataagggcatgatttcagatccactaccctaccctttctccttcccccttgacccacctttctcatctacctgcacctttccttacacatcctcatgactgctctgtcatcttccttctgtgtttgatattggagtggcaagttaatgtcaccattggaatttaccccggagaaagaagcacatcccccactttcagtcctgccaggtaaatttgcatctttatagaggctccaaggcaatcctgcagacacccataaacctgcaggtaattacaggatctaggaattttccaattactgacatttacttcacctttcttttcctacccttcccatgtgacctgctagttagtgatagatgtgatggctacagctgcagaatactggaacacaggccctactgcctttctcctcggaacgctgtttgtgggatcttctagagtagattgagaagggaggctcgcatccagtaacagtagcactgactaataagacgctgaccaagggggatcaatttcagcacgtgtaaaacttgaccccagacttaaattaatattgtgaaactttgctaatacagcgttaataaagttacttccaagtgattttgttgttaattctctttgatacataggccaaaaaagctgactctgaaaggttacaaacaatattggtgcaccttcaaagacacatccatttcttgttataagagcaaagaagaatccagtggcacaccagctcatcagatgaacctcaggggtaaggagagcctggcacggctgttgttgatggtggcatccccattggcctaatagtcaatgagccacttgctgggataaacaagttttttaaaaaaatcaatttctttactcctttgggtacttgaaaaatgtttagatatgtctcttttacatagtccttttcacaggtttgaagtattcaattccacataaatattttgttgtaatctctttgtgcagacttgacctgaaatgtatgattcaacttttcttttttgttttttgagagggagtcttgctctgtcacccaggctggagtgcagtggtgcaatcttggctcactgttacttctgcctcccgggttcaagcgattttcttgcctcagtctccccactagctgggattacaggtgtgcaccaccacacccagctgcaaggtttcgtcatgttggccagactggtctcgaactccgggcctcaattgatctgcccaccttagcctcccaaagtgctgagattacaggcgtgagccaccacaccaagctgattctgcatttctaacttgtcaagtaagcttacgttgtcttttgatcttcagcattaaggacatttagagtttccttattctgcaggggctgcctccttgtctgttttggattctgccttattttaagccacgctgtagtcatccctgggctttcttcttcgacatcctgctcttcctcaccctcactgatgacaggctggtcccactcagggtcctcagcctctgaattttcctggctcgccagtagagtagctgacactttcagggtttgggcaagtccttccccttccccttccccaacacctcttcctcacacagttttgtctttgctctcatcctggcttttgaggccgcttcaggatattcctcggaggcttctagctgacaccttgagtctcactggttttctcttgtcctgtcttttcaaatccaaagctatctcagaactagggtctggtatttgggttgctcatttcctttccctcagggcgtttgtggcaggcctgcttcctacagcctgggctaagcctggatgaagcctcagctattggctttgttttggattttgtttttccttttcttcagtaaggtctatgacctacagcttaattttctatttcagtgatttcttctattggttcttcatactgctctttcacctttttcatctgatgatgccctggctcagctggtaggcgaatttcctctccagattagtctggttcttctgcaggtagatggcattctgctgctcactgtgatttctttgcagagcgttaatgagcctctcacttggggtaatacttttcaataaaatcacctggttcactttcagtgtagataccacttctccagaaagctgtatcccctgaggaccactctcccgtgagcacacacccttggcacatggcatgccttttggatgatgcagtcaatcagctggctctgcactgtctgttccacagtcctctcactgtatcttcccttagaagagcaaagactaaaaaactaaaatacactttctagactcatttccaatgagacttagattccagtcaggtgcattcatgggagacttaaattcggaatagagctaaggggttagagacacagaaaatgaaaggagggaggtattactaggcgctggagctaacacctgcagccatagtctcctggtttcccacctgcttgattatagcaaaggttgcgccacccttggcaagccagttctgagttactcctagtggcccagcccatctcttctttgggtacatttgtacgtacacatatttttgtagataaggcctttctaactcgaagtattccgatgtggacaacagcaccagggaaaagggctccagactgatttcacaaaaatgactcccaaaacaatttcatttaacacttaaaacacagaggtgcttttcctgattcatattcctaaattgtacttagtacagtcatgtatcatttaacagtagggatacattatgagaaatgtgtcaccaggtgattttgtcattgtgtgaacattatggagtgtgtgtacttacacaaaccatgatggtatagctgactgcacacctaggctatatggtatagccgattgctcctaggttacaaacctgtacagcattttactgtactgaatactgtagacaactgtaacacaatagtaagtatttgttatctaaacatatctaaatctagaaaaggtacaacttggctgggcgcggtggctcatgcctataatcccagcactttgggaggctgaggcggcggatcatctgaggtcggaagttggagaccagcctgaccaacatggagaaaccccgtctctactaaaaatacaaaattagctgggcatggtggcatatgcctgtaatcccagctactcaggaggctgaggcaggagaattgcttgaacctgggaggtggagcttgcggtgagctgagatcacgccattgcactccagcttgggcaacaagaacgaaactccgtctccaaaaaaaaaaaaaaaaagtacacttgtatagagcagtttccatgaatggggcttgcaggactgggagttgctctgggtgtgaatgggtggtgagtgaatatgaaggcctaggacattactatatgctactatagactttattcaataattttctttcttcaaacctttgcttactgtaactttataactacttttaacatcttgacccttttctaatgacacgtagcttaaacattgtacagctatacaaaaatattttctttatatccttattctatatgtttttttgtatttagatttttattttttatttttaaccttttgttagcttaaatcacaggcacacacattagcctaggcctccacgagattgggatcatcaatatcactgtccttcacctctgcatcctgtctcactggaaggtcttcagggggagtaacaagcatggagctgtcatttcctctggtaacaatgccttcttctggaatacccctgaagacctgtctgaggctgttttacagttaacttttttatttaagtagaagtactttgtaaaataatgatgaaaagaatagtatagtaaatacataaaccagtaacatagtcatttatcattatcaggtattatgtactacttataattgtacatgctacatctttctattactggcagcagaataggtttgtttacacagatgtgagctatgatacagctacagtgtcactaggcagtatttttcagttccattatagtcttatgagggcattgtcgctgtcgtatatgcagttcgttgtttaccgaaatgctgttatgcaatgcgtgactgtatattgtacattaggatagatttaccgtatttcaacacagtgttgaaatctgtaccctagtacatgagctctgcctagtagtcacttaaactattgcttttaaagttacacaaatttttaaaaaatagaaaaactcagtcctgggtaaacaattgctattcccacattttggaattctgtaatttacctgaaactcttaattagggtcactaccttcctctctcagtcacgggcgtttcacttttgggtctctgtcattctttgttgctctcaggatctgttgcaaccttctcctgcttccctcttcagctgcccaggaccagcgtaaatgatccactgttgactttgagactaaatctgtcttctggcccctgttctcactgtccctgttatatcttaaccttcttcctgtataactaagaggtcaggtcctggcatggaattaataagtttataagctgttctcagttttcatcccactgctcccaagtcctctcaaaggactcatcacactgatcattgcactcatcacaggcaccgcactgataacaccttgaccaagaatcaaatggtctggatgctgctcttctactaaacaagccctatgatttttgttgtttcgttttttgagactatgttgtacacgcttatctccaactcttggggtcaagcgatccttccacctctgcctcccgagtagctgacactgcaggtgcacaccactacacctggtttagatctgtgattttggaaagatagcacatctgggcctatagtatcttcttctgagaaatgagagtgttagactggatgccaaggcttcatagagatctaaaatgcaaagttattaaaaattcatttcagctaatactaagtgaactcctgtgccacaaactgtgctgggtactagagatacaaggaagaaccacttacagtctcaatcctcaggatggtttagagcatgttggcgagataaaattacaattggggtaataaatagtactttggaaaggaaaggaaaagagcaaggggtaagggtgttctataacttaatcttcagtgaggatggagagacttcatcggggatggagagccaagcacagtggcacatgcctgtaatcccagctactcaggaggctgaggtgggagcattacttgagcccaggagttcaagaccaacctgggcaacatagccagaccccatctcaaaaaaaaaaaaaatgcctagagagttttgtgctgctggaaaatagaatttaaggggaaggatgaatacttcttaatagctattgaatctgattcctgctaacatgagaggtagtcgcagaagaaactggcagacattagatgataaaaatggtaaggagattgctttttgaactggcagcagtgacgtgtcactgaaagaacattaacacaaaaatgacaagatccatatttataccagttatggtgcagaggagtcattttagagagatgatagtaatccaaattaaggtaatcaacatgggatgagaaaaggggcagattgaatagatactgaggaagtttggtcaatagtctgggtgacttatttgggaggaggttgaagtggggtcatttttctgatttgtgcaattgggtggatagtgtgatactgagataagaatgtagaagatgagaagaatgtagaaaaaggagctgggtttggggggaaagatgagtttaatttggggatattttgaatttgaggtgcctgtgggatgtctatttggagctagcctgtagacattggattaggggagagatgcacatgctacagatactgatagggtaacagttagcagtaatggtaagtgcagccattgcaatggttgtctgtaatgtgagaagacaagatgaagaatagaaccctgcagatcacccatgtttaagagacagggcaggttagaagaaggggaccttgcaaaggaaacaaaaaaaaaatgcataggaagactatggcagtgaagtatgatgaaagctaagataaaagttgtttcaaaaggacagagtagtcaacaatgtccagtactgtagtaaagtaaggtagttaggccaacatagtatctagccatgtagttcatgaccttgataagaacaagttaagtagacttcagtggtttattgagtatggagccaaagtacagtcactgagaagtaaataagaaacaaaaatggctgggcacggtggttcatgcttataatcccaacattttgggagaccaaggcaggtggtggattgcttgagcccaggagtttgagaacagcctgggcaacatggtgaaaccctgtctctatttaaaaaaaaaaaaaaaaaggaggcaaagctttttaatgaactttatctatgacaaggaagggggaaagaggtaacagaaaagggaggtaggttgtggtgtaagatgggagagactcaaggaaattaaatgctggtggaaatgtggcagtagaaagaaggaaatgtagtgtctgagagggaggatctcagtggtggagcagggttgctcggatggtaatgaactcagcccacttggataggaaagctggaggatgagggatgcctcttgcactgcgtggaagcaaggacagctaagtttatcttgtacggtggcaggaaatggatggacttaacttctggtggctttcattttcttggagacataagaggtggagttgtcccttgagaccaagtgacattgtaggatgtctgagaagatttgaaataggcattgttgaaaatgtctgtataagcacagaaggatgcaagcataaagggcccagctgaggttggtatccatgaatctgtagtgaaacctttttttcttgcttcttcccatcttgcagtgctaagcagcctgagtataggcaaggaaaagttagagggatttatttacctagggtgcagattttgctaggagaatgtataatgtgaagacagtgagtctcggcagttggagttgatgtccagtgaatgtggtccaggctggttgggaaggagggagctgttgcttccttctgttgctgttggggagaaagtggaggggttgcagcatagggttcctcaaagagttaggattagagattgtgaccagaattggctgtttgcatttcatctttcagatgtacactaattgggtaactgaggaagtccagtggttgccgtggaagtaggtagctgaggtggcatggaatgggtgtttgagatgtggcccctgtaggcctctgagcctacactagtgcctgagttaccacccactttgtctctccctgtttagttttcttgtttttttaaaagaggcctaattattatggaattgtgtactgtaaatcctcttgaattattaatgatatttgtgcaaaagattgtgtactttcaaacaactgtttcaactttgcacattaaacagttcgtcacacatgttctcatcattctaaagcctgtataaaaggagatataaaagaagaaattcatatgtagtaaatattttaaaaagaaaacaaagggcaggggggaatctacaaaattcatggtaggagttgcttctggggaggagaataaagagggcctctcctttatctaaagtgttctttttatttaatactaaaatatttatgtagacagggaaaatgacaattttaacatttgttcttctgaatatggagtgtgtatgatcttatattctgtgccaagaggaattgaaaaagcaagccctactaacaatttaaaattttcttcgtagagcctactgcatgatcatatgacattgtgctttgttcatgtcattcttggacaattggaataagctttaggaagctttgacagtgtattatcttatttatccttaaatcatccctgtgaggtagagtccaaggtcaggaaatgtcgacttacagaagttaaatggcccataattattattaataagtgacaaagaaaggtctgcaacccaagtctctctgactgcagagctctacttcactgtatttattatactgttactacttgtttatgccagctgttatgccattatctaacacctagttcagtaaatctgcactcccttctgtaaagcctcctacaaagtgaaattctgaagagagagtttcgcttttgttgcccaggctggagtgcaacggtgcgatctcagctcactgcaacctccacctcacaggttcaagtgattctcctgcctcagcctcccaagtagctgagattacaggtgtccaccaccacccccggctaattttttgtatttagtagagacatggtttcaccatgttggtcagctggtctcaaactcatgacctcaggtgatccgcccgcctcggcctcccaaagtgctgagattacaggcgtgagctaccacacctggcctgaatacagttgttttcattccagcttcccaagtatatgtgtatgttaccttctgcagcagatgccttcataaaatactatggcaaaatccaacatgttaagatgccacagaatgagggctgcttgtattgacttgagatttcttaaaagtaaatttagccattttaataaaaattttttgttacaggatgtgaagttaccccagatgtaaacatttcaggccaaaaatttaacattaaactcctgattccagttgcagaaggcatgaatgaaatctggcttcgttgtgacaatgtaagttttccagttaaaaatacacttcaattttcttaaatgagttgaccagtcatccttatattttatacttgaaagacccacctcgtgatacattgcacacatcagtatttcttttctccaggaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcaggtacttacttcattttacttcatctactgtgctggtttgtttttataattttgtacataactttgtttttcccctcttaaacaaaactttttagtcttaattttgtatcagatggttagaatataaaatacagttagagtatccctaatctgaacctctgaaatcctccaaaatctgaaactttttgagtgccaacatgactctcaaatgctcattggcacattttggatttcagatttgggatcctcaactggtaagtataatgcagatattccaaaatccaaaaaaatctgaaacccaaaatacttctggtcccaagaattttggataatggatactcaatctgtagaaaataaagtaacctttagtcagtttaaattggtcattaaaaaaaaaaatctttatcattttaatagaacagataaggacacagaatagttgagaacttactctaaacaaattgcagaaatcattctgttaacatggtgttctttcagacattttagggaattgaatatggtctcaatgctttgtgttccttaatttatttaattttattccatatataattaagtaaatgtgacataaagtgcagccagcatttctcaacaaaatctgtaatacctgctcttgttgaaattggcttttccagctttagaaagaaactttacaagagtacatttttagccgtgtcttttcttaacattttcagtcagaacctaaccacaattttacacatagttacacagtttggtaaattttcattgaaatttgcttttgttcactctgtttagaattcttttctttggaaattaataccataaaagggctgctacttaggaaaatggttctttggtacaacataaaaagtcctttacaggggaatttcacttggtataggccctggtattctctgcccccaacatcatgccataaaaggaaaaggctttagtttgggggtggggagacgaagacctttaaaataaacattttgtttttatctaattttgctttaatctttgttaaggaataattttaaaacatactaaaaaggctcaatgaaatgcccagaacacttactaattccttaactttaagtataatatttattatatgggtctaaaattatttctacctaaatgttcagaattttaatgacagaatatttgtctttaagtctcagaggttgtgtaagcctagaaattgtttatcccgtggtcatatgatgtgggagtagtaaggaatggaggaaatgctgccctggggaactgtatggaatgtagattgtaagttaaaaagagaaagtaaagcaagtgctaatttcatttttcattcgtagttttttaaaattatttatacagaatcttgtttctaaaagtgaacttatttgccttcaaaggcaataagtaatttcaaacctgaccaattttatcatttcacagtaaggtatcagggagataaaagagcttaaacgagagctgccacacattgttttcactgtcaactatttgttttctcagaagccttttaaatgatagttcttgactagaaactatcaactgaagatttatctttaactgacaggaggacagtttgtgtgtggtccgtggttaaagatccttctggccttgcctttcatgttgccatctaatcaaatgcacatttttaaccctcctttctctcactagagctataggttagattttttggtgtgtattttgttctctttgaggcagagtctctctgtctcccaggctggagtgcagtggcaccatcatagctcaagcgcactgcagcctccatctcccaggctcaagcaatcctcccacctcagcctccctagtaactagaaccacaggcacgcactgccactccaggctaatttttgtattttttgtagagatggggtctcgctatgttgcttagactggtctcaaactcttgagctcaagtgatctgcctgccttggcctcccgaagcactgggattacaggtgtgagccaccacactctgctggaatagacttacaaattgttggccaggcacagtggctcacgcctgtaatcccagcactttgagaggccgaggcgggtggatcacttgaggtcaggagtttgagaccagcctggccaacatggtgaaaccccatctctactaaaaatacaaaaattagccaggcatggtggtgcacgcctataatgccagctacttgggaggctgaggcaggagaatcacctgtacccgggaggtggaggttgcagtgagccaagatggcgccattgcactccagcctgggtgacaagagtgaaattctgtctcagaaaaaaaaattgtttccagagaatagcgaccatgatgttattgccctggtgcctagtaagtagtgacattcagaagtttagttgctactgtgtgtcagataccacactagtcacactggacatagtgctcagtaattattaagctgtatccagttgcgttctggaggctgtaggaagatgtgcaggccacaaggacattcttccctacctgggcatagactcgtagttttcttttgggtctatcaaaataacctgttgtatttaacctactttaattcccttcaattatatatatattaactaaacatgctgtgggtatttttaaataaatatgactctcaaactggatttttaaattttgaagaattattctatatgttgatttatgttaatctaaatggaaatgactaatgccataaagccgaaattcctcatgtagtatacggcatctctttgttttcccttccaggaaaaaggatgcaaaaaacacatggtaactgaggggtttgcttttcttgtgtaaaaaaagaaacagatgggcactgcacttattttatgccttcaaattcttatttctgaaaagcagtgcatggatcatattatctgactaaatctgagaagactttaaaggcttttggatacttttattttgctactaaaataattggctttaccttaaccggtgagaactgggtacacgatgtaactgggtacacgatgtagggggaaagaaatatttgctctttttatcttctccctacaaatttctacccttaggttctttagcaacatttaacattctaaaataatgtggagtgtttctcagtgttctaaatggaaagtaattgctgcttcctcattttcatttttcattcttgcatttactttgcttggtttctacctaaagtagttttttgcatgacttttggctggaattttggtttgcaggtgaccgcaactttttctttgcttcgttgccattttttctgattgcctttttttttctttctgcttcctttttctttcctcgcattgccatctacagccaggctatataagagatttggtaagttctccatatttaccacaaaagaaaaagaataaataaaaattcatagccacaaccttccctcatggaatttaccccagtagtgaaatttaaatttaaaatagaaatgattatggtgatttcaagtaccttaaagctgctaacaaatattcctgctagaaacatgtattccaggtattcattctgattatagacatagtgctaaatttaattaaaactcgtgtatatgtggattagaatgtgctgttctgtaatagtagtaccgttaggtgtatgcatttggaatatgtctcaagtgtggcaactatgtactcctaatagtactttttgttgatatatgaaaactgaaattaagacttattttgaaaaatccttatacattacattattacagtgtccaaatgtagcttcagatattttgatttcaactcttacaatatgattttggggtacggggtgcgtaattcaatcttttgatcttttgtctcagttctcccatgagagaataatgttcaatggtaaaggtgatgtttactcatgtttagataacagcgagaatcttggaggcccatcagaatgtagctcagatgagtctaattgaagccaagatgagatttattcaagcttggcagtcactacctgaatttggcatcactcacttcattgcaaggtcagtggttctaagcatctatgtgtaaaccttaatctgcatttttgcttaatctacctcatgtaattagatattaaacatctaaagcatacctatgtagacccattaactcatattacaatagaattcaaagactgttagaatgtattttgtaagcttttaatttctacattaaaaattcaagataattgtgtttgttttactactaagagaatagcactcttggccaggcacggtggctcacgcctgtaatcgcagcactgtgggaggccgaggtgggtggatcacgaggtcaggagatagagaccatcctggctaacacggtgaaaccctgtctctactaaaaatacaaaaaattagtggggcatggtggtgggcgcctgtagtcccagctactcgggaggctgaggcaggagaatggcgtgaacccaggaggcggagcttgcagtgagctgagatcgcgccactgcactccagcctgggcaacagagcaagactccgtctcaaaaaaaaaaaaaaagaatagtactcttttagggttagagagaacacttatcttgaagaaaagcagtccaacatgttcccccacaacatgtttttaaccgttcttttcttaaatgttataggttccaagggggcaaaaaagaagaacttattggaattgcatacaacagactgattcggatggatgccagcactggagatgcaattaaaacatggcgtttcagcaacatgaaacagtggaatgtcaactgggaaatcaaaatggtaaactcataacaatgttacttgaatatagtccttctctgatacaaattagtacattaagaataaaaaggcctataaattctgatgattatttgtaccaccacctcttaaagtacagacagaccatggttgactattcatttctcacttaaatttgcctatttcataattagcccagttactaaaattctaagtgcataatttgcttagaatgttgccttttttgtctttctgtaatggataaagccgatctactctgaaatagcagctactgtttgttgaatgcctaccctgtgccagacatgatacttagaggcttacattagtaccctgtctctaaacctcatcacagccttttaaggcagttggacaaatgaagacactgcaatagagagacctgagggccatcattgtctatgaccacgcacaaagtaactacagaatcatttcaaactcagatgctttaggcttaaaaacctggcacatttaccactgtacatcatgttgcccccagtcttggagtatacgagtatcatttaaaatgaaccatcttttactaataagtcatttggtttagcatcatattggatttattgtatcaattcctattacttcaaagaatcttatatttctgaaatactcaaacgtgatacctaaaatttaagtatctgaagcgaacgttaaaacacaggaagtaggctttcctgcacgacttgaagagaggcattctcattaattgaatcaatcaccagagaccatttgagaactgaacgacctaaaacccttgcattcctagtcttccttttcagaacatgaaaacttaaagtgtaggggaagggcaataaacttagcttcttctttgggacttaaaggcattattcgtttaggttttagacagactgatcatttgaggatcaacaagtgttttgtgatatgacagactttaagtagcacagtagttttgtgtggacccagccacctagcatttgggacagcactgatggctcttgtctttgttccaggtcaccgtagagtttgcagatgaagtacgattgtccttcatttgtactgaagtagattgcaaagtggttcatgaattcattggtggctacatatttctctcaacacgtgcaaaagaccaaaacgagagtttagatgaagagatgttctacaaacttaccagtggttgggtgtgaataggaatactgtttaatgaaactccacggccataacaatatttaactttaaaagctgtttgttatatgctgcttaataaagtaagcttgaaatttatcattttatcatgaaaacttctttgccttaccagaccagttaatatgtgcactaaacaagcacgactattaatctatcatgttatgatataataaacttgaatttgtcacacattccttagggccatgaattgaaaactgaaatagtgggcaaatcaggaacaaaccatcactgatttactgatttaagctagccaaactgtaagaaacaagccatctattttaaagctatccagggcttaacctatatgaactctatttatcatgtctaatgcatgtgatttaatgtatgtttaatttgatatcatgttttaaaatatcctacttctggtagccatttaattcctccccctacccccaaataaatcaggcatgcaggaggcctgatatttagtaatgtcattgtgtttgaccttgaaggaaaatgctattagtccgtcgtgcttgatttgtttttgtccttgaataagcatgttatgtatattgtctcgtgtttttatttttacaccatattgtattacacttttagtattcaccagcataatcactgtctgcctaaaatatgcaactctttgcattacaatatgaagtaaagttctatgaagtatgcattttgtgtaactaatgtaaaaacacaaattttataaaattgtacagttttttaaaaactactcacaactagcagatggcttaaatgtagcaatctctgcgttaattaaatgcctttaagagatataattaacgtgcagttttaatatctactaaattaagaatgacttcattatgatcatgatttgccacaatgtccttaactctaatgcctggactggccatgttctagtctgttgcgctgttacaatctgtattggtgctagtcagaaaattcctagctcacatagcccaaaagggtgcgagggagaggtggattaccagtattgttcaataatccatggttcaaagactgtataaatgcattttattttaaataaaagcaaaacttttattt

SEQ ID NO: 37174 - DNA, 93744 bp, Homo sapiens; identical to SEQ ID NO: 37173

SEQ ID NO: 37175 - DNA, 76570 bp, Homo sapiens
cgggcgtgtaacccacgggtgcgcgcccacgaccgccagactcgagcagtctctggaacacgctgcggggctcccgggcctgagccaggtctgttctccacgcaggtgttccgcgcgccccgttcagccatgtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggccgtacagcagctgcaggcggagggcctgagcccgcgcttccaccagctggacatcgacgatctgcagagcatccgcgccctgcgcgacttcctgcgcaaggagtacgggggcctggacgtgctggtcaacaacgcgggcatcgccttcaagggtatggggaggggacgtggcctccccgaagaagaaccgatgcactggggctcctggcgtctgcggggtccataacgcctccctagggaggagagggaggagctaggagatgcagggagtgcagaaaccttggagaaagtgagagttttccagccaaagggaactttgtgtttccctggctgggactcttggggatctttttcaggttttctgcagtttttctgaattgagctttaaggcaactggatggattttgaactgattttaaaataaacgacaaattgcaaaaagaaaaaatggttatgccaagatccagtgtgtgcacccttcatcctccttcccccaatggtgccatcttacaaaaatactagaacatgatcaaaccaggagattgacattggcacaatactgtaaccagatacagacttactttaggcagagggcactaagtttttttttttttttttttttttttttagtatcattgtatagaattttaccccatgggtacaatgtattaactatgttctctttctctcctaaaagttgctgatcccacaccctttcatattcaagctgaagtgacgatgaaaacaaatttctttggtacccgagatgtgtgcacagaattactccctctaataaaaccccaaggtgagtctgatgggaaacagcgcaccttctctttggggcttgatttggcccctgcttgcctgggatttctcctgcaggctcctgcttcctctccatgctgcacgtgcactgacctctgtgctttttctcctgccagctgatatgtgccattttgcctcaggactttgtcctcacttctcccactcccatggccattcgtcctccctgtcgcactggtctttgcacacctggctgactctcatccttcaggtcttagctcaaacgtctcctgagagatgctctttatttgctccattcccctctgcgtgggagtccatcctgtaccctttctctgctctttcagagagatcttattcaggctggtggaggctttactaccaccagttcattaggcccttctaatacctgtcacctgtctgaaacactccttaagctcccaaccacatggttgtcttgctgcctttccatctcttcctgatgcctttccccacaatctaagatatttccagaggatccctatccttttccctaagtcgtttgggacacagaccccaccacccacccaccaggatcctgcaggtcaccatgccccacccctcataatcatttactaggtcctaggagttgtgcccactgagttcctcctgaatccgtctcattgcagctctacagcaggccctcacctgtccctctggacaattgcaaaccctcacaaggcacctctggtcttgagtcttttcctcttttcctttcccagcatcctgcgtactgtctgcatggtcatgcctctcccaaaatccttcaggaggaaagtccaagcccttagcatggttcacagagatgtccataatctgccgctgcttaactctgggcccattttaactccccttcaacgtgctgaaggtgctggacatgactatcacatgtctttggttgtaaactgctgtgatagttaccctaagtaatgggacaggagatgaacccacccattaaataacacagcaattaagcagccacttttagaaaaatttaaatgtgtggcttcgagttgggtacttgcatgtacagcttactctcagcttttatcctgtttccctgtcctgtcgtcctgttaagttgtgctacttctaaggctctggttcaccaggacctcaaagggcagctcttccaaatctcacctgactctactcagccaaaattcgaaggcaggaatgaacttcttcatgcaactaccaccacactttctatgcgtattcctcttagaactcataccagtaactgtctctcatatgaaaattttctgctccaaaatccctgcaaatttggcattcacctctctacgggattgttgcacacctttctacataatgctttgtggtgtatcttagggagagtggtgaacgtatctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatacggggtgacgaagattggcgtcaccgttctgtccaggatccacgccaggaaactgagtgagcagaggaaaggggacaagatcctcctgaatgcctgctgcccagggtgggtgagaactgacatggcgggacccaaggccaccaagagcccagaagaaggtgcagagacccctgtgtacttggcccttttgcccccagatgctgagggtccccatggacaatttgtttcagagaagagagttgaacagtggtgagctgggctcacagctccatccatgggccccattttgtaccttgtcctgagttggtccaaagggcatttacaatgtcataaatatccttatataagaaaaaaaatgatctcttatcaattagcactcactaatgtactactaattgagcaacctacgcactcagttgactacgtaaatctgtcaggtcttttgtgatttcctctgatgcaggagaggaaaaattgtaattgatgaaaataatgaatgaaaatcaacagatgaataaatggttctttataagtgtccatttgtacagattgtttagatgctaaataagctttgtctcaagtacaatcaacctaaaaggtcaagggaagggacagtacaacttgggggtgagcaaacccagaaagtaaagaaagagccagttagtcaatattttcaatgttgtaggtcaaacaatgcattggaactccccaaatccacattatgtaacaaaagctgacagcatgtaagcctgtgagcatagctggctctggcccttcccagcctctaggaaaacaaatagtaccacaacggcaaaggcagctgacctggtctctttaaaaaagccaaagtcattggggaaaaacaaccagttgctatgtgtgaaacgtgagtgtgcacttgtgtgaaacaccgagctgatgagggacctatcagatctccataggaatgtgttatttatgtagggatgaagtgtcatgaggtgtacaacatatgccccaggtgtacaacatgtgtttcagcaaagtatacaaagactgatgaacaggtaaggcaaaaaaaaaacaacttttctgtttgttgaaagctttcaaaacctgggggttggcagtggaaacttctggctctgcccactgaattcctgacctcaggcagaatactgtatctggctttgtctctgtttcctcaactgtcaaattgggatgacagtcataggattatatgtattgagataaagtgttgagaacaaattagctgggtgtgatggtgggcgcctgtaatcccagctactcaggaggctgaggcaggagaatcgcttgaacccagggggtggaggttgcagtgagccaagattgcactactgcactccagcctgggcgacagagtgagacttcatctcaaaaaaaaaaaaaaaaatagtgttgagaacagcccctgctgtcattagttcctgtaaatgggcctgacgctgtccctgctggtaatgagaagtgtgtgtttactgtctaacacccagtaaatgcccaggccattctgtttcttccacagaatcacagtgttgtgatctctcacacttcaccagtgagaattaaggcttacagaaacaaaaagcgatcacccgtgaaaagaaggagaggccccttattttatttttatctatttattttttaattctccaaactgcttcggaagagtcccttattttatttatttatttatttatttgtttgtttgtttgtttgtttattgagacagagtctcaatcttggttcagtgcaacctctgcctcctgggttcaagtgattctcctgcctcagcctcctgagtagctgggattacaggcgcccgccaccatgcatggctaacttttgtatttttagtagagacagggtttcgccatgttggccaagctgatctcgaacttctggcctcaagtgatccacccgcctcggcctcccaaagtactgggattacagacatgagccactgcacccagcctagtcccttaggttaaaagtgaggtttactttgacaagtttcacctttcagtagggctgttcatttcttcctagtttttgtacacagacaccagaaaacaatcacgtctgcagcaaaactggtattctcaagtgctagtttagaaatttgtacctgtattgcaaagatatttttcccttaataccttaaaaataacacctaacttctttaagagatttagagaaagcattgttccaaattcaagtacctgcttacctctgagggtgaggggaggaggacatacgtggttccgtctttattgctaaggatttctttcttataccaggtgataggtacatggtgctaaaatacaattttcagaaaaaggtaaaatcatgactgtcatacagatgtaaaaataatagtcaaaaaaatgtattttactcataagggaaccagggaaatgttataactggttcaaaggaaaagctaaaaggaaaagctaacagattatatggaatcaacaaatgttgagctgaattgcaaatgacgacaaaactggtgtttttacagggaggaggacgtcaattcagtcaccactagacaggacagcacttgcacctctgttacctacaattaagaaagagatgcaaaatatctcaaagaatgaacagggccatagttcaatgctacgagtcttgccttgcaagcacccttcactctgttgtgtgagtctggcaaaacacccatccccatgcttaataaccatgccagcctgctctagcagctcttaacagatgatgttgctagggagaaaggaaacaagaggctgactgtactcttttatgttcccaccccaatcccaaacagacaagcaattctcctagccagtgttgtcttttcccctagtaaattcactctcctactctgtaagatgattattctttccgcatatctcccagactgatcgtgctggaggatgtcctcaaatctgttccctaaaaaagaaatagatgcccctgaggagagtcgttcaacatacctgcaaccagacagcacaccctgcccccctttccgttacaagaagaggcacactgcttcccaggcagcacccccaccagagtcctggttcgtccattattgccctcccaaacattttgttcttgtaattattccctttctttccttcaccaaattcacctctcagattaccattgcataaaaacatgctttaatatctctcccagcttttaaaactaaggagttgagtcacacaaagtatattctccgaccacactggaattaagttagaaatcaatagtaagatggctagaaaatccccaaatagttggaaaccaacaaaatacactttcaaacacccttagtcgaaaagatatcaaaagttaagaaaacaacaacaacaaaattttttaaagatattgaaagttaaattcaaaagtattttgaactgaatgaaactgaaaacaacatatcaatgtttgtgggatggcactaaagcggtacttcgagggaaatgtatactacgtaatgcctacactagaaaagaactgtctcaaacaatgacctcagcttccatggtaagaaactagaataagagcaaatgaaaccccaaatgagcagatgaaaggaaataaagatcagaacaaaaattagtataatcagaagagagcaataaaggtaaaaaaaaaaatcaatgaagccaaaagccggttccttgaggaaaaacaaaaagtgctaaacctctagccagagagatcagaaaaagaaaaaaaaaatgaaagacacagattaccaatgtcaggaatgagaagtagcatcattatgattaataagaagataataaggggttgggcacagtggctcacacctaaaatcccagctctttgggaagccgaggcaggtggatcacctgaggtcaggagttcaagcccagcgggccaacagggtgaaaccccatctctactagaaatacaaaaactagccagacattgtggcagacacctgtaatcccagctactctggaggctgaggcaggagaatcgcttgaacccaggtggagattgcagtgaaccgagatcatgccactgcactccagcctgggcaacagagtaagactgtctaaaaaaaaaaagagcattttactaacaacctcaaatcattggaattaacaacttacataaaatgtacacatttattaatatttagaaaaacactaagctcactgaagaagaaatggaaaacctgaatagctctatgtctgtaaagtgaagtttcaaatactctttggaaagaaagaaagattggttggggcataaagggaaccacacccagcaggtgcccagctattaacttgactttgatagagaaagtggactcggtggcagggcacaggcagttcagccagatctgcttgagtaaagcagagtcatgatgagatggtggctctctgctaatctcagagtcgctaatcaaacacactcagatcaaacacgtgggttacagtgaagaagacgaatgaaggaatccaattgcccgtctataccttgacacacctttgacaattcctttgttttgtgggtacacatttcatggggagatgccatatattttacatattaactgtgactttggataaaacaaaaatgcagacacttttagcaaacgggttatgtaacaattagataaaacattctaataaatggcttacggcatagtaggagcttcataaacattctctctcatttgagggcatattaggaaccacacagagattgcctgcccatgcctggaagtctaattacaggacatcttttttctctaattcttaagtttcagtttctcttaagaaaggggatgtatgtcctgagaagcacttagtgtgtaaataatttcattgcatcttaagataaagcaaacatctgcattttgcagtgggtgatgggtgcacatccaagaaaattacttggcacatgttttcctccctttgggattctcccaaaatagttttaattcaactgtcacctgtctcaggccccctactgacccatcaccatccagttttgctttcagagagcccgacctcttagccctgcaaaccattgcttggctctgttaggatcaaaagagggatgtgtcttggcatgacccaatacacagctcatggaaagggtagacccaggagtgggggcattaggaaactttctggaacattcagcccctcgagttgcagcactggaatgcagaacttagctctgctgtacagcccagagcaaccatgccggcctgcagccataaggcaccttcaggctgcaacaattccgagaattgacgtctctgtacacgcaggtcccaataccacttataatgtgtacgaggtgttagtctcagataaacaggactgggcactttggctgcaaacaaagcagcatctggtgggacacacggaggcacaaggaggtacaagaggagttgttcatgacacggggtcagaatccatgccttccattagctgggctacttactcggatctccataatcccaatataggtgagaaggtgtctataccctgtgaagtataattttggcagaacaaggtacatttcttaggatatggactatcccaggaagtccatccctcacaaggatttaccattcggaactgcccagtcctgacactaaaagacaacacaggagatttagggtcacactagctattgcagaaagtcagtccctaacttttctgtaatcaccacaattctataactttcagtcatctatgccagaattcccatttttgggaacagtaatagattgaaggctggctgccaagaagatatgtccatgtgtcagaatctatgaatattttctttggaagaaagatttttgcaaatgtaattaaggatttcaagctgagctcatcctggattatctgggtgggccctaaatcaatgacaagtgtctttttacaaaacagagagacaaggcaggcatatgaagacaggttgattagagggatgtggccgtagccccaagccaaggaaagcctgcagcccacaaaagctggaagagtcaaggaaagatttctctctagagactttggagggaatgcagctatactgacagcttgatttcagaattctggcctccagaactatgagagtaaatctccgttgtaagtcaccaagtttggggttatctgtttcattttgttttgttttttgagacgaagtctcgctctgttgcccaggctggagtgcagtgatgcgatctcggctcactgaaacctctgcctcccgggttcaagctcaggagcagctgggattacggacacataccaccacaccctgctaagttttgtatttttgtaaagacggggtttcaccatgttggccaggctggtctcaaactccagacctcaagtgatccacctgccttggcctcccagagtgctgggattacaggcatgagccaccacgcccgcccggatcatgtgttatggcagccctaggaaagtgaaacagaaacccgaacataagcagatatcctgtgactgaaattaaccctccaacaacttcccactctggccttagctaactatgaacctctctgctcactcatacagaagggcttccaatttttacccagttctctggagcctagaagcaaaaagctatgacaacctttttcttgatccggcagcagactcatccaccttgtctcagagcagcagtggcagcagcagccgcgtgcctgaagccctctgtcgccttacccctggagcctcctttaacatagggccctccggctgcacagtttttgctgctcactgaaaatagtcaacatttctgagaaaactgattcacctcccgagacattagaacgagatctcaaatgcctagaacaactgactgctgtacgtgtcttcacgtttttgttccttacatacctttgtttttagttactttcgttccttatttacctttgtttttttttgttttttttttttccctttctctgctggtttaaggttctggattgcaaatagctacttgttatctcctaactatgtcacccatgtgggcccctgttcctaatactgcctttgtactacccctcgtgactccatggcttaaacataatttaaccaaccattggaattatgtccacatttgatatgttttggatctatgtccccacccaaatctcatgtcaataatcctcccagtgctggaggtgggtcctcgtgggactgattggatcatgggggcgggttcccatgaatgggttagcgccatccccccagtgttgtctcgtgatagagttctcatgagatctggctgtttaaaagtgtgcggcctctcctccctttctttcttccttctactctagccatgtaagttgtacctgcttcccctttgccttccgccacgattgtaaatttcctgaggcctccccagccatgcttcctgaacagcctgtggaactgtgagccaattaaacctcttttatttgtaagttacccagtctcagaaattgctttacagcagggagagaatggactgatacaacatccctttgagcatttcccagtttccattagtactgatcccttgtagtgaatcagttggttgtataaacggcaaatactataacaagccagatggccaaaaaccaagtactctttataacgtcatgcaaaaaagtgggaattttctgtctccgttaaaatgaaacttgggtatcctttcatagaaattagcacttcaaccaaacttactaatagagcttgtaagcaaccaactgatatgggactaactgtacaagtaaaagattctgcttttacacagatgctttaaggaaggtttctacttacgcttagtctccttgactatggaactatgtgctgatgtctgcatttcactgtctggtgctggaatagacttgtattgacttgtgtcaaagctgtaggacaattacacaacatcatggggtattttggcaaacaatggaactttgggtggcctccagtgactgatagtggatttatgctacaaaagcttattggctactgcccacaaatcagacagagatgtgccaacccaataagctgatgccaactatcaggaaagttcctgatatttctctgggtccctttggcccattgatttcccctcattaaaaaaaaaaaaaaaaaaaaagtcttcaaatctcttaattcaagataaagaatccaggcatggtgactcgtgcctatattccctgcactctgggaggccaagacaggaggattgcttgaggccaggagttcaagaccagcctgggcaatataatgagatcccatctctacaaaaaatttaaaaattagctggccatagtggcacatacatgtagtcccaactgctggggagactgaggcaggaggatcccttgagcctgggagtttaaggctgcagtgagctctgatcatgtccctgcactccagcctaggcaacagagcaagacactgtctcaaaaaaaaaaaaagaaaaagaaaagaaaagaaaatgtgagcttcaatttaaaaccctaaatcttaacctttgaggaacaattccgtgctgctttattctgtcttcaggcatacctatttcacactttacagaaggcccaaaaagtggctcaaaaaaaccctacgtgtcttggttcagagactgacagagaactagggagtgtgattaaagccagaggtctccttgcctaagaaattcacaggactggattgacagtgggttaaaaagagtcattctagacatactactgccttctcaaggcagaacaggcaccttcttagagaatgttaaacttccatcctacagtcttttctatgatctttaatattatagagatctgggaaataaaggcattagaaaattcagcaatttgggctgggtgtggtggctcatgcctgtaattccagcactttgggaggccctggtgggcaatcacctgaggtcaggcgttcaagaccagcctgtccaatatagtggaaccccatctctactaaaaaaatacaaaagttaggagataacacctggctaattttgtattgtttttaagtagagatggtgtagtgcacgactgcagccccagctccttgggaggctgaggcaggagaatcgcttgaacctgggaggtgaagtttgcagtgagcctagatcacaccattgcactccagcctgggcaacagattgagactctgtctcaaaaaaaaaacagaaaaaaaagaaaattcagtaatctggtcgatattcccacatccagttctttgggctcttcaaacagagcagatagtatctgctttcttggcttaaattgtgcaaatttggttcctggctgagaagtagactccaaacagttcttcagtgttgcagtgatcaaacatgtacttctacagaatcataaatgttgccacacagctgctattttatcaatgatcttattgacaaaaacaagaagacctaatatctactgaaactgaagtgacttccaaccatgaatattccatccagtgctgtaagtcaaagttgttttctcttccatagatgtggttgaaatatgattcaaaaattatgtctcagaaatagaaaagtgaagaaattataacttgtcaagcagattaattatatagagaccacagacttaaaatccagatagattggttcaaattcaaacaccttgagtgtcagtttgttcggtggagtcatgttttagaaagataagctcataaactgttcaaatacaaacaacgttagcacctctcctagtttacaaattctgaccaaccataatgtaaacctcaattataaacttctgctctaagatcaccctatgactaaccatccaaacataaaacctcgtagctcaagaccctgggggagtctattgggtggaattattcagccagtggctcccttgcttagtaagtttctaataaagttagcttcttttttttttttttttttttttaataatcaggtttttctggtggtcttacatgagtctttgaaagctcattctgtaatattcaggaagcagtaaagaagtctttttatacccttgaacttgctttctttcctactgtttatagccaatgattctgggatagagaatttaagaatagcgatgttgtttgttcaaattacatattcccttactttccccaatctccaacaagatcctgccatgcaacccaaaactcagaagcacaactgcagtaagccagtgccagtgaaggaggtaagttgcttctccaagtagtgctagagaaagtgttgaaaacattggccatgttgaaattatccatgcaaaaccatgttaagttggagatatgacaataagttagtataacatttgctggggccaggcaccgtggttcacgcctgtaatcccagcactttgggaggccgaggcaggtagatcacctgaggtcaggagttcaagaccagtctggcgaacatggcaaaatcttgtctctactaaaaatacaaaaacttagcggagcctggtggcacacctgtaatcccagctacttgggaggctgaggcatgagaattgcttgaacctgggaggcggagattgcagtgagccgagatcacactgctacactctagcctgggcaacagagtgaaactgtgttgcaaaacacaaacaaacaaaaaaacaaaaacacacacacacgtttgcaaaaaacataacctcaaagagtagctcttcaagtcactactcccatctctctatgccatgtgatatcacctgctttctcactaggtgagggcttggtgggggtggtcaaggaagaacacatcagggagaagcaccagaggtagcaaggtcacaggtgtggggcctggaagcgtcatcgctgctcacatcattagtgctgctggtgctggtcctcaccccaaccccatgtctgagctcaggagaactagagccccgccgtccctcctgtgcctccacttcatgctagaggccttaaaggactgcaaccacaagaaacacaaacaggcccctggcagggctggtctttggacaattgtgaaagacacaaaagaagacagcttctagaggcgggcatggtggctcacgcctgtaatcccagtactttgggaggccgaggcaggtgagtcacttgagatcaggagttcgagaccatcctgaccaacatggtgaaaccctgtctctactaaaaatacaaaaattaggccgggtgcagtggctcacgcctataattccagctacttgggaggctgaggtaggagaatcgcttgaacccgggaggtggaagttgcagtgagccaggatgacaccactgcgctctagcctgggcgatagagtgagactgcgtctcaaaaaataaataaataaaataaaatcagccaggcacagtggtgcatgcctgtaatcccagctactcaggaggctgaggcaggagaatcacttgaacccgggaaggggaggttgcagtgagctgaaatcataccaatgcactacctgggtgacagagtaagactccgtctcaaaaaaaaaaaaaaaagaaaagacagcttctgggactctcacaatgcagtgagaattcttgagttcttggaatggatgcattaacctctgttttcaagatggagaaggaagccaagtatggggatgctattctgtacagggggaagatctgaagattcaaacagaaggcacaaatccaggaggcagtccacaagcctacaaaaatgtatatcctacaagattcaggttgctaattttggagaacaactttctgaacccagcttatgaaggccacctaatggtggggactcccactcatgacaaggtgtggaaaatctgacaaagaaaattatagaactcctaatcctctttggccaatatgaactgaagcttcagaacaaagttccaggcctcccaaaaagtcttgatccagcctgttgccattttaatccaaaacgcactatggttatagcattgcagctgggatggagtaattgtatcctcagaatcaggagcagttgtatgcaagggcttcaaacttactcaatagcagaatttgtgtaggtgatttgaatacttagggtcacttgagatcagtgccatcaagaccagcttttgggagatctcagtctcccaagcagttgtccctcacaagaaactccatgccaagggcagattgctccctgttcagatggaaaacatcaagcactcacactcagagctcatcagctgctggcttcagcttgagcaagaagtcttcagtgtcccagcaggtgatatctcactaccaacttgctgtgcacagatttgctgctgctctatcaagatgcacaggccaggctgggtgttgtgtggctcacacctataatcctagccctgttgggaggccaaagcagaaggattgtatgaacccaggagttcaagaccagcctgggcaacacagcaagacctcgtctctaaaaacaaagacaaaaacaaaaaaaaaactagccagacatggtagcatgtacccatagtccccaccccccccgaaaaaaatgcacagaccaactagaatccaaggataaccattctgacattcatgggtcccatctctaacagctacttcaccacataccagagacaccaagggttccctcagcccaggtctccatgccaaccaggctcaagttttaaaccctagaaattaggttctctagggccaacgagagactagggataaaacctagagctaaaatccaggtcccagctgtgctggcctctgccaaggattcttcaggcttccctgcttcttcatcgtcaggatccctaatcctacaatcagtagccagtgcctttgtccactgccacgcccagctaatttttgtatttttaatagatatggggtttcaccatgttggctaggctggtctcgaactcctgacttcagacaatctgtccccctcggcctcccaaagtgctgggattacaggcatgagctaccatgcccagcctgtattaatttccatgtgtttgtgtaatttccagagttcctcttgttattgatgtctagttttcttccatcttggtcagaaaagatacttgatatgatttctgtttttttgaatgtgttcagacttgttttgtggcctaagatatggtctattctggagaatgttctatgtactgatgaaaatgtgtattctgcaacagttgggtgaaatgttctcctattgtgagttaggcctattagatgtagtgtgtagtttaactctgatgtttcctttttgattttctatctgaataatctgtacattaaaagtcttctactattattgtatttcagtctgtctttccctttaaatctattcatgtttgctttatatacttgagggctgcagtgttggttgcatatacgtttataattgttatttcatatcttctcgccaaattgatccttttatcattacatagggaccttctttgtttcattttagtctttgatttgtagtctattttatctgatataagtggagctactcctgctgttttttggtttccaattgcatggaatatctttttccatgcctacactttcagtccatgtgtgtctttataggtaaagtgggtttcttgttggcagcatatatgggtcttgtttctttatccattcagcctctctatgccttttaattggagaactgagtccatttatgttgtttcattactgacaagtaagaacatactactgccattatgttggttgttttctggttgttttgtaacccctctcttcttttctcactgtcttcctttgtggttaaggtatttcctctggaaatatgttttaattcattgctgtttatttctggtgaatttattataggtttttgtgttgtgattaccatgaaacttacaaaaaacatcttagaggccaggtgtggtggctcttgcctgtagtcccagcactttgggaggctgaagtgggtggatcacggggtcaagagtcgaagaccagcctggcccacatggtgaaacctcatcgctactaaaaatatgaaaattagccgggcatgatggcaggtgcctgtaatcccagctgctcgggaggctgaggcaggagaatcgcttgagcctgggaggcagaggatgcagtgagccaagataatgccattgcactccagcctgggtgacagagcaagactccgtctcaaaaaaaaaaaaaaaaaaaaaaattcatagagatagaacaagttattttaaagagatgacaacttagatcacaaagaaacaaaaaacaaaaaaaagtttacactttaactccatcccctcccacacattttgacttttaattgtctcaatttatatattttatttcacctcttaactagttgctattgctattattattttttgatagtcttttgggtttcatatgagagtgatgagtggaccgcacaccatacttatagcattaaaatattctgggtttgtccatgtacttaattgtacctgtgggttttataccttcaattgctttctcttttcacattaatgttttttctttcagattgaagaactccctttagcatttctaaatgccacgggtctagcagtggtaaattctctcataattcagtagtgctcattagcttatttttatatgtagtaactttaaggtttttgtctttctttgagtgagattctctgcctcagatttgatccacggccatcctttcttaagttactaaggcacacattaggcttggcctcagccagccccctagtggtacagctcatgcccccaagagtcccctactcttctcctacatcacacggggacactggagttgttcccagggtgtatccttggtctgggtcattttctgtgttgagatgacatcatggccggcaaacaaagacagtgttatctgttgctctttttatgcaatgccaagtaccagcctacccaagcctccatcctactgccagccagcgtggaaaggcctcattggcattcagcaccaggcttccagacactcaggcacccaacagttgccaccatacctcagctgcctgccctttcacacagaggagggtgggcaagtgagagctcatgtttcccaccaaggaagggatttatcaggcagtgggagagggagaagcttaagagaagaagagactagaagtttccctctcctccagtccctcattcgacaatctctgcaaccttcagagaatggctcctctgttcctgaatgctgaatagttagtggatgactggacatttctcagagagctcgtggccctctgctagctgccctcaggaggatctggggcctgccagagttagctataaagggatgctgggttttggaaggaagaagaaacagctctcctccataaggaaaggtcctaaaactgctcagggatggagaggcaacctggctgggcctggccttcccccacacagggcaccaggcatgtgactgagattatcttggaccctccagcccaccccagccaccaataaatatcaccaagaaattccaatgaacaccacatgaagcaaaagaactgatcatctatgtcctgcccgaattccctgacccacagaagcataagaatagttgtcattttaagccaatatattttggggtaatttgttacgtagtaacagacagctagaacccctgaccaatataactctcaataggaaatgggcaaataccttaaacagataattcacgatagaagaaatattgactactgagaatatgaagaaattatttcccaaattcattattaataataaactgaaacaaacagactatgtgtcaacttgggaagtttgtgtttttgtttttaatacctggtatttgcaagactgtggtagaagtgctattttcttgtactcctgatactatggttttaatttttgttccttctaaaactcatgttaaaccgaggcaggtggatcacttgaggtcaggaatttgagaacagcttggccaacatggtgaaatcccatctctactaaaaatacaaaaactagctggccatggtggcaggtgcctgttatcccagctgcttgggaggctgaagaaggagaatcacttgaacccagatagcagaggctgcagtgagtcgagatcgtgccactgcactttagcctgggtgacagagcaagactccatctcagaaaacagaaacaaaaacaaaaacaaacaaacaaacaaacaaaaacttaacccccagtgtggcagtactgagaggtggggcctttaagaggtgattggctcatggccctgcgccatgagtggattaatccatccatggactaatgggttatcacaggagtcggattggaagctttataagaggaaaagggacctgagctagcatgctcacccctctcagcactctacagagagtctccaccagcaagtaggcagatgcacccctttgaccttgtacttcccagcctccagaactataagaaataaattggttctttataaattacccactatcagatactctcttataagcaatggaaaatggattaagatacctgactatgaatatgtctggtttttttcttttttttttgaaacagggtctcactctgtaacttaggcctagagtacagtggacacaatcacagctcactgcagcctcaaaatcctgggctcaagggatcctcctatctcagcacccagagtagatggaactacaggcacacaccaccacagtggcctatttttttttttttttttttttttactttttgcagcaatagaggtcttgctatattgtctagactggtctgaaactcctgtcctcaagcaatcctcctgccttggccttctttaagcactgggattacaagtgtaagccaccatgcctggcccaaatacaagtctttatgaagaattttctcaacaggcttcagcagccttagattttttttatatacatatatacactgtgactgttaattctacttccaggagtttatcctcccacagaaataatcagatgtgcataatgctttatagacacaataatccctgatacacaattaaccagaagagaaaactggacacaacttaagagtccaaaaatatagcagtcattaaattgcagcacgtcacacaatgaagtattttgccaatattaaaaatgtttaagaaacttataaaattataggtgaattttatttcctttataggttatttttcctctgaaacttttttctgtttgtttttttgtttgtttttgtttttgtttttttgagacaggctctcactcttgcccaggctcaagagcagtggcatgatctcagctcactgtagcctcgacatcccaggcttaagtgatcttcccacctcagcctccaaagtagctgggaccacaagacatgcaccaccatgtctggctaatttttgtatttttttttgtagagatgggtgttgctgtgttgcccaggcttgtcttcaactcctggcctcaaggaatctgccctcattggcctctcagtgtgcttggtattataggcatgtgccaccatgtccagactaaaacattttctaattacaaaaattgtatgcatcataaagctttaaacttgcttttcaagacaaaagaagaaattttgaagaaacaaaccgctacaaaagcaaaaataatggtaggaaacgtgtagattaagagatacagtgtatgcaccttatttagatcttaatgcaaataaaatgtattttaaaaatgagataattgtggaaatttaaatactggctggatatttgattaagagtttattttattttattttattttttgagatagagttttgctcttgtcacccaggctggagtgcaatagcatgatcttggctcactgcaacctccgcctcccgggttcaagcgattctcgtgcctcagcctcccaagtagctgggactacaggcacctgccgccacacccggctaatttttgtatttttagtggagatggggtttctctatattggccaggcttgtctcaaactcctgacctccggtgttctgcgccgcggcctcccaaagtgctgggattacaacgtgagccaccgtgccctaagagttaatttttttaaaaaaacatgaaataatgatattttagttccacttttaacaagagttataccttacagattaacacacacacccctcccaataagactggtagacatttcaccatgagtatttgaggagaaagtggggatggacctgagaaagaagacagtaaaagtgtttcccaatgagaaataaaaaaattcggccaggcgtggtggttcatgcctgtaatcccagcactttgggaggctgagtgtgggcggatcatttgaggtcaggagttcgagaccagcctggtcaacacggtgaaacgctgtctctactaaaaatacaaaaaaattagccatgcgtggtggcacatgcctgtaatcccagctactcgggaggctgaaacaggagaatcatttaaacccaggaggcggaggttgcagtgagccgagatcgtgccactgcactgcagcctgggtgacagagtgagactccacctcaaaaaaaaaataataataataattctaagcctttcaactgactgaatggatcctctctttgccaaggggactccagagaaaccttgaaagctgagttcacagccatgataagataggagatcaaacacacctcattatacctactctctcgctaacagtacttaggttttcttccataaggactaaacagaaaccagtctttgcaaaagactactagctcaacttcccaggcacagaacaaggacaagatgaaactaatcattccttcatccctccccaagactcagccttttctatttcctatttctccaaatcttcaccttatcttacgtaaaatgttgatttcctgggcactaactaaagtcttacaagtatgtaatcatttgcctcactgctgcccccaaccccttttttttaaggaaaatgtaataaatactaaatcttttaagaacctccttggaaaaaccagccactgattctatgactcgtgtttttcccctgtgcatcctcaagctggctcaataaaccttggtggtttgagacttagtgcctcagtcactcattttggttgtaattttggtaaccatgaagggattacggagaagagattagctcctttgacctgcagcaattctccttccaacaagagattccctctgactatgcaaattgcaaaggttcagaagcttgctctctctcctgaggttccctgatctcctgaaatttttggtttgagattcaaggtttattttgccaggaaactcctctagaaaaggagtttgctcacttccaataacgaaggtgagtttgctgcttccatgccaacaaagagcagtcttcagcttgggctccatctccaggcaaggaagtggtttgggatttcatttggggatttggtagttgaaggtcaaggtttactgacaactggctataacttctcctttatactcagaggtcccagcaatatgtaaattttgctattgctttttctgttttttttgtttcagtccatcttctgttagatttgaccaattcttaccacatctccatgttgattaaaacccctgcagctgcagaaaatcaagtttcaaccctaggaacactggctggttaagataaatcaatattttaccctcccaaaaaatttttaaaattattttacccccccaaaaattatatatatatatatatatatatatatatatatatatatatatatatatatatatatattttttttttttttttgagacagactcttctcaaagagaagaggctacagttgtccaggccagagtccagtggtgcatctcagctcacttcagccttgacttcccaggctcaggtggttctcccacatcaacctccccagtagtttggactacaggtgcatgccaccatgtcaggctaattttttgtatttgtggtagaaatggggtttcactatgttgcccaggctggccaaaatatatatctttgacatattttaaagtagccctgccagactttctctagcctgaatctaggaaaggttagctaaggtcttcattctgaaggttcccttgtacacatgttaaataaatgtgcatgcctttcctactcatcatctgcttcacaccagtgatttttttcagtgaacctttagggggccaagggcctatgactcctgcagtgtggcacagcaagcagagtggacaaagccattcttctcttctggaacccacagtgaagagaacccaggaacctgatctgccagccaagaactaggaatttctcaccagccaggctctctgtggactccagctgggtggatggtaaaaatcactgtctcatctccaaggttctttttttgttttgtttttgtttttgtttttgttttagataggatctcacttcatcacccaggctggagtgcagtggcacaaacacagctcactgcagccccgacctccagggctcaagtgatccttccacctcagcacccccaagttgctgggactgcagacatgcaccaccatgcctaggtaacatttttagtattttttgtagagatggagttttgacatgttgccaagcctgatctcaaactcctgggctcaagtgattctcctgcctcagcctcccaaagtgctgggattgcaggtgtgaaccaccatgtccaacctcatctgcaaagttttgattatgggaaaaaaggatttgtgtaactagtcttgcactgtggtgactctgctgtaactctggtattttgtgttatgagtattcacatcatttgatcccttttcctctaatatccttttttgttgccactttgcttcttctttctgtgtccttctgtcagaatgaaactgacccaattattccacagaactttacagttcaccatctcatagatgtttacagtttcttttgaagaaacatagaaatttacctttccaatcttgaaacttgagaaagttacattcatcttatctgagttcctttctcaagaaatcagccatcaggtctcccagatagaatcaaagaattgaaactcatcggatcaccacacctgaataatgaaatgtcatacctctctccctttatgattgactgacccaccacctgctgcctgttgaccaaggtccctttcctaccccttcctaattcctgttttcctgcatgttgttacatttctgctgtataaactcctatctttagtgagtgaggagacagatttgagactgatctcccatctcctctgctgcagcacccaattaaagcctagcaatactggctgtctcagtgagcagctttctgtgcagtgagaagcgggacctagcctaaacctctagggtttcagtaacaataaaagggggtaccatagggtagaatacgagcctagaactcttgtaagcccctgtaagcctgctgtgaaaacggcactgcagcctggtcagtcttttgtggttctgaccggaccaatgtctgttaagacaaactttactgtgggtccctgaaacaaaaaccagatgaagtttcccactcttcctgtttcgtgtccttgagagcttcactttgtgactaaggggggatactcttagtctctgccatccagaaaatgtgatttttcgggtcctcatctgattttctgagggtccaagacacataatattttaaaaagctcacttttcactctgaacgtatcaggctcttatgggagttttgtcttaaaaggtcccattcctacagggcttttgtcatcttttgctatcttttttttattttttatgttttatttttatttttttttgagacggagttttgctctcgttgctcaggctggagtgcaatggcgtgacctcggctcaccacaaccaccacctcccaggttcaagtgatacccctcctcagcctcccgagtagctgggattacaggcatgtgccaccatgcccagctaattttgtagtttattagagacggggtttctccatgttggtcagtctggtctcaaactcctgacctcaggtgacccgcccacctcagcctcccagagtgctgggattacaggcgtgagccaccgtgcctggccatcttttggtatcttaagtctatttataagagtgaattttgggggatcatgaagatgcctcctctataccctttttaggaatatcttttgcttacatggtaaaaaacgtggaaaattcccacctaggcttgaaagaagcttttggattgtgtcactattggaactaaataaaccactgaaaataaaaaaatgttagagatatcttattccaagcaatgtcaggaaggtactccatatggtctaaaaaggggaggcatgaataatttgccccttgtttagcatataatcaagaaataaccataaaaatgggtaaccagcagccttcagggctgttctgtctatggagtagccattcttgattcctttcctttcttaataaacatgctttcactttatagactcacccctaattctttcttgcacgagatccaagaatcctttctcagggtctggatgaggacccctttccagtaacattgctgcaaaaccaaaagacagttcaggaggtcttatcaaatctgctgtctcaacttctcctcaagagtcttacagatgctagtaaacacattaggctaattaacaagaaaatggtgaaggcatccaggatcatggtggctcacatttgtaatcccagcactatgggaggccgaggcaggcagatcacttatggttaggagtttgagacctgcctgggcaacatagtgaaaccctgtgtctactaaaaatacaaaaaattagctgggtgtggtggtgcacacttgtaatcacagctactcaggaggctggggcacaagaattccttgagcccaggagatgaaggttgcagcaagccaagatcacaccactgcactccagcttgagcaacagagtgagactctgtctccaaaaaaaaaaaaaaaaaatggtgagggcaaaagggggagtcaaaggactcatcccaaaaaggtggggatttttaagcagttatttacaaagtaaggtaaaacttaaaaatcattgatgggttgaaactaagagaaaaaagaaagggcaaatcatggaacccatcacagcagggtggaaatctttagatggttattaagaaatgaaacgaaggctaggcacggtggctcaccgctataatcccaacacatttggaggccgaggcaggtggatcaactcaggtcaggagtgtgagaccagccttgacaaacatggagaaaccccatctctactaaaaatgcaaaattagccaggtgtggtggtgcatgcctgtaatcctagctactcgggaggctgaggcagaagacttgcttgaacccaggaggtagaggctgcagtgagctgagattgcgccactgcactccagcctgggcaacaagagcaaaactgcatctcataaaaaaaaaaaaaattagctgggtgtggtggtgggcacttgtaatcccagctactcgggaggctgaggcagagaattacttgaacctgggaggtggaggttgcagtgagccaagatcacatggcactccagcctaggtgacaaagtgagattccacctcaaaattaaaaaaaaaaaaaaaaagaaagaaagaaagaaatgaaatgaataaaatggaaattggcactaaaataaaggtcttaatacaacactattgaaagttgggtgtttgtatgagggttttaagaaaaaaaaaagaaagttgggaaaccaaagagagccccagctggtcctctaacatttgtcctccaagggccccaaatcagtgccatatttaccctagattggagagatttatgaaaaaatatgagggcagagattacaatgagagagctgaagaattgcctgcgacaatgttcatcaagataagattgatgaaaggagccagggttccttggttcagcacccctgctggggactcaaagcctttttcaccaggaagggtaaaatggtctgggattggacaagaaaaggtgcctgggaccagaacataaagatgcaagggttgatagaattaagaaagttggaatgtttcaacaggttttatgtctgtgaaaggaaaataaaatcttgggaccccaaactcactaagccaaagggaaatgtcaagcttgggaactgagtcacacaaaactgcctatttttgttcctacaaagataaaagcccacatccctccccaggggtgctctctcacaatttgcccacaaggaaattccttgcaggccctaagatccttaccctaaagcagttctgttgaatttctccctgacaatgtaagttaatagcttatcttagcaagtaggggacaaagacaggaccagaagtcatccctccacctacctgagacaaatgcatattaatgcagattcactgagcctgagatgaatgcataattgactatttatctacccacagtaacatgtggattcaaagaatgttgattaaagctgcaaaagaatgtaaccacttgcctcttttcacacccctccttcactttttttcttctcttgtctttccctactgcctgcctgctctttcccttcatctttgttttctttttttgaaatggagtctcgttctatcacccaggctggagtgcaatggtgcaatcttggctcactgcaacctctgcctcccgggctcaagcgattcttgtgcctcagccttccaagtagctgggattacaggcatgcaccaccatgcccaactaatttttgtatttttagtagacacagggttttgcaatgttagtcgggctggtcctcaagtcctgacctcaagtgatcgcccacctccgcctcccaaagtgctgggacaacaggcatgagctgccactcccggcctcccctttaaatcatgaaggtctcaaaccttctttggaaaaataatggatcacagatgctcctgtggttttgtgttcctttttcctgggcatgtcctcaaccttggcaaaataaacctctaaattgattgagacctgtctcagatactttttggtttacaatgtaaagtagttgtatctcctttacctaaatgacttttaaaatagttattgtatcagactggggaaatgtttcccctacctagcatcataaagcagaaggcatgtaaatctgcccttccggcaatgttaattagacatgctaaatgagacccagtaagactgcctgagcccacagggtgtgtggatgctgatagggacaaattctccacttcatagccctttgtggagcagttacggtctgtatgagtcagttctcatgctgctataaataaataaccaagactgagtgatttatagtgaaaggaagtttaatggactcacagttctgcatggctggggaggcctcaggaaagttacaatcatggctgaaggtgaagcagaagcaggcaccctcttcacaaggtagtaacgtgtactcccctggagtgtattttaaagcactgggactccttcgaccctgaaattttgaagaaaagtggcttattttcttttgcacaagggcttggcctttttactagacctttgcaggtgttgcaaaatcaaccaagctcttttagcaatcatatcaggcaggcccaaagagaataattccccaaaattagtaaaccaagttccaggggaaccatctgaggattcccttatttggggccccttcaacaccccttctcactgcagaaccttagacaagtaaaatgagacttaggccaattttctgatgaccctgatagatatatagaagctttccaaaatttaactcaggtatttgacctctcatggaggaatgttgtgcctctcctaagccaaactctaactgcagctaaaacaggcagctctgaatgcagaagaaaattttggagatgagcaatatgtctcctatagtagggccaaaagggaaaagagaaaatagggaaggcaaagaaataggggaaacaccattcccaataggaaaagaggcaaaacctcttgacaaccctaattggaactcctttctgtggtgtttttccttctttcatggtttaaaacggcttctatctcttttataatgttcttccaacctgggaaaagttaattttccaaaccttaaaatgcttggcttagagttgagctagggggaagggaacccagaagcctgatatgccggcaaaagggtaaaaatttcttacggatcgggctttcagcttttctctccctgtgcaaacaagtaaaagggttaataagaaccattgtgtatattctctgtaaatgtataattaatgaaaaaggatttgtgaggttgctcttaagctgtagacaatctggtgtgctttgcatgtctttctgtatggttctgtcaaagaaagggtatctcaggttaggatgcaggcccaggaacccataagcctgctgttcaagccaacccaacagaacagtcagtaacaaacttgcctgcaggcctccatcttgtttcatgtccttggcaacatgacctgtaaccaagtggcaatactttgttttagtctccatcattttacaatggtgtctgtcttcttgtgctgttgagggaagtcagggaccccaaacggagggaccggctgaagccatggcagaagaacgtggattgtgacgattttatggacatgtattagttccccaaattaatacttttgtaatttcttatgcctgtctttactgcaatctctaaacataaattgtaaagatttcatggacacttagcacttccccagtcaatacccttgtgatttcctatgcctgtctttactttaatcttttaatcctgtcagccaagaaggatgtatatcgtctcaggaccctgtaataattgcgttaagtacacaaattgtacagcatgtgtgtttgagcaatatgaaatgtgggcaccctgaaaaaagaacaggataacagcaattgttcagggaacaagagagataaccttaaactctgaccgctggtgagccaggcagaacagagccatatttctcttccttcaaaagcaaatgggagaaatatcgctgaattctttttctcagcatgggatatccctgagaaagagaatgcgcacctaggggtaggtctctgaactggcccccccggggcgtactgtctcttatggtcgaggttgcagaggtgaaataaactccagtctcccatagcgctcccagacttattaggaagaggaaattcccgcctaaaaaactttggtcagaccggttgatctcaaaaccctgtctcctgataagatgttatcaatgacaatggtgccggaaacttcattagcaattttaatttcgtttccatcctgtggtcctgtgatctcgccctgcctccaattgccttgtgatattctattaccctgttaagtacttgatgtctgtcacccacacctattcgcacactccctccccttttgaaaatccctaataaaaacttgctggtttctgtggcttgtggggcatcacggatcctaccaacgtgtgatgtctcccccggacgcccagctttaaaatttctctcttttgtactctgtccctttatttctcaagccatccgatgcttaggaacatagaaaagaacctacatgactatcggggcaggtcccccgatattgtgctaactcaattcctgggtgagggccacaaaatcagataagccagtttgtcaatctgggtggtgccccctgatccatcaagggcaggatttacaaaatatcttaagcactaatcttgagtgcagttttaggagggtcaaaatcttgtagcctccagatgcatgactcctaaaccatggtttctaatcttatagctagtttcttggtctggtccccaggcaagagggaagtatatcttaagaaggagctgttctttgggaggccgaggtgggcggatcacgaggtcaggagatcgagaccatcctggctaacacgatgaaaccccatctctactaaaaatacaaaaagtagctggttgttgtggccagcacctgtagtcccagctactcaggaggctgaggcaggagaatggcgttgaacccgggaggcagagcttgctgtgagccgagatcacgccactgcactccagcctgggtgacagagtgagactccaaagaaaagaaaaggagctgttatcatctttgttttagactatagattataaaccaggctgctcccaaagttggttcggactacccccagggatgggcaagaacagcttggggctggaaaacaaatgcagctgtttgggtcagatctctttcgctgtctcagtcacaattttgcagtaacagtttcaaaagctgcctatcacccctttgaaaataccttgtacattcaaggttaagtcataacctaattaagccataaacctaattaagacttgtcagtttcacctgtgaggtttcaaaagctgaacatcttaactgcttcctgtggctaaagtcgagtcacaagggatttaaaaggatttttcttaatgagtgctcagcttaattaaaagtggatattcaagttataaatatatttaaaaggcctttatgttttttgcttcttggattttgtttttctggtaaaaggcttttttcttctcagtcgactgaattatttttctccattttttgtcttaccactcttactgcttgctgcctggcactgttcctccaagggctccaccctgacgccagtaatccaattaagaaactggcaaatgaaaaatcttacaagtgctgaatcttctgtctgttcgtgttgctctatacatgttgtgtgtaaggtctattaaaagagctctaattgactggcttaaagaaaaacaagtgcttaaatcaaatattttttagttcacataactttaagaaataaaaatagtcttaaggattattggtaaaatgcaagtgttgtcaaaatacaaataggtggtctaaatcattcagcttagatactaggtttgctaaatgttccaaggctgtgtatactgcccgcttttcagataggtaaggcttgggacacatggacctagatgctgaaacgtcagactttatctgcacttctgtctgagtcctaggatccacatctggtacataattaaaatagattactaaccaggtttttcaccaaaaataaaagttgctaaaagttcaacagtgaacattaactaaacttaaaagtgtattatatgatcttttcataaattgagcattgaaataaaagcacagcaaagaggtcttacgacactaatctgtcctttagtaaaagggttatgaaaggtttgtaaagatttcacctcatggtcaaattggttaaggttagatggaatgatctataaggtttaatttaaacaaattggggttaatattaataaactaatgcaagggtaaaatttgggtttgaacaggattttcatgtcatagtaaaggccaacgaacagtttttgccttttaagtcaccattttggcaaaagaaataatgtatggcaatctggaattccatttcataacatcaagtgttttaaaccttgaacatttaacaggcatcctaaaatcagacttcaagtttcaaaattgtcgttcctgatgcctggctttttgatggttcagagggcccctgaaacattcagaaaagagataaacaggattatctgacatatttaatcacatgagattgccaaaatgatgtccaatcttaagttatactttgctaaataatactaatatattctggccgggcacagtggctcaagcctataatcctagtgctttgggaggctgaggcaggtggatcacctgaggtcaggagttcaagaccagcctggccaacatggtgaaactccatctcaactaaaaatacaaaaaaattagccaggtgtggtggcaggtgcctgtaatcccagctactttgggaggctgaggcaggaaaatcacttgaacccagaaggcagagtttgcaatgagccaagatcatgccactgcactccagcctgagcaacaagagcaaaactccatttcataaaaataattttaaaaaatactattatatgttccaaaattacatatgatttctaaaattctgatgtctaagtatatgctatcaatcataattaagggtaaagttattgtaaaccactgaaatgaataaatttgttaatcatgttgttaactataaatatcctggaaatcttgtcattcacagacaattgttatcttgctttgttccttctcaaaagatggtttataatcaagctatattaaagaatttaacaggcattctcaaatacaggtttttagtagctttgaagattgtaacattggaatagagaatgtatgggactcataatgagcttacatgttcacaaatatcaagcaaaacaagatttaactagacggacagcactcagaaggttaaagcaactttttgactcttgcttggaatattgctgatccttgttttatttttcagagtgaaggaaacttactttgaactatttatggcctttaataattgagtaaggtatactactgtaaacaaaatttggagtgtgtttgtttttctctgcctggttcctctagaatttggaaactatctgtgagtactcttaacttatggcaatatttgcatcagtgcaataagaatccatttttctttgtcaacaggacacaattgaaaaaactggttattttaccaaggctttgactgaaagggtgtgtttccctttaaggaatgaagcttgacatgcagacccaataaaagccccttaaggagaactggcctcataccttgtctacacagttcctgcacaaggttcctaaattgtggtcagtaaagaatgtcattttctaacaggtccagcagctccaagtttatcttagaccctcaagaggagaggattacccaactcacaggtatttgaggatacaaacccatggctgggctcagctttaaagatcttatctgaaattccttgtggaacagagtttcatcaaagccaatccaaaggcctacatagaaacaaccattcttgctgcactttatgcaaataatcaggccaagtataagactaaagtttattctacgaacaacccacacagtcctatcataatttgtttttaccaaaaatgaggactggagagagaaattgttctccaaagcttatcatacatttgtcattaaatcctagtctcattaattgtttttaagcttttcgcctacattttagactaaccctgcttattcctgtgaatcaagtggtgatctcctgcagcttggaagaatcaaagggggatggttaacataaaaacctggatcaatatgctagttctggacaattctcctgcaaattctgccaggtaatgaaagtgagtagggtgcccataacccagaggtttctttgtttgggaaaataaaaccaaggaacttcatagacctccccaaaaggaaattctatatcttaggttaacacctctagtaaagtagaggaaaattgttagatatgagttctaaatttctcttcaaagaatcaatatgtcagtatgttcaattctttgccttctacttataaacttaacttcctcataaagcaacctttttccattacctgctccacccggactcattctgattacctgcttctccctgactcattctccaccctgactcattccgatttctcactctgccataaccatttttcctgccaaaccgctcaccccgtcactctctttaaattagccaattggaattagtttagtttgtgcgatctaaccctagccaatagggaaatgacacagcatcaggggccacgtgcatcagggataaggaccccttcccctcctttgtccaagtgtgcgctcaccatcgctccatctgtcagggcgcacccttttatagaagaacatggccttgcagagaattaaaaagaaaattttatatttgagtgctatttcttttgcggcaccgaaactttataacaatttcagggctcacccttgattacatttcccccaggggcggtctccggttctctctcctgaggaggcgcaccccgcccccttgtggtggcctcaggggtgagaaatcaggaccacccagtgcgaggaataaccggagctctctgcaacgctgaaagaaactggccagcaacctagcttaaaggatcctcacatctgcggcgatgactctgtgcacagaccaaggaaggagaagccgccggagccagtaaagtactcccttggtggtcaaattccggagggctaaatgtgtgtgtgcatgaatgatcacaaataaccctacctgcggtgttgttcatgtggatggtgacaagacctactgctggacagagtgagtgggacctctccgcagttccgtagctacctcatatggcttagggcggatcctgccgtgggatttatactggcacaccgacactaagaggggcctaattctcccttgggggagcagccagagagggcaacacaagtgggaagtgtgcaagggaccttgagagggggaaagggaggaaacaggtcaacctcccagagcagcaaggtaagacatccctgatttaagggattgagccttccagggcaggcaaagcgagacacccctggtttgaggggttgagtcttctgcaagtttcatgaacctcacacaaacctccagtagcaagaaaaatattcaggactccccttgcctttcttctcaggggaagaaagagtaactccactcctgccggtccctcccctagggaaaggggaaggagaggggagaacagcggcataagcggctggcagaggcagagaaagagagagtcaaagagagagacagagagagagagagagaaagagaggcagagagagagagaaagagaggcagagagagagagaaagaggcagagagagagagagagaaagagacagagagacaaaaagggagtcaaagagagagaaattgagagacagagtcagagagagagagagaagtagtaaagagaaaacagtgtaacctattcctttaaaagccagggtaaatttaaaacctgtaattaatgattgaaggtcttctccatgaccctataacactccaataccaccttgttgccagtgttaacaagggcatagcccaaaagcactgaggccactgacaacccgtagccttcctatcaaaaatccttaacccagtaacccacggatggcccatatgcattcaatctgtagtggcaactgctttgctaacagaagaaagtagaaaaataacttttaaaggaaacctcattgtgagcacacctcaccagttcagaactacctaagtcaaaaaagcataaaggtagcttactaactcaaaaatcttaaagttttgagattttagtaagttagtaagttttgtgatttttggggctattctattagaaaaagatgatttaacactagccactgaaaattcccttaacccagcaggtttcctaacaggggatctaaatcttaattaccatagaaagttcagatcacacctaggaggaactcccttcaggacaggatgatagatggttcctcccaggtgactgagggaaaaagacacgatggatattcagtaagtgataaggaaactcttgtagaagcagagttaggaaaattgcccagtagttggtctgctcaaacgtgggagctgtttgcactcagccaagccttaaagtacttacagaatcaggaaggagccatctatacaaattctaagttaacagggactgaacgaggtcttattaatagcaaagaataattgaaatcccaaacatacaaggttttcaacaaaagcaaagtttgctaaaagttaacagtgtaacatgtattatcctaacttctaatcttgtggccttagacacagacatgaagttcacttgggaaaagaatggttatcatatttgagaaaaaaaaggggggggggtagaatttatgtaaaaaggaatgttatggtaaattcttaaagtaaattaactggttgtttaaagaaagggatgttggcaacaagttagaaagttgaggcatgttgaagaattgtctgtgaaagtcgtgaaaaaatgttataaaagggaatttatgcaagaaatgtataatttaaaagtaattaggcctcctgaatgtaaaactattgaagaaagagtttgtgtgcaaggtatgtaaggaaagtagaatatacttttggtaaaaggattacaaggaggcataagaatgtggatttttacctacattaaaaggttaaaaaaatacattttgttttaaaggtttaagcaagttttgaaatgttaattgtaaaggaaattctgtgtgtaatcatactggctgaagttaaaggggtatcatccagtttttctgtgaactggacattaaaataaaagcacaacaggtttttcttaaagcactaacctgctctttaacaaaaattataaaaaggttaaaaagagtctgtaaaaatcttacattatgatcagacattaaaaattggataaatatgtctacaaggttttactaaaattaagtttaacattaataacacactaatataaagatgaaatttagcttatctggtataaaaatcatacaggaagcattgtcaaatacaaaatggtgtttggccttctttggtctaaaaactaataaaaataggtgccaaagaaaatttctcaacaagaaagcatgaaggactataaagtccactgttgatatccccacgtttaaaacaaaagatcaatttcttagaaattatatactcggtttatcctccaccttctcttcccttaaaacagaggtcttttagcacaggtgctgcctttggactttccagtgcctcagcatcagcctggggatcacgttctcatcaaagaggggaaagaagggaaactcgagccagcccgggaaggaccctaccttgtgctgctaaccactgagactgctgttcgtaaggttggaaagagatggacacatcacacatgagtcaagcaagcaccattatcctcagaatcatgggccattgttcctggatcaagccctaccaaattaaagctaaggaaagcttagtctatctatcttttcctttcccttccttacccagtgcttatatccattactattcctaccactagcaactctaaccccactttagaacgcttctgtggtttaggagcagaggtcactggaaaggatcctatgggcttctttaaggtgggctttgttctccctcctccacctcctatggctgcccctttcccaaacctacaaaatcaaactatgactcacctcatgccaaatgacaaaagcaaggtcccggtagtagaaataggagacctaaggcaaaccatagccattaaaacagggtataaaaatgtaaatgcctggttaaaattgattaaatattctgtccacacgttaaacaaaggcaatttttatgcttgtgcacatgacaggccagaagcccagattgtcccctttccactagggtggccctctagttgactgggcatggcctgcatggcagatctttcccaggattattcagcctggggtaacaagtcgtgccaagctctctctctgctacatcccgaagttcaacaccctgcgggtcagcccccaagggccatccagcttccatctcccaacactaagttcacttcgtgtctctcaggaccgggaggaaacttagcgttccttggagtcctgaagggatgcagtgagattaagaaatttcaagagcttaccaattagcccttactcatccctgagcagatgtgtagtggtattatgatggacctttactggacactctgccgagtaactgaagtggcacttgctttagtccagttggctatccctttcacgctggcatttcatcaaccagagaaaggaaaaataagatatcataaagcaaaagaagccccttatgggtcttttgactctcacatctatttagacataattacagtcccacagggaataccagatcaatttaaagcctgaaatcaaatagctgcaggatttgagtcaatattttggtgggtgacaataaaatgtaaattggataaactacatctattacaaccaacagccatccattaactacactagagatgctgttaaaggaatagctgagcaattaggggctactagccagatggcttgggaaaaataggatagccttagacatgatattagcagaaaaaggaagaatttgcatcataattaaaaatcaatgttgtaacttcatcccaaacaacaccgcccctaatggaagtataacaaaggcattgcaaggtctgactgctctatcctgagttagccaataactcgggggtaaatgacccctttacaggatggctggaaaagtggttcagtaaatggaaaagaatagtagccccaattcttacttccatcgcagccatcataggtgtgcttattcttgtcgggtgttgtgtcacactaaggaaggagaccgctacaactcctgctgccctcctcccaccaccttgcctagttcacaagacaggaggaaagagagaaagcaaaaagctggaaagaagcaaaagtaagataaatagccagacaaccttggcaccaccacctggccctaggagttaaaaaggtaataataataacatcaaccccagacctaaactacttgtgttatctgtaaattccagacattgtatgaaaaagcattgcaaaactttctgttctgttagctgatgcatgtagcctccagtcacgttccccacgcttgctggatttatcacgaccttttcatgtggacccctttagagttgtaagcctttaaaaaggccaagaattcagtttgcagggagctcagctcttaagatgcaagtctgccgatgctctcagccaagtaaacctcttccttctttaatccagtgtctgaggagttttgtctgcgttggtgcagaggtttataaaaacggcacttactaaaacctcccttaactatcctccaccttatccagagaagcttcttcttttggaaaatcaagcagaacaactaagccaagacatgttaaagaagtttgaagggaaagagctgtaaggaaatgcaagaggagagattgttagatatgagttctaaatttctcttcaaagaatcaatatgtcagtatgttccattctttgccttttacttgtaaacttcctcgtaacgcaaacattttcgattacctgctccatcctgactcattccgattacctgctctgccctgaattctgatttcctgctctgccataacaatttttcccgccaaatcactcaccctgtcactctctttaaattaaccaattggcattagtttagcctgtgcggtctaaccctaaccaataggggaacaacacagcagcagaggccacgtgcatcagggataagaaccccttctcccttgtccaagtgtgcgctcgccattgctccatctataagggcgcacccttctatagaagtacattgccttgctgagaattaaaaagaaaattttatattcgagtgctatgtcttttgcggcaccgaaactttatttataacaaaatctacaagggcttaacgataaagtcaaaattactgacaagctcagggaaaatgcagacttcagccccaggtggctacaatccctctttaatgaattccagtcttctttatggaattggttaacccctttaataagcaccctcttgctgttatgtcttgtattaataattggaccctgtatactcaatactataacttgaattgtttcctctcacctagaagcgatcaaactccaaatggtcccgcaaactgagccactcatggacaggcctttcttctgaggacctttaggttgaccccacaaggagccctcgctgctgttccccattcaacgccccttttcagcaggaagcagccagaaagagtcatcagccaaaacctcctaacagcagttagggtgacatctccacaggggggaatgttataggagttattaagaaattattttaggcagatagagaggaaaaggggtccttgggaagtttttgtttctttcttttaaagcagctgcataaatgtttcttgtctagcaggaaagcacaggctcttagagccaggccggcaacctttgatatgcaattgcaggccattagaaactgggtccacccaaacatggcgattcctgccctcttcttcttagtgcctcaatcactcattttggtcgttaccagaaaggaactcatatttagctggaatctatgccaggtaatgttacagagggtagtagtcagacatgaacagggcaggagaaggcccccacaccccaccaggaatgtcaggtgatggtccagcagttgtcccactgcctctctaaaataataactggtctgagccagcaccagggaaagacagtttcccaacagattaaaaaaacacctgaaactggtgattggcagcttcccgataagatctcaggaattgggtgagtgggctcaatcatgtgcattaagaggcaaaatagcagagtttaactggcatatgaccttccaggtacattccaccagaaaagggaagaacacctacctcaggtgagcatgcatacaactctagcaaacacactgcgcatgctcacctcccgagcctagcaggccaccgcgcatgcacgcagatcaccctcgccctaagggaagaatgaggggaagaggcaccagatgttggaagtatgccagcacctaaatccctaaatccaaggtcaagtggggcacttgtccttcaacttgcccagctgggcctcctccaagtgtactttcctttctttcattcccgttctaaagctttttaataatctttagcttctgctctgatacttgccttggtctcttattctgccttatgcccctcagtcaaattcttctgaggaggcaagaattcagggagggagggaaggagggaggaaagtgaaggcagggagggagggagggagggaggagggagggaggatggaaggaaggaagggaggaagggagggagggagggagggggcaagtgaagggaggaagggaggaaagtgaagggaggaaggaaggaaggaaggagaagggaagaaggaaaggaaggaaggaaggatacatccttgaataaggatcaatgaggaccaaagccccaaaatgacaaatgtcccataggacagggtggggtagcatttctaatgtgatgctagcctgcgttccatcaaaaatgggtttactggccgggtgcagtggctcacacctgtaatcccagcactttgggaggccgaggcaggtggatcacttgaggtcaggagttcgacaccaacctggccaacatgttgaaaccccaactctcctaaaaatacaaaacattagctgggtgtggtggtaggcgcctgtaatcccagctactcgggaggctgaaacaggagaatcacctgaacccacgaggcagaggttgcagtgagttgagatagtgccattgcacttcagcctgggcaacaagagtgaaactctgtctcaaaaaaaaaaaaaaaaagtttacaaatcccatcgtaacctgaaggcaattgctttgagatctgttcacaagagccatagatttatcatgtaacttaacttcatttggtacaaactttgttttttttttggagttggccccatttgggaaaatcagaatgtagatctggaatttaaatattgcctacaaagctaaacagacaaaatgcagttgttgcttacctgaaacaaatgtttgcggcatctaaggactgataggctgggacagaattaagatagtgttaggaaagggtcccctaaggttgggtcgagttgccctttcataggaagaagagaggcctgggaaaactttctaaccaggaaggtagacattaatgtccatagttaacattagtcaatgattatttactaggtatgctctttttagagacgtttatgtacactctcgtttagtcttagtacagctcataatgagctggtactattataaccctcattttacagaggaggaaacagccttcacatgtgtacagaaatcagtgaagcctgcctatcacccatacttgctgggttcaacatgaacggcacaggcaaggagaaagccctgtgaccagcggtaccagaaagagtgaaagggcgccatctagtgactgtcatggtggttggcagtagaggttggaagccggtggttttttttcgtgggttttttttgctgttgttttggggttgtttttctgtgtgagacagagttttgctcttgttgcccaggctggagcgcaactgcggactaccaatttcagttgtttctatctactgggaaacggccgctccctggtgccagctgcaaccaattatcattttagcgaggcaggatgacaacctccggcccatcacgtgatggtcgcctgacatttctggtgtgtggggggagctgtctcctgccctgctcatgccccactagctacctactgtaacattctcgggtatctggaatacagtactaagcatcttaaaaaaaacttcactggcggccgggcacagtggctcatgcctgtaatcccaacactttgggagaccaaggcagacggatcacgaggtgaggagttagagaccagcctggccaacatggtgaaaaccccatctctactaaaagtaccaaaatgagccggccatggtggcgtgcgcctgtagtcccagctactcaggaggctgaggcaggagaatcacttgaacctgggaggcagaggttgcagtgagccgagattgcaccattgcactccagcctgggcaactaacagtgaaactctgactcaaaaaaaaacaaaaaacaaaaaacaaccccccccccccccccacacacacacacacacacacacgcagaggcaaaatggcggggggtaaccttctagggggtcattccaccggaaacgggaagaacgactcaggtgagcatgcctgcagctccagtaaacacacgtaactccggtaaacatgcttgcctcccaagcacaatcaggtcactgcgcatgcgggtggctcaccctaagggaagaatgaagggaaaggggtgcaagacgccggaagcagggcagcatgtaaaatcctaggtccaaggtcaaacggagcacttgacctccaaggtgcccccttaagcctcttccaagtgtactttcctttctttcattcctgctctaaatctttttcatcaatttccactccgctgtaaaacttgcctcggtctcttttcctgccttatgacaatctatttttttcttctgaggaaggaagagttgaggctgctgcagacctgtacagattcgctgccggtctctcagataacttccactactagcaagaaagcaaacacaccacatcaatgaaccaccaccatgtagcttaagagctgtaaactttcacttttacttttttttttttttttttttgagatggagtctccctctgtcacccaggctggagtgcaattgtgcaatcttggctcactgcaacctccacctccggggttcaagcagttctcctgcctcaccctcctgagtagctgggatgacaggcatgtgccaccacacctggccaactttttgtagagatggggctttgccatgttggccaggctgatctcaaacgcccagcctcaagtgatccacccacctcagcctcccaaagtgctgggattacaggcatgagccaccgtgcctggccaattcttcactttttcaagtaaatatatgcacactgattaaaaacccaaatgaacgaaagctagatacagtgggaagtcagcctccacatcccccagctacccagtcctccccagaagcaactgctgttaccagcttcccatgtccccttccagagacagtctaagtaagcaaatactttgatacaaataatagcataccacggtagccggaataaagcctcctcaccaaggtgtccgtgtcctaatgcctgggatcagtaaatatgtgatacggcaatagggacggggcagctgattcaagttaaaggccttgagaaggcagattatccaggtgggccctatgtaatcaaacaaatccttaaagctgagaaccttcccaggctgtagtcagaagaagatgtgactttggggttagagagacgcaaagttgctggtactgaagatggaggaagccacgtaatgcaggtgacaaaaacactgattctctccttagccccctggaaaggcgtgcagccctgctggcgccttgatcccaggcaggtgaggcctgtgtcagacttcctaccccaaaatcagaaggtaataagtttgtgtcttaagcccctaaatttgagaacatttgctacagcaacaatagaaaactaataaatacactagtacccttttctttccttctttcttcctttcctttttttttttttttttgacggagactcactctgtcacccaggctggagtgcagtgacgtgatctcggctcactgcaatctctgcctcccctgttcaacctgttcaagcaattctcctgcctcagactcccaagtagctaggattacagatgcacagcaccacacctggattttttttttttttttttttttttttgtatttttagtagagacatggtttcaccacattggccaggctggtccggaactcctgacctcaagtgatccacccacctcagcctccactgcacccagcatcatcttcttcttctttttttttttttttcaagataaggtcttgctttgttgcccagactgagtgcagtggtgcaataatggcttacagcagccttaaactctgtggctcaagcgaccctcctgcctcagccccgggagtagctgggaccacagatatgcaccaccaccctcagctaatttttaaaaattttttgtagagatggggtctatgttgccaaggctggtcttaaacttctggccttaagcaatcctcccacctcaggctcccaaagttctaggattagaggcatgggccaccgtgtcccacctcctttcctcacttaatacattttgaagcctcttcccttttacaatatttagagctgcctcattctttttaatggctgcatagcatctcatcatatgagtatttaatcgttctattaaggatggtcacggggctatttgagacatataaataagttacaaataagtctgtaatgtcatacttcccaattattctcatctcatagcacacacaaatatattaatatttatataacacactgaagtgaattgaaggtactgaggtcatttaccttggaccttgatggaaaatgttactaataatactttctttttctttcttttttttttttaaatgagacaagttctcattctattgcccaggctggaatgcagtggcatgatcacggctcactgcagcttcagcctcccaagtacctgggaccattggtgcacaccaccacacctggctaattttttatttttagtagagacgaggtcttacatgttacccaggctggtctggaactcctaggctcaagcgatcttctcacctcagccttccaaagtgctgggattacaagcgtgagccaccatgactggcctatattctttatattatatagttttgttagttttttcagacaggctttctctctgtcaccaaggctggagtgcagtgaaatgatctcagctcactgcagcctccacctcctgggctcaagctatcctcctgcctcagcctcccaagtagctgggaccataggcaagcactaccacacttggctaatttttgtattcttttggtagagtcagggtttcaccatgttacccaggctggtctcaaactcctagactgaagcaatccacctgcctcggcctcccaaagtgctaggattacaagtgtaagccaccacacccgacatacagttattaaacacacaaacacacatacaggagaagatattgacattgaatttatataaaacttttttttaactgagggtcccactctgtcacccaggctggagtacagtggcgtgatcctagctcattgcaccctcaaactctagggctcaagggatcctcccacctcagcctctcaagtagctaggactacaggtgtgcaccaccacgcccatgtaattttattttatttttttagagttagagtctcttattactgcccagactggtctcaaactcctgggttcaagcaatcctcctacttcaacttcccaaagtgttgggattacaagcatgagctaccatacctggcctatacaaaacttctaagtctttaatttttttgaagaagttgattttttttatttataatatcaggctttatattatttaatattttaaatatcaggctttatgcctgaaatagctgattctcattattcaccacagttatgttctataaagtcattgcaaacactgaatctgttaatactaaattattgttcctagtggaaatacagggttaagttcctatgagcctctggccacatttttataaactgaaatgccacttgtggtacaggttcatttgccaacttccttgcataacaaaccagtttcattagcattgaaaacctgttcttccacaggactcttttaaaatatcactcagcaggtattttaaaaattcttccagatctgcagaacatgcctcacctgcaacttgatgtttttcactccatgtcaccttctgaaacacgcttgctgaccagcagtggctgagaagggtttaacaatgttctaatcctgtatcatgtgactggaagtttcttgggctttcagcttcacagtgctgtctgctatgtttggttggttttgttaaatgggtcgtcatctcaggaatccacaaatgtagccacttctccatagcttcatcacagattggcagtcttcttcctttttctggatggactgtattgttaactcattcatgctgagctcacagccaacagcactacaactcatgcctgaatcgaagcctatcaaaggcccatcccagccttcctgtgccaaggaatgctggacaacacttcagcattctgcatggggccattttgaacaggcacagtggctcacacctataatcccaacactttgggaagccaaggtgggcagatcacttgaggtcaggagtttgacaccagcctggccaacatggtgaaaccccatctctactaaaaatacaaaaattagctgggcgtagtggtgcgcacctgtaatcccagctactagggaagctgaggcaggagaattgcttgaaccccagagtgcagtggttgcagtgagccgagattgcaccactgcactccagcctgggtcacagagcaagactctgtcttaaccaaaaaaaaaaatcaccaccaagaggcacaaaaatgtgaaaaatgtggcactaagaccacaaaaaggacactgatttacaatatcagagcaaaacaagaaggcagggtgtccccttgtttgacttcatctgcgaacgtgcgtgttaggtgataaaaatttttgccactctgtgcgtacctgcaaacagctgcaaaagtgccaggagcactgattttggagttacgagtaaattttagtgagtagttgaattcacaaaatggagttcatgaataatgaggactctctagatgcaattcctgatcaagataactttttaaagatgatcgcttccttttttttttttttttttttttagtgttaccattgattagaaaatgtgtttgcaggccgggcatggtggctcacgcctgtaatcccagcactttgggaggctgaggcaggcagatcacaaggtcaggagatcgagaccatcctggctaacacggtgaaaccccgtctctactataaataacaaaaaattagccgagcatggcggcaggtgcctgtagtcccagctacttgggaggccgaggcaggagaatggcgtgaacccccgggaggcgaagcttgcagtgagccaagatcacgccactgcactccagcctgggtgacagaacgagactccatctcaaaaaaaaaaaaaaaaaaaaaagggaaatgtgtttgctcaagtaggtgggaacaaacaggagactgtttatccctattttttaaacattttctgttcttgccattaactagatttcagataatttaatctatttaattcatagttctaagcaatagtctagtctttaaatctaatagcttttcttttcattcacaaattgacattgtcctgtgatattgtcaatgaattctgagtccagtcaaacttttccatttcaaatcatcactaaccaaaagaagcagaatttcagctacaaatgcaatcacatgtcatttcaaattttgtagtagcacattgcagtaaaaaagaaacatgtgaaactaacattttaacatttaatttcacccaacacgaaatatcattggaaaatgatgtgtgttttgcagtatgatcagcgtgaaaaatattagtgaggtacttaacaattttctgtactaagtctttgaaagtttctgttgatggcaacatctcattcaggctggtaacattaacattaagtgctcactagccacaatgttactacctcattgaacagtatttcaaaaataacactcaagccattcctcaagtacacgtaaatattattctagtaactataattttttagaattaaatttatattaataatgctgactagtagctactagtaaaaaattcctaaactcacttttccaaagttaaatttttgctttaaaagcatacactttttcaatacacatttgtatctgtacatacatatgagatattttcacatgatccatgcagtattcttttctttctttccttctttcttttattttctttcttgttttttgtttctgtttttatttttttggagtcagggtctaactcccatagcccaggctggagtgcagtggtatgacatgatcttggctcactgcaacccccacctgccaggctcaagtgatcctcccacctcagcctcccaagtagctgggactataggcgtgcaccactgcacctggctaatttttgtctttttaaaagagatggagttttgccatgttgcccagactggtctggaactcctgggctcaagctatctgcctgcctcagcctctcaaagtgttgggattacagacatgagccactgtgcttggcaatattaattttaaaaaaattttttagagacatagtctcactctgtcacccaggctagaatgcagtagtgtgatgataggtcacttgcagcctcaagctcctgggctcaagggattctcctgcttcagcctcctaagtaggtaggactacaggtgcacaccaccacacctggctaatttttttaatgttttgtggagatggctaatttttaaaattttttgtgaagatggagtctcactgtgatgcccaggatggtctcagactcctggcctcaagtcatcctcccgcctcagcctcacaaagtgctgggattacaggtgtgagccaccacgctccgcctccctaatctttactgtattacctactgggcaatgtaagtgattttttgactgccagtctagggagtcagatgactgcccagcttgtggtggccggcctccaagaccatcccatgatccctgccttctgttcttcagaccctgtgtaggcccttcccacactggatcagacttgctctgtgtgaccagcagacatggggaaggaatggtagaagaaactaggtcataaaagacagtttggctttcatcttccccctctcttggttcactcactctggaggaagccagctgcagtgtcttgaggccacccaaggagaggccctcttggctaagagctgaggcctccagccaccagctttctgtccccagatgaccgcagccccagctgacagcaagatggctcacgagaggccccgaggcggaactacccagccaagctactctcattcctgatctacagaaactgagaaaataaatgttttaagccaacaaagtttgaagtaacttgttatgtagcaataagttactaacatacagacttaactttaaaagttatatttagttgggcacagtggctcatgcctgtaatcccagcactttgggaggctgatgtgggcagatcacctgaggtcaggggttcgagaccaacctggccaacatgggaaaccccatctctactaaaaatacaaaaattagccaggcgtggtggcaggtgcctgtagtcccagctacttgggaagctgaggcggaagaattgcttgaatccaggagggggaggttgcagtgagtggagatgacaccacttcactccagcctgggcgacagaatgagactccgtctaaaaataataataataatgttatatttagatataaagaatttaagggactaaagagtttccacagttttttttcaaacttttgaaatttgatatttcaaaaaataaatcttggccaggcacagtggctcatgcctgtaatcccagcgttttgggaggctgaggttagcagatcacttgaggtcaggagatcgagaccagcctgggtaacatggcgaaaccccatctctacaaaaaatacaaaacactagccgagtattgtggtgcatgcctgtagtcccagcaacttggagagagacaggaggttgaggccacagtgagccatgatcatgccactgcactccagcctgggtgacagggtgagaccctgaatcaattaatccatcttacatcagccacttcttaggaatgctttaaaccaactcaacctttttagattaagcatagatgagcgaaatacaatatggaaatattagttttacttaaaattctgaaaaagcaacaaaatattatattcatgtagagtcaattgtgaaaaaaactgattcctgaagccacaaagtctacacctttattgtatcaactttatgttcaattaatatttttaagaatatttctatgattaaaaattaattataaatcctatcaagaatcaaacttactaaatgttaactttaaaagccagtaagatctacaacacagatgaaccttgaaacatactaagagaggctggttgtggtcgctcatgtctgtaatcccaggactttgggaggctgaggtgggcagatcactggagcccaggagtttgaaaccagcctggctaacatggtgcaaccttgtgtctacaaaaaaatacaaaaaatgagcagggcatggtggtgcacccctgtagtcccacgtacacagaagactgaggtaggaggatcacttgagcccagggaggtcaagactgcagtgagctatgattgcaccactgggctccagcctgagcaacagagcgagaccttgtctcaaaaaagaaaaaaaaaaaaaaaacccactacgtgaaagtcagtcacaaagggccacatcttactgtttcatttatctgaaatgtctagaattggtaagtctatataaatggaaaacaggttagtggctgcctagggatgaaggcatggaaggaaatggggaatgactgctaatggctatggggtttgttttaggggtgatgaaaatgtcccaaaatagtggtaatggttgtataattctgtgaacatactatcaatcattgaattgtatactttaaatgggatttaattcacattacatctcaataaaactattttttaaagaagaaaatgttcaaggaacaagggttgctaaataacagaggataactgttgtttgacaacagcacaaaaattatttcccaaaaagtgtaatggccctggaaaatgagtgcaacgggatcttctcttgaacctggatagcggggtgtggacagctgggcacactgaaggcggtgatacagaactaaaagcaacaggacagctatgaagggaaaagaaaatcagtgtggctaccaagacattttagtgtctgctttcaagaaggtcctccccccatgcttggctcatgatatggggtgagtctcttgttagagtggaacatataggtcagtgtaaagtgtggagaccagcacctgactctgagcaagagttccatgaatattagctttctatttttaaaaacccactaaaagtctgggcacagtggctcatgcctataatctcagcactttgggaggctgtagtgggtaggatcgtttgagcccaggaatttgagaccagcctgagcaacacagtgagaacccatgtctaccaaaaatttagccaggcttggtggtgcacacctgtagtcccaactgctcaggaagcttgaacccaagaggttgaagctgcagtgagccgagatcacgccactgcattccagcctggccaacagagggagcctgtctcaaaaaaataaataaataaataaataaataaataaataaataaataataaaaaaatatgaagccactaacaaaggagggtaggaaatagttaacaatccagttatattctctttagagacacgcaataccagataacaaaaacaataaagatggctatcttagtcccttttctgttgctataactgaatgcctgagactgggtaaattgtaaagaaaatacattcatttcttacggtctggaggctggaagttcaaggtcaaggagctgcatctggtgagggccttcttgctagtggggactctctgcagagttccaaggtggtacagggtcacatggcaaggagtacacaagagaatgccaagtggcttttataacagactcagttttaaaataactaacccattcccatgataacccattaatccattaacccattaatccatgatatattaatcctttggtgaggacagagcactaatgacccaatcacctcgtacaggctccacctgtcaatattgttacatttgggattaagtttcatcatgagtttcagaggggagaagcattcaaaccatagcaaactcctatgatggtagaaaaataaatataagagcaaactgtaccaaaaggaaactaagctttatatatgcttctatagtttgaattatgtgtcctcccaaaatttatatgttgaaacctaatcaccaagatgatggtattagaaagtggagcttttggggaggtgattgggtcatgagggctctgtcctcacaaatgggattaatgaccttataaaagatatataagggagctgcttccctcctttttgcccttccaccatgtgaagacaaagcgtccatcccctctggagggcaaaacaacaaggcatcatcttggaagcacagaccaggccctcactagacttcctagaaccttgaccttggactttctagtctccagaaccacaagaagtaaatttctattgtttataaattacccagtctcatgtattttgttatagcagcacaaatggactaagacatgcaggcaagaatttatgataggccgggcacggtggctcatgcctgtaattccagcactttaggaggccggggtgggaggatcatctgagatcaggagtttgagaccagcctggccaacatggcgaaatcccatctctactaaaaaacatatatatatacaaaaattagccaggtgtggtggtgcacacttgtaatcttagctactcaggaggctaagacaggagaattgcagaattcttctgcaattcaggaagcagaggttgcagtgagctgagatcgtgccactgtactccagcctgggcaacagagcaagactccatctcaaaaaagaatttatgataaacaagtcaggctatccagatgcaagggctcatgcctgtaattccaggactttaggaggccaaggtaggaggattgctctagcccaggagttcaagaccaccttgggcaacatagcaagaccccacctcttaaaaacatatataaaaataaaaaattgtccaggcatggtggcacagacctgtagtctcagctacaaaggatcgcttgagcctgggaggtcaaggctgcagtgagccattatcatgccactgcattccatcctgggcaacagagcaagacactgtctcaaaaaagaaaaaaaaaattcaggctaaataatatattagaccagttgaaagggatcaatagaaacattaaagaaagattctatagtgggttagttctgcagtgtcccctcaaaattcatgtccacctgccatctcagaatgtgcccttttggtaatagggtctttacagatgtaattagttaagatgagattatgctggaagactaatgtccttataagaagaggagaagggtcaggcatggtggcttatgcctgtaatcccagcactttgggaggctgaggcgggtggatcacttgaggtcaggagttcgagaccagcctggccaacatggtgaaaccgtgtctctactaaaaatacacaaattagctaggtgtagtggcaggcgcctgtaatcctggctactcgggaggctgaggcttgagaatcgcttgaacacaggagacggaggttgcagtgagccaagatcatgccactgcactccagcctaggcgacagagtgagactgtctcaggaaaaaaaattaaaaaaaaaaggaacaggagaggagaagacatacacagatgctcagcagagacagcagccatatgaagacagaggcagacattggtgtgatgctgccccaagacaaggaatgccaaagattgctagcaaccaccagcaagtggaagaggcagggaaggattctttcccagcgcttggagagagagcatggtcctgacaacattttgatctcggacttctggcttccagaactatgagagaatgaagctctgcacctgtatttggtgtttagttatggtgaccgcaggaaactgatacatatgccatgtagtgcagccactcaaccacaaggggcactgtctggcagcaagttctacaaacacaaactgtccaaaataatcactgaagttcacagagaaagccatacaaatagcattcaaatatttttaacgatgatcaacaggctacaatttatcatttttaaaaacataaaaccattatcatcttgctgaataattcatgacctttgtaacaaactggctgagaaccacttttaaagaacatcctggtccggctatcattacacacacgggagggtatctgtaggataaattcccccaacaattccctttccaggaagagacgcatatttttaatttcaatagacaacagccaaattgccctccaaagaggaggtacattacactcgccagaaatatacatgaatggctggttttccccaggcttggcaatactttgccaagctaagaggtaagaatgggctttaaaataaaccctgatccagctcccaaggagaggactggggccttcggacccacatttcccagcacaggtgcttcaccagcctgccatggccccttctctgtccagtttagcaagggtgtggcagatttcctttcaggcacagagcccagccttccagacatcacacttaaactggttcctaccacatttgcaaggagaatctcttcttccaagtcagcagtgtttacaataagcagtatgcttttccctgagtcactctgaatatagagaccagaaaccaattccagggtagcaaagggacagccaccatggtgacctcaagcatacaaatcacacacctgcttgtcctgcctggtcaagccctgttgggaccatgcataatcctgaccccagcactcaggcacagaacacttaggagaggaaggcgaggtttcagctacatgaggtggcattgtaggaattgtcttctccctgacaccccccatggcactcaacagcctcactgtcctgaccctaagccactttgtgacccacccctgggaagggcaggcagtgaagaactaggcatagagaagaggaggtggggagttaccaagctgtttgctgacctcttcatttgactcagaacctgaccttaatcttgcttccagaaaaacaatgggccccattcctgcccaagcttgccttctgcaacccagactttcttagaacgcgatgggagtcaagagcgctttctttaaggcgaagctgtagacaggttcccctcacctcccacctctgcccacattatctgcctctagcaaataatggtagtcatgactgtgcctgttacccaggagaacaccaatcaatggctgtaaagacatgaatgtatggttttagatggtgtctgcctgcctttgctgaaaaaatgtaagaacagcaaacatttatgtattaccgtttgtcagtactgctctaagcacttttataatattaaacattcatgctgtactccttacagcaatcgtaagagctaggcactaaaactattcccattgtacagatgagcaaactgagacactgagagattgggaaccttgcccacgatcacacagtgagtaagtaggagctacaataaggagccatgaaggcagggagctccactcctgcccttcccaggcctctgttcactcctgagcatgactggtacctaacaggtgctcagacagtcgctggatgcagatgagggaacggctgtggacattcagtccttcagaccacaaaaggactttggaaggagaagaaccctggaagaatgccatgttactggcaaaggtttgggttcttacccagtgatttggtaaacacaaagggacaatggcattaagtgatagcaaagccaatctaaacagaatcacagcagtaaaccaccagaacccacaactttttttttttttttttttttgagacagagttttgctcttgttgcccacgctggaatgcaatggcgccatctcggctcgccacaacctccacctcccgggctcacccaatcctcccagctggaactaccgcacacaccaccacacccagctaatttttgtatttttggtagagacagggtttcactatgttgcccaggctggactcaagctacccacctacctcagcctcccaaagtgctagaattacaggcatgagccaccatgcctggccaccagtattttgccaggctggagtgcagtggcacaatctcggctcactgcaacctccgcctcccgagttcaagcaattcttctgcctcagcctccctgagtagctgggactacaggcacgcaccaccacacccagctgatttttgtatttgtagtagagatgaggtttcagcatgttggccagattgttctcaatctcttgaccttgtgatccaccctcctcagcctgttgggattacaggcacgagccactgagcccggcccagtctttttcttaaaaaatctgctcacaattccaattatttgcgcaatgctgtactaagtacaagagaaaggtgtttcctctcagccaggacagaaggtaggaatcttcctgtaactgcagtcctttctatggccactaaaacaaattaccacaaactgaggggcgtgagataacacatgtttatgatcttatcattctggaggttagaagtcctaaagtcaaggtatcagagccgtgctccttccagaatccctgagggaggaacccctctgctgtcctgtcaacttctggaggctgtctgtgttccttggcacatgcccttcctccatctccaaatctctcctgacctctgcttctaccacatcttcgtcttggacccttctgcctccctctcataaagacccttgggtctacactggacccaccttggtaacccaggctaatctccccacatcaagatccgtaatcacttctgcaaagtccctcttgtgaaggaaagcaaattcacaggctctgcagattctaatgcagacctcttgggggaggggcattattctgtcgacggcaataaccggagccatttctttctttctttctttctttttcttttttttttttttgagacaaagtctcactctattgccaggctccagtgctgtggtgtgatcttggctcactgcaacctccaccccctgggttcaagcaattctcctgcctcagcctcctgagtagctgagactacagatggacgccaccacacctggtttttttttgttttgttttgttttgtttttttgtttttgagacagagtctcactctgtctctgtcacccaggctggaatgcagtggcctgatctcagctcactgcaagctctgcctcccaggttcacaccattctcctgcctcagccctcccgagtagctgggactacaggcgaccgccaccatgcccggccagttattttttcgtatttttagtagagatagggtttcaccgtgttagccaggatagtcttgaactcctggtttcaagtgatctgcctgccttggcctcccaaaatgctgggattacaggtatgagccacaggaaaaaaaaatcactttcccaatctgcaaaatggctactgtcctcaatttccccaaactaatccctctcaatgatgacctcaaatctctcaccctccaaagagataacagatgccctcaggaaggccttagtttccccaacatgcttgggtctaaacccacacactctgcctttccttctgttacaagagaagaggtgtgctgtttccccctccacacccccacctgattcctggatccacccgtgcttggtcttcccacacattttgttcttgcaattcttcctgttcttcaactgttctctctctgagattattgtcattacataaaaacatgctttaatatctctctcggcttttgaaattctttaaaaaggagttaagttgtgcaatgtgagttcattgaccacaatggatttaagttagaaatcaatcgcaagatagccggaaaaatccccaagtaagttggaaacttaaaaaatacacttctagccaggggcagtggctcacgcctgtaatcccagcattttggaaggccaaggcaggcagagtgcttgaggtcaggacttcgagaccagcctggtcaacatggtgaaaccccatctctactaaaaatacaaaaattagctgggcttggtggcgggtgcatcccagttactcaggaggctgaggcacaagaatcgcttaaatccaggaggtggaggctgcagtgaactgagatggcaccactacattccagcctcagtgatagagcaagactctgtctcaaaaaataaataaataagaataaaaataaaaataggcggccgggctggagggccctgccaggggtgggggtgggggtgggtgcggggagccccgcggcgggggcgggcgcggagtcacgggggtggggtcactcgcggtggctcggggaggccagctgggaggggagggggccgtgggggcggctcggctgaaccagccccggctgggcagcagcggggacgccgggggccggggccagggctttccgggcttaggtgaggccgccgtgggccccatcttccggcggtcgccggagtttgtggtgattgttgctgccgccgccacccccccggctgccatctcctcctcctgggccgccgcctcctcctcttcctcctcctcctgggccgggctgatcccctccccgctgccgcctcctcctgggctgggcccgcggtgtctcgtcccctcgcggagccgctcctgccgccgccgccgccgcctcctcattcatcctcgtgcaccataggcggcacaggcaccaagatgtccaaccgagtggtctgccgagaagccagtcacgccgggagctggtacacagcctcaggaccgcagctgaatgcacagctagaaggttggctttcacaagtacagtctacaaaaagacctgctagagccattattgccccccatgcaggatatacgtactgtgggtcttgtgctgcccatgcttataaacaagtggatccgtctattacccggagaattttcatccttgggccttctcatcatgtgcccctctctcgatgtgcactttccagtgtggatatatataggacacccctgtatgaccttcgtattgaccaaaagatttacggagaactatggaagacaggaatgtttgaacgcatgtctctgcagacagatgaagatgaacgcagtattgaaatgcatttgccttatacagctaaagccatggaaagccataaggatgagtttaccattattcctttactggttggagctctgagtcaaaagaacaggaattcggaacttttcagtaaatatctagcggatcctagtaatctctttgtggtttcttctgatttctgccattggggtcaaaggttccgtcacagttactatgatgaatcccagggggagatttgtagatccattgaacatctagataaaatgggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccgggctcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttatggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactcaaaataaataaataaataaataatttaaaaaataaataaaaataaactgaatgaaattgaaaacatatcaatgtgagatgccactaaagtcatactaaaagggaatttacaccacttactgcctacattagaaaagaagtctcaaatcaatgcaaatcaatgacttctgcctttacagtaagaaaccagaaaaagagcaaataaaatccagtaagcagaagaaaggaaacaaagatcagaacagaaattaatataatcaggaaaagagagagagagagaatcattgtaaccagaagtttgaggaaaatcaaatcaattggtaaacctctagccagacagatcagaaaaaaacacgaaagacacaaaccagtctcagaaatgacaggtagcatcattaccaacattaaaaggataagggcatgttaaaaggataagggtatcaatagaatcaacaccttagatgaaatatataaaaaatttgagctctttctcagtgaccagggcctgtgcttaggcatagacgggcaagtggagccaacatgccagcggcccagagctgggtttgttgccaaacttatgtgaccctgcagagacccttcgagaaacctcatctcgaccaaaagctaaagctgattggtgagtatgggctccagaacaaatgtgaggtctggagggtcaaatttaccctggtcaagatccataaggccgcccgggagctgctgacgcttgatgagaaggacccacggcgtctgttcgaaggcattgccctgctgcagtggctggtccgcactggggtgctggatgagggcaagatgaagctggattacatcctgggcctgaagatcaatgatttcttagagattcctacagacccaggtcttcaagcttggcttggctaagtccatccgccacgctcatgtgctgattcaacagtgtcatatccgtgtccgtgagcaggtggtaaatatcctgttcttcactgtccgcctggattcccagaagcacattgacttctccctctgcttccctattggggtggccaaccccagccacgtgaagaggaagaatgccagcaagggccagggtggggctggagccagagatgacgaggaggaggaataagcctgcttgtcccctcctgggctggtggattgtctagttttcctgccaaatgataaaacaggatcaatgctttatttaaaaaaataaaattatgaaaaacagaaattaaggtcactcaagaagaactaggccaggcacggtgacacaagcctgtaataccagcactttgagaggccaaggagggagaatcgatgtagcccaggagttcaaccagtctgagcaacacagtgagactcccatctctaaaaacaaataaaaataaaataaaataaaaaattatccaggcaggccgggtgtggtggctcacgcctgtaatcccagcactttgggaggccaaggcgggtggatcacgaggtcaggagttcgagaccagcctggccaacatggtgaaaccctgtatctactaaaaatacaaaaattagctgggtgtagtggcagcgcctgtaatcccagctactcaggagcctgaggcaggagaatcgttggaacccaggattcggaggttgcagtgagccaagatcgtgccactgcactccagcctgggtgacagagcaaaactccgtctcaaaaaaaaaaaaaaaaaaaaaattatccaggcatgactgtggcacacttgtagtcccagctactagggaggctaaaggggaggatcacctgagctcaggagactgacgctacagtgagccacgactgcagcactgcactccagcctgggcgacagagaagaccctattaaaaaaaaaaaaaaaaaaaaaaaaaacagaaatagaaagcctaaatagccccatatccttaaaacaaggttccaaatgatctttttttttttttttgaaaagtctcactctgttgcacaggttggagtgcagtggtgcaatctcggtttactgcaacctccgcctcccgggttcaagcagttctcctgcctcagcctcctaagtagctgggattacaggcacgtgccaccacacccaggtaatttttgtatttttagtagagatgggggtttcaccatgttggtcaggctggtcttgaactcctgaccgcgtaatccacccgcctcagcctcccaaagtgctgggattacaggtgtgagccaccgcgcccggaccaaatgatctttaggagaaaaaagaaggaaatactgggggaggcacagtaggagatcacagcaggggcccacctccggaacctcaagtaaggacttgagagagaaggtagagtcagagtaacagagacacaggcgggttagccagctctgcatggaaaaggctgagtcgtgatgatgtcatggttctccccaaatctcaaagtcactgatcaaacaactcagtttacactgaagacgatggatgagactctaattttgtgcccacagcttgacacacctttgggaatttggtttaactttctttgccggtacacagatctgtgagaacatatgatcaatccagatctttatagatctatatcctccctggacaaacctaaatgcagacacttttagcacccgtaggagttaggtaggattaaataaaaacattccctcccacttgggggcacattcactgggaatcccagagcgatgtcgcctgcccacacctgctaagtgcgctcacagggcatctagttccctctcttgagttccttttaagcaagcaaggcaacctatgtccagagaagcagttactgtgtctaagtaagtcactgcatcttaggaaaaagcaaacattcgcattttgcagtgcatgatgggcgcacacccaagaaaattactcagcacttgtttttctcactttggggttttcccaaaataatttcttcagtccagttgccaagaatctggagcccccgactgacccatcaaggtccgatttggcttcggacacctcgcagatcaccccgcggctcagagcccggatcctgaagggcgcagcgtgggcagggggcgggcccgggagttggaacagagggcacagacggcccctcctcggaggggagggaccggagccggggcctttttctttaagactcgcagcactggatcccagaacttagtctgcgcggcggcattgacactagctgggctcctcggggcgcgccccaggtggtccgaagcccggtccgccctccacgcaggtgccccgcgctccccgctcagccatgtcgtcctgcagccgcgtggcgctggtgaccggggccaacaggggcatcggcttggccatcgcgcgcgaactgtgccgacagttctctggggatgtggtgctcaccgcgcgggacgtggcgcggggccaggcggccgtgcagcagctgcaggcggagggcctgagcccgcgcttccaccaactggacatcgacgacttgcagagcatccgcgccctgcgcgacttcctgcgcaaggagtacggggggctcaacgtactggtcaacaacgcggccgtcgccttcaagagtaggtgcagggcttgggttggggccccctggagcgctccgagggtgcggaggtggccagccgcaggctccccacccgtccacttgagtgaccgaggagggtggcgccgacccctagggatgcgctcagcccacgcctcccgcgaggcggttttcgctttccgtgattcgctgagccccaggcgggcccgggcgacaaacagcgcgccccgcccgccggcctgtgagggcctgtgcgcggcccggggccctccccgaactgtcagccgctgttgtgtgcaggaaaactggcctcctgggagggggcaacgccctgctagagttcatcagctttccttccaacgcgagaaacattttctctgcaaagaaacggtctccgctcgctttgggctttcgctttccttgaaagggcgcattcatagatgcccggaggcatttgctcgggaaaggaaatgaatcgctaaaacaggattagcgcgcgcttgcccttggtggacttgacaatttgtgtaatgcagagctttgataggctctggcaaaaaggaagcgagccttctcgttcccccacccccgcccggggagcttatgtttgttataaaatacgtgcgtgtggtcttaaaagcatcttccttaaggagaggggcggggatcaagagattgcttattctaactactactgaagaaaattacaggagggcgcagtggctcacgcctgtaatgccagcactttgggaggccgaggcaggagaaacgcttgaacctgggaggcagtgagccgagatcgcgccactgcactccagactgggagacagagcgagactccgtatgaaaaaaaaaaaaaagttactacggagaaataaacaggccggcttcacctccaacctagtggggaaaaaaagcctaagagggagtgaaatgaaggatgggggagcagaagtctccacccctccctttggccctaggcactccgcattgttgtgcatggggacctgagactttctttgacccgcacgggcaactcagcctgccggctttctgagagctggggtgcaggagtggggattaacaccccctaatgcagccctcagccatgggctgagagattggtggataaatacccggcttcctggacgacaggcggagggacttccccttgcctttcaaggtatggggaatggaccaccagcagctgcaaacctgggcgctcatggcaaggcagaatctcccgccttgccccacacctgctgaatcaaaatctgcgtttccgctgggcgcggtggctcatgcctgtaatcccagcactttgggaggctgaggcaggcagataacctgaggtcaggagttcaagaccagcccgggaaacatggtgaaacaccaactctactaaaaatacaaaaattagctgggcatggtggctcactcctgtaatcccagctactcgggaggctcaggcacaagaaccgcttgaacccaggaggcagaggttgcaggaagaggagattgcacccctgcactgcagcctgggcgacagagcgagactctgcctcaaaaaaaaaaaaaaaaaaaaaaaaaaatctgcatttcaacagaatccccagctccctcctacgcacctttaagtttaagaagtggtagtcaaagccaagtgttctcaaggtgtggctggagaccagtagctgtcacatcatctgggaacctagaaatgcaaactcaggccaggtgcgatggctcacgcctgtaatcccagcactttgggaagccgaggcgggtggatcacatgaggtcaggagttggggaccagcctggccaacatggcgaaaccctgtctctgcaaaaagtaaaaaaattagctgggtgtggtggcatgtgcctgtaatcccagctactccagaggctgaggcaggagaatcacttgaacccaggaggtggaggttgcagtgagccgagatcgcgccactgcactccagcctgggtgacagaggaagaaaagaaagagaaagaaagaaagaaaagaaaagaaagaaaggaaggaaggaaggaaggaaggaaggaaggaaggaaggaaggaaggaaggaaggaaagaaaatgcaaattctggagcccttactccagccctttgcaatcagaaactccaatggtgaggcccaggaagctgtgttttaacaggctctacaagtgattcggatgcagactaaagtttgagaatcaccgacctcgttcttaaaaattgttttaaaattaacttgtttttcctttagttgttaggagttaggatccactttgtcatgtgagtttcagggggaaaaatatgactttctttttgtttctttctctttttgaaaggtgatgatccaatgccctttgacattaaagctgagatgacactgaagacaaatttttttgccactagaaacatgtgcaacgagttactgccgataatgaaacctcatggtaagcccaacgtgtggacagtcgggttgcatccctcagtaagaagtgggctacaggcttcccggagcagggctaccctgcagaaatcactcaggggtgctatttctctgaagggggaaaaatagaaaattgcttcattttcccacagtgtttggcttctcactccaacattttagtttagtttagtttagtttagtttagttttgttttgtttggcagtggggtgggtggtgggaagaaattttgctcttgttgtgcaggctgtagtgcaatggtgtgatcttggctcactgcaacctccacctcccggggtcaagcaattctcctgcctcagcctcccgagtagctgagattacaggcacccactaccacacccggctaattttttatatttttagtagagacgtggtttcaccatgttggccaggctagtcctgaactcctgaccttcaggtgatccacccaccttggcctcccaaagtgttagaattacaggcgtgagccactatgcccagccttagctttaagttccaaagataagtgtgacatatcacaatgcttttgggatccatgtcatgaactcaatcctagaatgatagaatgctgtgagtccccaaaggccgcttgcctctggtcaatctcatgagtcctccagccctccaaggtgatgggcccacatctagctcatctctggaccttggtatctgttttagcattacaacttttcctatattcctttcttcttataccatactttctcaagttgattcagaaaacccaaaagaaattttcttttctttttttttcttttctttttttttttttttttttgagacagagtctcgctctgtcatccaggctagagtacagtggcacaatttcggctcactgtagtctccgcctcccaggttcaagcgattctcctgtctcagcctctggagtagctgggattacaggtgtgcaccaccacgcccagctcattttgtatttttagtacagatgggatttcactatgttggccaggctggtctcaaactcctgacctcaagtgatccacccacctctgcctcccaaaatgctgggattacaggtgtgagccaccatgcccgaacgagaaattttctttattaggaaatgtcttgcctatacctgcaggtattcaataaatgttactattatacttttcctacaaacattggagtgcctgccatattccaggcattatgctgggatctgggtgtgcaatggtgagcattatagacagggaccatctcattggtggagctgaaactctagtgggggagatatccattagcaaagaatctgaagtgtgaaatgacagctgtgctggggtacagggaagcttgcttccttgaggattttattccccaagaagttaactgtggattcttagaactgtggtttttattaaaaatgtgcttgctttttctttttttttttttttttttgacagagtttcgctctgttgcccaggctggagtgcagtgacaggatctcagctcactgcaacctccaccttctgggttcaagggattctcctgccttagcctcctgagtagctgggactacaggcgtgtgccgctacgcccggctaatttttatatttttagtagagacagggctttgccatgttggccaggctggtctcgaactcctgacctcaagtgattcatctgcctcagcctcccaaagtgctgggattacaggtgtgagctactgcacctggccagaagtgtgcttttcttaatttaacatttcgaatatggattattggccgggtgtggtggctcatgcctgtaatctcagcactttgggaggttgaggcaggaggatcacttgagcccacgagtttaagaccaggctgaaaaatatggcaagaccctcatcactttaaacaaacaaacaaaattatctctggatgcaaaaccttttttttttttttttttttttctgagacagagtctccctccgtcgcccagactggagtgcagtggcatgagctcagctcgctgcaacctccgcctctcaggtacgagagattctccgccccagcctctcaagtagctgggtttacaggcgagcaccaccacgcccagctaatttttttgtatttctagtagagacagggtttcaccatgttggccagcttgatctcgaattcctgacctcaggtgatccacccgccttggcctcccaaaatgctaggattacaggcttgagccaccgcactcagacgcaaaaagttcttaacctaagaaggtgaatggtgagagttgcacttgtactctgtcagtttctgagtgggatgagatcatagaaagcctgcagggagaactgcaggtgctttgaaggggatggagtttctaaatgcaaatctgagccaatataaacgcacattttaaaaactctcctttttacacagaaggtaacatttcatacaatgtttgccactttgctttttttactccttatgtctggggctctctccaggtttggtcagaaagcttttatcttttttgtggctatatagggacgcagccattatagggatgtcttttacccagtgttgggaagttttctcccgataaatttttgaatgggaacttgagagctgcaaggtattaagacacctttaaaactccatccccttccagagcacctgcagttctccctgcaggctttctctgatcccatcccactaaaaaactgagcaagtacaagagtacaagtgcaattctcaccattcacctttttaggttaagaagtttttgtggccgggcacagtggctcacacctgtaatcctagcactttgggaggccaaggcaggcagaccacgaggtcaggagatcgagaccatcctggctaacacggtgaaaccccatctctactaaaaatacaaaaaaattagccaggcatggtggtgggcacctgtagtcccagctagtcgggaggctgaggcaggagaatggcatgaacccgggaggcggaacttgcagtgagcccagatcgcgccactgcactccagcctgggcgacagagccacactccatctcaaaaaaaaaaaaaaaaaaagaaagaaagaaagaaaagaaaatatcataagaatggacttaatcctgagcaacatatggagaccccagctctacacaaaaaatgaaaattaaaaattagctgggcatagtggcatgttccagcttctcgagagactgaggtgggaggatcgcttgggcccaggaggttgaggctgcagtgagctatgattgtgccactgtactctagcctgggcgacagagcaagtccttgtctcaaaaaaaaaaaaaaatgcatttaacgcatctgacctaccaaacaccataggtcagcctcgtctagcttcaaggtgctttgaacgcttacattagcctatagtctggcaaagtcatctaacacaaagcctattttatcataaaatgttgagtatcttatgtaatttattgaatctgtactgaaagtgaaatgcagaatggttgtatggggcctccaagtacagattctgcagaatgcatatcgcttcctcatccatcagtgaagtcagtaagtcctaagtggaaccatcagagggcagggaccatctatctgtatttgacttgcttatttgttcaaggttctgagtcaataggacaagcaactactaagccactagagggcgcaacttgcctactctttctagagtaaggcagcaggtgtttcgggaccggtggggccacctggacctcagtggagggtggtgtgggtgcagcccttcccagggctgatgacgcatctggctgacgaggctgactgtcagcctctggcctctctcccagaggtgtgccctcagatcaaagaggacacctcctccccttaagaggatttatttcctcgaaggcacagcttctatgatctgtgtttttctttcttcctttcccattcacatttaattccttgtagccgccaagtttctgagaacaaagctgtttagaaagcaatgaagaacacaacatcactgatgtagtattcctggccaaaatattgatgtgactctcctcatgagaacagaccaattcactttgagagaaatactacaaaataatggtctacagtcttcaaaaaagtcattgccaactaccttacattaaaatatatgaaagagatgtgacaattaaatgcaatccatgggccaggtgcggtgactcacgcctgtaatcccagcactttgggagaccaaggcgggcggatcatgaggtcaggagattgagactatcctcgctaacacggtgaaaccccgtctctactaaaaatacaagaaattagccaggcatggtggcaggcgcctgtagtcccagctacttgggagactgaggcaggagaatggcatgaacccgggaggtggagcttgcagtgagccgagatcacgccactgcactccagcctaggtgacagagcgagactccatctcaaaaaaaaaaaaaaaaacgcaatccatgatcctactttggaccctggattaaagcaaacaaaaactgtaaaagaacattactgggacaatttggacacatttgaatatgggctgtattttagataatagtgttgtataatgataaatgcctggcatgtggtcataactgtagtaatgtaggggaatgcccttgctaccatatataatactaaagtgtttaagatgaaggtttatgatatcagcaacttggagagaaaaagggacagagagggaaaaagcaaacacagcaaaatgttaacaattagtgaacttaggtgatgggcatagggtatttatcgaactattcttgtaacttctctgtaacaggaaagaaatacatacatacacttcatctttgaaagtgagagagagaaggaaggaaagaaatactgaatagtactaggtacctggggggatgagtgaggtgctagtttccaaggacagagtgagggtatctcttgtgggattggggtccacaagaatgtgcagctcccttgcaatgggaacttgtggggaatgccattcagaaaatgaaataaaatctacagatccggccaggtgcggtggctcatgcgtgcaaccccagcactttgggaggccgaggaaggcagagcacctgaggtcaggagtttgagaccagcctggccaacatggtgaaaccccatctctcctaaaaatacaaaaattagctgggcatggtggcgcacacctgtaatcccagctacttgggaggctgaggcaggagaatcacttaaacccgagatagaggttgcagtgagctgagatcgcgccactgcactccagcctggacaacagagcaagactcatctcaaagaaaaaaaaaaagaccctattggacacagagaatatgcattcagaataatacataataaaagaactcactaaaattagtggggtttgatgctgatgaaatgtgtaaattaacacatttactggtttttggatttccaccagtacttcaaattgtaaaatttttggcctacatatttgtttctatgggcacaattgtctctttagtagctgtgaatcatgatcaacatgaatattaattcataatttaatgaatattaatattatcaaatagggactaaaaagtaatgaaatcaggccggatgcagtggctcacgcctataatcctagcactttgggaggccaaggcaggcagatctcctgagctcaggagtttgcgaccagcccggccaacatggagaaaccccgtttctacgaaaaatacaaaaattatttgagtgcagtggtgtgtgcctgtgggcccagttatttgtggggctgagacaggaggatcacttgagtctgggaagtggaggctacagtgagccgagatcatgccactgcactccagcttggctggcagagtgagattctgtctcaaaaaaaaaaaaaaaaaaaaagtgatgagataaaaaccaggatggaaaaacagcccattccacacgtgaagtgtccataatgaaggacagacagagtcatccccagggattccttactgctggttgtggcactaaggaattggggtggctgcccactgtcctaggacattgggtgtgcctaggaaattgagagctttagtccttagggtgagagcactgtccctcagaaagcaggtttataagtacttggagtgtgtatgctggggaggagcagttttataaaactgccagcgggctgggcacacggtggctcacacctgtaatcctagcactttgggaggccaaagcgggcggatctcttgaggtcaggagttcaagcccagtatggccaacatggtgaaacctcatctctactaaaaaaatacaaaaattagctgggcatggtggcacacaccttcatcccagctacttgggaggctgaagcagtagaatcacttgatcctgggaggcggaggttgcagtgagccgagattgtgccactgcactgcagcctaggcaacaaaacaagactgtctcacaaaacaaaataaaaaatttttaggccgggtgtagtggctcacgcctgtaattccagcactttgggaggctgaagcagtagaatcacttgatcctgggaggcggaggttgcagtgagccgagattgtgccactgcactgcagcctaggcaacaaaacaagactctgtctcacaaaacaaaataaaaaaattttaggccaggtgtagtggctcacgcctgtaattccagcactttgggaggctgaagcagtagaatcacttgatcctgggaggcggaggttgcagtgagccgagattgtgccactgcactgcagcctaggcaacaaaacaagactctgtctcacaaaacaaaataaaaaaattttaggccaggtgtagtggctcacgcctgtaattccagcactttgggaggccgaggtgggcagatcacttcaggtcaggagttcaataccagcctggccaacatggcaaaaccccatctctactaaaattacaaaaattagctgggcgtggtggtgggcacctgtagtcccagctacttgggaggctgaggcaggagaattgcttgaacccggaagtcggaggttgcagtgagccaagattgtgccactgcactccagcctgcgtgatagagcaagactgcgtcttaaaaaataaataaataaatttaagtaaaagtaaaaataaaactgcctggggaatctacaaatttactacctcacccatctctcagcgaatccctgagaaagggagccccccctgtcactgatggaggtgtgttcttccccttgggagaatagggccaaaaaaattaaatcccatgggtgcatagattttatgccttctatagtcacatttttaatctttttttaaatttgattattactttttgagaaagggtctcattcgtgtcacccaggctggagtgtagtggagtgtagtggtgtgatcatggctcactgcaatctctacttcctggattcaggtgatcctcttacctcagcttcctgagtagctgagaccacaggcacacgccaccacacccagctaatttttctattgttagtagagacagagttttgccacgttgcccaggctggtcttgaactcctgggttcaagtgatccactcctctcagcctcccaaagtgctgggattacagatataagccacagcatccagccacttttttgtttttaatcagcaattaaacctacacaatggccaggtgcggtggctcacacctgtaatctcagcattttgggaagctgaggcaggaagatcacttgatgtcaggagttcaagaccagcctggccaacatggtgagaccctgtctctactaaaaatacaaaaattagccagaatatggtggctcacgcctgtaattccagctactcaggaggctgaggcaggagaattgcttgaacctgggaggtggagtttgcagtgggccgagatggcaccagtgcactctagcctgggcaacagggcgagactctgtctcaaaaaaaaaaaaaaaaaaaaacctgcaccaagactcaatcatatgtttggtatattattcaaccagtggttgtacctctgtgatatgctttcatatatttatcattctgtttcagggagagtggtgaatatcagtagtttgcagtgtttaagggcttttgaaaactgcagtgaagatctgcaggaaaggttccacagtgagacactcacagaaggagacctggtggatctcatgaaaaagtttgtggaggacacaaaaaatgaggtgcatgagagggaaggctggcccaactcaccttatggggtgtccaagttgggggtcacggtcttatcgaggatcctggccaggcgtctggatgagaagaggaaagctgacaggattctggtgaatgcgtgctgcccaggaccagtgaagacagacatggatgggaaagacagcatcaggactgtggaggagggggctgagacccctgtctacttggccctcttgcctccagatgccactgagccacaaggccagttggtccatgacaaagttgtgcaaaactggtaaacgtctgcttcggagcttgctgcttaataaatgttggtggaatg

SEQ ID NO: 37176 - DNA, 25760 bp, Homo sapiens
ggctcccacaccactgcctcgtgtggggttgttcgcccgtgaaggggcaggacagggtgcgcgctggtggaggttagtgaggtcacacaccgggccgtggcgcctggtgcgctgggcgcttccacctcaaccttcgtagcaaacccagcggggttctgtgcctgcgcaccgtggttcctgcgttcatttactgtcccgtttctcactccggaaagtgtggctttgagtttgatctgcaggagtaggacgggcacagcgggtgtctggtcttcctcgcaccataaatcgcagagcgagccctctgtggtctctggatacagtataccaaagttagattaactgtactccttctcacaagccggtccaacgtttgcagcagtgaaaaagccctaagtgtcagggcctttggcgaagcctgtgtaagggaataaacactttccccagttttccaggcgcaaactgatggttttggagcattaaggtctggtcggatggggcaggatggctgcgttgacacgtcttatttaatccacatcataggtaaggtgaccacttatctttttacaggttgaaattgttacattttggccgggcgcggtggctcacgcctgtaatcccagcactttgggaggccgaggcaggtggatcacgaggtcaggagatcgagaccatcctggctaacacagtgaaaccccgtctctactaaaaaaatacaaaaaatcagccgggcgtggtgacgggcgcctgtagtcccagctactcaggaggctgaggcaggaggatggcgtgaacccgggaggcggagcttgcagtgagccgagatcgcgccagtgcactccagcctgggcgacagagcgaaactacgtctcaaaaaaaaaaaaaaagaaagaaaagaaattgttacattttatatatatgtaagttgaaatggaagtatatattgcaagcattataaacgtatgcaccaatatgtataaatccatgatttacagggatatagatgcagatggagccgtgggcccagttcattgccctggggtgagtcacatgctgaagggacaggggactgttgatcttttaactgggtgcccaaaatgttaggaagcctgagccctgaggccccagctttcactaagtgggaaaaaattcccttaattagcttagaaactccaatagcgtagtgctgcctccactgctgaaaacagccaaccttgatatcaggtctggtcccaagaaacaacgttgatatcaggtctggtcccaagaaacaacgttgatatcaggtctggtcccaagaaacactgtgtgtttttttttgtttttgtttttgtttttttttttgagacatagtctcgctctgtcgcccaggctagagtgcagtggcgcgatctcgactcactgcaagctccaccttccgggttcacgccattctcctgcctcagcctcctgagtagctgggactacaggcgcccgccaccacgcccggttaattttttgtatttttagtagagacagggtttcaccgtgttagccaggatggtctcgatctcctgacctcgtgatccgcctgcctcagcctcccaaagtgctgggattacaggcataagccactacgcccgccccagaaacattgttctttccttttctcttagattgttattttatccctcttttctcaggaatgaggaaaaaggttgctattttaactgtgagtgtgtgggaactggagtactgggtagcactcttcaaaggttcagttgaagtccgggcaattagtcacctctggattttttttttttgaaatggagtctcactctgttgccatgcaggagtgcagtggtgtgatctcggctcactgcaacctctgcctcccgggttcaagcgattctcctgcctcagcttcccgagtagctgggactacaggcacgcaccaccacgcccagctaatttttgtatttttagtagggatggggtttcaccatgttggccaggatggtctcaaacacctgacctcaggtaatccacccacctgggcctcccaaagtgctgcgattactggcatgagccactgtgccaggcccctcctctggatgtttctgagagtggctggctttgtaacatgtatacttcacttttgtataatactttgtatatacttccgtttcatataatactttgtatatacttcagtttcgccactcagatgccataggaagtgaggggtgcattgtttttgtttgggattttgttctaaagattacagtataaccaaacatacaataagctatattaactcattttttggtgggggggtagagacagggtatttctttgtcacccaggctggagtataatggtgaagtcatggctcactgcagtctggacagcctgtgctcaagccatcctcccacctcagccccccaagtagcttggagtacaggtgcgccacgctacacctggctaattttttactttttgtagagatgaggtctcacaatgttgccctgctggtctcaaatttctgcgttcaggcaatcctcctgcctcagactcccaaagtgctggaattacaggcatgagccactgcacccagcctttattacctttttttttcttttttttttaagataggttctccttctgttgtccaggctggagtttagtggcacggtcttgactcactgcaacctccgcctcccaggttcaagcaattcccgcaccttagcctcccgagtagatgggatttacaggtgctcgccaccactcctggctaatttttgtatttttagtagagaccaggttttgccatgttggtcaggctggtctcaaactcctgacctcaagtgatccgcccacctcagcctcccaaagtgctgggattacaggcatgagcctccacgccctgcagtattatcttttttaaagagagagtacttgaggccaggagtttgagaccagtctgggcaatgtgagacaccgtctctacaaaaattacaaaaaattagcccagtttggtggtacacacttgtggtcccagctactcaggaggctgatgtgggaggatcacttaagccttgcaattagaggccgcagtgagccatgatcacaccacggcactccagcctgggcaacagagacctcatctcaaaaaataaataaataggccgggcacagtggctcgtgcctgtaatcccagcactttgggaggccaaggcaggtggatcacctgaggtcaggagttcaagaccggcctgaccaacatggtgaaaccccatctctactaaaaatacaaaaaataagccaggtgtggtggctaacgcctgtaatcccaactactctggaggccgagacaggagaatcgcttgaacctgggaggcagaggttgcagtgagccgagattgcgccattgtactccagcctgggcaacaggagcaaaattccatctcaaaaaaaaaaataataataataataatacaaaaattagctgggggaggccaggcgcggtggctcatgcctgtaatcccagcactttgggaggccgaggcgggcagatcacctgaggtcaggagttcaagaccatcctaaccaacattgtgaaaccccatctctactaaaaatacaaaaaatgagctgggcatggtggcacgtgcctgtagtcccagctactcgggaggctgagacaggagaatcgcttaaaaccaggaggtgaaggctacagtgagcccagatcacgccaccacactccagcctggcgacagagcgagactctgtctcaaaaaaaaaaaaaaaaacaattagctggggctagtggtgggcgcctgggcgacaaaagtgaaactccatctcaaataaataacagaaacacaccctttcttatctgttgtgcatacttaactaaaagaaacacacccaaaagtatttacaaataaagaagatgggggaggaaaagaaaatctttagcttattaataaaagaatgggtctatttgaaaagtacaaatgctaaaaaaaaaagtgcttcaatgtatatagcttgccttttaagtctgtagccatttaaattataagaatttcatcatttgctggccaggcgcagtaactcacacctgtaatcccagcacattgggagaccgaggtgggcggatcacgaggtcaagagatggagaccatcctggccaacatggtggaaccccatctcttattagccgagcatggtggtgtgcacctgtagtcccagctacttgagaggctgaggcaggagaatcgcttgaacccaggaagcggaggttgtagtgagccgatattgtgccactgcactccagcctggcgacagagcgaaactcagtctcaaaaaataaaaataaaaaatatcatcacttgccaagcctggtggctcatgcctgtaatcccagcactttgtgaggctgaggcaggaggattacttgagtccaaaagattgaagctgcagtgagctgtgattgggccactgccctctagcctgggcaacagagcaagaccctattcaacaataacaaaaaaaggaattaggtgatgggaaatgcctaccatttgaatctataaagataagcaaggcagggtgcagtggctcacgcctataatgccaacattttgggaggctgagacaggaggatcgcttgagctccagagttcaagaccagcctgggcaacatagtgagatctagtctctacaaaaataaacaaatttagctgggtgtggtggtgcgtgcctgtagtctcagctacatgggaggctgaggtgggaggattgagtgagctcaggaggttgagactgcaatgagccatgattacgccactgcactgcggcctaggtgacagcaaaacctgtctcaaaaaagagagagagagagataagcaagagttactcatgatgcttggacttgggggaagatgccaactctggcacatgtcagttactacataaaaagtcaagtgcaatgtcaaatccagagcatcaagaggaaaaaaagttcagttcccaagagaacatggatagcttaataatgtaaaacttggccgggcagggtggctcacgcctgtaatcccagcactttgggaggccgaggtgggtggatcacaaggtcaggaattcaagaccagcctggccaacttattgaaaccctatctctactaaaaaaaaaaatacaaaaacaatagccaggcttggcagctggcgcctgtaattctagctactcaggaggctgaggcagagaattgcttgaacccgggaggcggaggttgcagtgagcccagatcacgccattgcactctagcctgggtgacagcgagatgccgcctcaaaaaaaaaaaaaaaaaaaaaaaaaggccgggcacggtggctcacacctgtaatcccagcacttttggaggccaaggtgggccgatcatgaggtcaggagatcgagaccatcctggctaacatggtgaaaccccgtctctactaaaaatacaaaaaattagctgggcgtggtggcgggcgcctgtagtcccagctactcgggaggctgaggcaggagaatggcgtgaacctgggaggaagaagttgcagtgagccgagatcgtgccactgcactccagcctggacaacagagcaagactccatctcaaaaaaaaaaaattagccggatgtagtggtgtgaacctatagtctcagctactcaggaggctcgcccgccttggcctcccaaagttctgggattacaggtgtgagccaccgtgcccagcctgtattttctgtagagatggaattttgccatgttgctcaggccagtctcgaactcctgggctcaagcaatcctcccaccttgtcctcccaaagtgctgggattacaggtgtgaggcaccatgcccagccgcaacagtaattttcacaaattactgaagtcaagtagccaattttgattcatgaaagtgatatcactgtaattcttctaaactttcactgaaatgcatgctccctttgcagagggaaagctgggttaagagatgtccaggatggtcgggctcggtggctcatgcctataatcccagcactttgggaggccaaggcaggcagatcacctgaggtcgggagtttgagaccagcctgaccaacatggagaaactccatgtgtactaaaaatacaaaattagccaggcgtggtggtgcatgcctgtaatcccagctactagggaggctggggccaagctggtcttgcacacctgacctcaggcgatctgcctgcctccacctcccaaagtgctgggattgcaggcttgagccaccgtgcccagccctatgaattatttcaaatgcgttagatccacctaatcaaaattctgtcattcaacatataattttgagtgccaactatgtctcaaggtcagtgttcagccctacagtaaacaacatggacagagctgctgccttcacagaacctccatctaaggagcaggtgaatataccaccaggccgtaattggttgcttagctccaaaatagcgaatttagggtcaattaagataataatctactaactgtaatgacatctctagagtattgtgtcttttaaagtacagttatagcctgggcaacgtggggaaaccccgtctctacaaaaaaaaaaattttttttctttgaaacagtcttattttttcacccaggctggagtgcagtggggcgatctcagctcactgcaacctcaaactcccgggttcaagcaattctcatgtctcagcctcctaaatagctgggattacaggcgtacaccaccacgcatggctaatttttgcaattttagtaaagacgggattttgccatgttggccaggctggtctcgaactcctggcctcaagtgatctgcctgccttggcctcccatagtgctgggattacaggtgtgagccaccgcacctgacccctcctgtctctcttaacacacattgcctccttatagaggttcaggcaccatgctgagcctgggaggtaatacaaaaatgaatgagtggaccttgtgggttccatgctagttaaagacaccctatgagaccagcctggccaacatggtgaaaccttgtgtctactaaaaatacagaaaatagccaggcatggtggtgtgtgcctgtaattccagctactggggatgctgaggcaggagaatcgcttgaacccaggaggtggaggttgcagtgagctgagatcacaccactgcactccagcttgggcgatagagtgagactccatctcagaaaaaaaagacaccccgggccaggcaaggtgggtcacacctgtaatcccagcactttggggaacaaggtgggagaatcacttgagtccggcagtttgagaccagcctggccaacataatgagaccgcatcttcacaaaaaatatgttttaaaaagctgggcatggtgaagtgtgcctgtagtcccagctacttgggaggctgaagtgggagtattgcctgagcccaggagttcgaggctgcaggctgcagtgaactatgatcacaccactgcactccagtgtgggtgacagagggagaccctgactcattaaaaaaaaaaaaaaaaaagaaggctgattgtggtggctcacgcttgtaatcctagcactctggaagactgagacaggaagattacttgagcccagtggttcaagattagcctgggctggccgggctcagcggctcaagcctgtaatcccagggaagagaattgcttgaacccaggaggtggaggttgcagtgagctgaggtcgtgccattgcactccagcctgggtgacaagagcaaagttccgtctcaaaaaaaatatagcctgggcaacatagtgagacctcaagaccccatctctattaaaagaaaacaaagtatccagcttaaaaacataatactggccaggcacagtggctcacacctgtaatcccagcactttgggaggccgaggtcagatcgagaccatcctggccaacatggtgaaaccccgtctctaatacaaaaattagccaggcatggtggtgggcacctgtaatcccagctacttgggaggctgaggcaggagaatggcttgaacccaggaggcggaggttgcagtgagccgagatggcgccactgaactccagcctgggtgacagagactccctctaaaaaacaaaacaaaaaaaccataatactaagtgaaaagaaacagaatgaggaaacacagacctgcgtgagttaggattgcagttcccaaactgtgttgaggcacctcagagtgccatagtgaattctcagggacgctgtaagatgctttaaattgtttgagggaaatatatgggtactcaacatgtcagatacctcataaactattcaagggagttcaaagtttcaaagttacattgaactacttttctttcaatgacatctttttgcaaagctgggtttacagcagtttctgtgataaaaagcaaacacctgacaaaaatcagcatggataaagtgatttaggtgatatcagacaatctgattaaggtttgggaaggtgtgcagagtctaacaaacatgcatccattaataagcaattgtagttatttaacaatttttttttctatctatgtgttgtcgattttctaaactgctactatttttttaggacataaataggtattatattttggtccaagcaggtggtgggggcagggcaagttaaaaaaaaaattggtccaagaaacagaagtgttaggtatttgttttgaaaaaaataacatatgcatacactcatgaaaccatcaccataatcaagatagtggacatatcatcatctccaagtttcctcatgcccctttgtaattcccttcctaactgccccacctcatccccaagcaaccacggatctgctttgttactatagcatacaaaatataacaaagtatacaaaatataacaaagtgtacaaaatatactttgttatattttgccttttttttttttttttttttttttttgagatggagtgttgctctgttgcccaggctggagtgcaatggcgtggtctcgctcactgcaacctccgcctcccgggttcaagcgattctcctgcctcagcctcccgagtagctgggactacaggcaagtgccaccacgcctggctaattttttgtagagacggggtttcaccgtgttagccaggatggtctcgatctactgacctcgtgatccacccgcctcagcctcccaaagtgctgggattacaggcgtgagccaccgcgcctggcatattttgcctttttaagagttttatataagtgcatcttagtatgaactcttctaaattccttcttttttttttttttttttttttttttttttgagacggagtctcgctctgtcgcccaggtcggactgcggactgcagtggcgcaacctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaattccttctttcttttctttatttttgagacggagtctcgctctgtcgcccaggctggagtgcagtggtgcgatctcggctcactgcaacctccacctcccggtttcaagtgattctcttgcctcagcctctgaagtagctgggattacagacgtgcaccatcacgcccagctaatttttgtatttttggtagagatggggttttgccatgttggccaggctggtcttgaactcctgagctcaagtgatccacccgcctcagcctcccaaagtgctggaattacaagcatgagccaccaagactagctctctctaagttctttcactctataaaagttattggaagccgggcgcagtggctcacacctataaccccagcactttgggaggccgaggcgggcggatcacgaggtcaggagattgaggctatcctggctaacacggtgaaaccccgcctctactaaaaatacaaaaaaaagttagctgggcatggtggcgggcgccacttgggaggctgcggcaggagaatggcgtgaacctgggaggcagaggttgcagtgagccgagatcgcgccaccgcacttcagtgtgggtgacagagcgagactccgtctcaaaaaaaaaaaaggcctggattacggtggctcacacctgtaatcccagcactttgagaggccgaagcaggtgaatcacctgaggtcaggagttcaacaccagcctagccaatgtggtgaaactctgcccatgttaaaaatataaaaattagctgggcatggtggcgggtgcctgtagtcccagccacttgggaggctgaggcaggagaattgcttgaacccaggaggcggaggttgcagtgagctgagatcgtgccattgctccagcctgggtgacaagagcaaaaaactccatctcaaaaaaaaaaattattggagattcaccaggtttgttccatgtttcaataggtcattccttttcttatagttgtaaggtaagatgtacatatcatagaaccaacctcttcaaagtgtgcaattcagtggtttttagtacattcacaagattgtgcagacatcaacactatctaattcaagaagctttattttgggccgggtgtggtggccatgtctgtattcccaacactttgggaggcacagccgggtggatcacctgaggtcaggagttccggaccagcctggccaacatgatgaaatcccgtttctactagaaatacataatatagccgggcgcggtggcaggcgcctgtaatcccagttactcggaaggctgaggcaggtgaatcgcttgaacctgggaggcagaggttgcagtgagccaagttcacaccactgcactccaggctggacagagtcagactcctgtctcaaaaaaaaaaacctttattcctttatttcattacctctaaaggaaaccccatagccattaccagtcactattccacccatcccctagcctttagctcctaaaaaccacgaatgtattttctgtctctatgaagttgcctatcttggtttttcatataaattaatcataaaaatatgtggcctattgtgtctggcttatttcatatagcataatattttcaaggttcatccatgttgtaccacacgtataagtacagtacttctttttttctcttcttttcttttttttttttttttttgagataaggttttgctctgtcacccaggctggaatgcagtggcccgatctcagctcattgcaacctccacctcctaggctcaagcgatcttcctgccatagcctcctgagtaggtgggactacaggcatgcaccaccatggccagctacttttttgtaaaaatggggtctcactatattgcctggccaacatggcgaaactctgtgtgtactaaaaatacaataattagtggggcgtggtggcacatgcctgtaattccagctacgtaggaggcagaggcacaagaatcgcttgaacccaggaggctgaggttgtagtgagctgagatcacaccactgcactccagcctgggtaacagagtgagactctgtctcaaaaaaaactttgtctagtaattccaacatctgagcttcctcagtggaagtttttatttaccggtttttttcttctttttttctttcctgtgtatgggctatgctttctagtttatttattttttgagatggagcctccctctgtcacccaggctggagtgcagtggcatgatcttgcctcactgcagcttccgcctcctgagttcaagtgattctgccacctcagcctcttgagtagctgggattacaggcgtgcgccaccacgcccagctaatttttgtatttttagtagagacagagtttcaccatgttggccaggctggtctcgaactcctgacctcaggtgatccacccaccttggcctcccaaagtgctgagattacaagcgtgagccactgtgtctggcctactttctagtttctttgcattttttaatctggacattttaaataatgtggcaactctgaaattcagattgtctccttcccagggtttgttgtggctgctgtttgtttttattatcactgctgtttagtgacttctttttgtttgtttgtttgtttctgagataaggtctccctcttgttgtctaggctggattgtagtgcatgatcatagcttactgcacctcaaactcctgggttcaagccatcttcccatgtcagcctcccaaaggcatgagctactatgagcctgtttagcaacttttctgaactaattctataaagtgtgtattctttgttgtgtgtggccactgaaggccctgcttcattagcttactgaccagataacggttaggcaaaggttcccttaaatgccttgaaccattacttcttccagcatttgcctaatgtgtgtccatgtatgttggagaatacctagaacactccctcaggtagttcacaactgtgccttagccttcactttttccttgcccaaagcctgaaggtcccccacaaataagagcttaaggccttcttggttctcttcgttgttgttgttgttgagacggagttttgctcttgttgcccaggctggagtgcaatggtgtgatgtcagctcactgcaacctccatctccaggattcaagcgattctcctgcctcagcctcccgagtacctggtattacaggcacacgccaccacgcccagctaactttttttgtatttttagtagagacaggatttcaccacgttggccaggctggtctcaaactcctgacctcaagtgatccacccgcctcaccctccgaaagtgctgggattacaggcatgagccaccacacccggccttttcttggttctttcttgggcatgctcacagccctatgcatgggcatgcatatggcattccagatatccagcagtgtgtcagaacttttcatagacatctcattccccagcttttcctttcatgctttttggtctgttgcttgtttactccagctcttatcaccatctcaaccagctatgatgttaaacaactgccactgattttttgtgtttttaaaaattttgagactgggtctcgctctgttgcccagattggagtgcagtggcacaatcatggctcactgaagcctcaacctccggctaaaacaatctcagcaactgctcaagcagtcttcccaccttggcctcccaaagtgctcagattacaggcgtgagccaccgcacctgtccttgaaatgctttttcctttgactttctggaatcttctcttggctctgctcctgccttgatggcttctcctattcagtcttgctagttcctcctggttcccctgagccctatatcttagcaatgtcccacgtcttagtcctagaacctcttctttatttacatcacttgctaggtgatctctttcatttcattttatttatttatttatttgatatggtcttgctctgttgtccaagctggaccaaagtggcacaatctcgactcactgcaacctccacctcccgggttcaagtgattctcctgcctcagcctcccgagtagctgggattacaggcatgtgccaccatacccagctaattttttttcttttttgagacgcagttttgctcttgttgcccaggctggagtgcagtggcgcgatatcagctcactgcaaacctctgcctcccgggttgaagagattctcgtgcctcagcctcccaagtagctgggattacaggcatgcaccaccatgcccggctaattttgtatttttagtaaaggcgggctttcaccatgtcgtccaggctggtcttgaactcctgaccttaggtgatctgcctgccttggcctcctaaagtgctgggattacaggtgtaggccaccatgcccagccttctttatctttaaaaaaaaaaaacaaaaaacaaaaaaacaaaaacagtatactgatggctcctaaatttgcactgagaaaataaaactaggctgggagcggtggcttatgcctgtaatcccagcactttgggaggcagagacaggaggatccagaccctgtctctaaaaaagaaaaaaaggagtctgggcacagtggctcacgcctgtaatcccagcattttgggaggccaaggcgggcagatcatttgagatcaggagttccagaccagcctggccgacacagtgaaaccccatctctactaaaaatacaaaaactagcccccgtggtggtgcacgcctgtaatccccactactcaggaggctgaagcggaagaatcacttgaacccaggagacggaggctgcagtgagcggagattgtgccactgcactccagcctgggcgacagagcaagactccgcctcggggaaaaaaaaaagagaaaagacaaatagcccaagggcagtctgagctatgtaaagtatgcaaaatttatcagtcccagagagaaaggagcatctcagctcagtcacatcctccacccacccacccatgcccaggggcagttgtttaaagagatgttgggccaggcacggtggttcatgcctgtaatcccagcactttgggaggcccaggtgggtggatcacttgaggtcaggagttcgagaccaacctgaccaacatggtgaaaccccgtctctactaaaaatacaaaaattagccgggcatggtggcacgcacctgtaatcccagctactcaggaggctgaggcaggagaatcgcttgaacccaggaggcagaggttgaagtgagccgagatcacgccattgcactccaacctgagcaacaagagtgaaactccatctcaaataaccttctcttggggtctggattgggacccctttgtggtaataaaggagggacactaatattaaagctggctcaactgggtctgagcagagtaatttttaccttagatatttgtgttttgggtgtgcactttcagtttacattggaagctgtctccccaattaaaaaaaatcatgttttgaggaagattttctctgagatatagatacaattaatttgaacaagtctggaatacctaaactttcatccaactttccacagattactaggtcattggaatattgtccattttatttatgtatttatttttagagacagagtctcactctttgtcacccaggctgaagtgcaatggccccatcatggctcactgcaatcttggcctcctgggcccaagcaatcctcccacctcagcctcctgagtagctgggactagaggcacacgccatcactcccagctaacttttaaaattatttgtagagacagggtttcaccatgtttcccaggctcttctccaactcctgggctcaagcaatctgctcaccttccgcctcccaaagtgctgggattacaggcatgagccactgcacccagcctcctgcttctttttatgcctggtaatctttgtttggataacagacattgtcaactttacctttttaggagctgggtcttttttaattcttatcaatctttgttattcctaaggatcttttagggtcttcttttatgatgtgtaaagtgagcctggagcaatactaagtctagggctagttactccccacaactgagacaagacattcctgtgtactctatgccctgtgaattatgagttttccagtctggttggtgggtgcaggcactattttcagaagctccatgtgagtgtcaggacctgttccctccaatccatttggatggttcttttcctggccttaggtagctgcctcatatgcatgtgttgataagcactccgctaaatactgaagggggaccctctgcagatctctgtgattctctgtgctcctctctgctgacattctgtccttttaactccagctgcccttgtctctctggaccacctcaacttagggagtccaccaggcgctgcctcagtttcccgttccagtgccatagcatggaagctctccaggcagtgtgctgggacagttgtagtgctcacgttgtttcccatctttcagggatcactgtcctttggtgcctgatgtctaatgtcttaaaaatcattgtttcagccgggcgcggtggctcacacctgtaatctcagcactttaggaggccgaggcgggcagattacctgaggtcaggagttcaagaccagcccggcctacatggtgaaaccccatctctactaaaaatataaaaattagccaggcatgatggcaggtgcccgtaaccccagctactcaggaggctgaggcaggagaatcacttgaacctgggaggcagaggttgcagtgagcagagatcttgccattgtgagattgtgcctgggcaacagagtgagactccgtcaaaaaaaaaaaaaaatcattgtttcatgtattttggtttttttgtggggggcaaagttggttgtttcctgtgagaggacaaagttggtccctgttattccactttgactgagagtgcatgacaccttttttcttgtagagacagggacttgcccagactggtctcaaactcctagcctcaaggaatcctcccacctcagcttcccaaaagtgctgagattacaggcgtgagccaccacgcctggccacaaactgtattgtgatgccattggctgagatgaaggagacagtgggggagcatctgagcaaaggaaatagaacaaatctgtttggatggataagcagtatgtgacacccacatgaatgtcaaacaggtcattacagtacgtttgagtctggtgttccagagaaaggtctaagctgaaggcctagaggatcttccaaatatttgcaataattaaggctacaggagaagaggaagtcacttaggaagagaggatcagacaggattatacccaaggatattctaatatttggaagtttgatacaagtggaggagtagccagagatggagaaaaaaaaaaaaaaaaaaaaaacgagaggccgggcgtggtagctcaagcctgtaatcccagcactttgggaggccgagatgggtggatcacgaggtcaggagttccagaccagcctggccaatatggtgaaacctcatctctactaaaaatacaaaaattaggctgggcgcggtggctcacgcctgtaatcccagcactttgggaggccaaggcgggcggatcacgaggtcaggagttcgagaccagcctgaccaacatggtgaaaccccgtctctactaaaaatacaaaaattagccgggcgtggtggtgcatgcctataatcccagctacttgggagcctgaggcaggagaatcgcttgaacccgggaggcggaggttgcagttaaccgagatcgccccactgcactccagcttggatgacagagcgagactccgtctcaaaaaaaaaaaaaaaaattagctgggcgtggtggtgcatgcctgtaatctcagttactcaggaggctaaggcaggagaatcacttgaacccaggaagcagaggttgcagtgagccgagatcgtgccactgcagtccagcctaggtgacagagtgagactccatcttaaaaaaaaagaaagaaagaaaaagaaaaaccaagagagtgagaggaagaaattgtgggtttcactagaaagtcacaggagagggcagagaagtgattgctggtttggcaagattattattcatcagtggtctggttaagagcagtcccaaagacacaggagtgacaaacaccaaattgaattgagttgaatatggtctgggacatgaggaagtggagtctgaagaaagccagatgattggccttgttgaggagcacagtaatggaatcatgccaaggggagtatatagggccaaaattcacaagtaaatatatacatgggaattgacgacacagtatctgaaacaacctaggcagccatcagttggggaagggctgaacaatgctacataatatcatgaaccagttaaaaaggatgagttaaaaagatgttcttatatattaatatatgaaaaaacagaagcatcaaaacaatacttcaaaaaaaggggggatttcatcaatgtgaaaccctgattgtattaaaagtatgagatttctctgtattttttctttaatattcagtcttcatagactgtcaaaaattgccaatgccgactatattgcaagtcttcggggcggggtattgggaagtttccaattagcaatatccacaccttggctaaacctcattggctatgatactgccactgcaaaaagcatatttcttttttttcaagaatattcttttttttttttttttttttggagacagggtttccctctgttgcccaggctggagtgcagtggcgcgatcttggctcactgcaacctctgccttctgggttccaatgattctcctgcctcagcctcccaagtaggggacttacaggtgcccgccaccacgcccggctaattttttgtattttagtagagaggaggtttcaccgtgttacccagggtggtctcaaacccctgagctcaggcaatccacctgcctcggcctcccaaattgctgggattacaggcatgcaccaccatgcccagccctttttttttgagacgggaatttcgctcgtctcccaggctggagtgcaatggcaggatctgggcttgctgcaacctccgcctcctaggtttaagtggttctcctgcctcagcctccccagtagctaggattacaggcgcgtgtcaccacgcccggctttttttttttttttcgagacagagtctcactctattacccaggctggagtgcagtggtgcgatctctgctcactgcaacctcctcctcctggcttcaagtgattctcctgcctcagcctcccgagtagctgggactacaggcacgcaccaccatgcctggctaactttttgtatttttagtagagagggggtttcaccatgctggccaggctgatctcgaactcctgacctcatgatctgcctgcttcggcctcccaaagtgctgggattacaggcgtgagccaccgcgcccagcctatttattatttcttaatgtaaagtttaattaaaaatccttccagccgggcgcggtggctcacgcctgtaatcccaacactttggggggccgaggcaggcggatcacctgaggtcaggagttcaagaccagactgatcaacagggagaaacccggtctctactaaaaatacaaaattagctgggcgtggtggcacatgcctgtaatcccagctacttgggaggctggggaggctgaggcagaagaatcccttgaacccgggaggcggaggttgtggtgagccaagatcgcgctaattgcactccagcctgggcaaaaagagccaaactctgttaatcaaaaaaaaaaaaaaaaaaaaaattccttccagtatgcatataatttggggcctttttttaaaagctttatcataggtaggacctcttttttttttttttttaacccaaagcattcataccttttactatcaaaaagctattttgtattttgtaaaaataaaagcagaggccgggcgtggtagcttaagcctgtaatcccagcactttgggaggccgaggtgggtggataacctgaggtcaagagttcgagaccagcctgaccaacatggtgaaaccccgtctctactaaaaatacaaaaattagatgggcgtggtggcgcacgcctgcagtcccagctactccggaggctgaggcaggataaccgtttgaacccgggaggcggaggttgcagtgagccgagatcgcgccactgcactccagcctgggagacagagcgagactctgtctcagaaaacaaaactaaacaaaacacaaaagacaaaactcagagctggcggggttggggggacagggtggggagaaagaaagcgaaatctgttccttggcttctcggagccaaggaggtttctccactttcaaggtctccaggtccgcccccgcctgtaacccccagcgccgcccctctggaagcctgggaggactgtgtgttgcgaaccggtgcggctactctcggccgccgcggaggtccgcgtcttgttagcagggaaggtttactcccccattgtgggtgaccaaggggctgagggcttggccggtttcgctttgctgggggcaaggcacgctctctctccccacccttccgggttccctcagacagtctcggccttgaggaacccccttcgcctccggtcccccagccaaccttcctccgctccccgcgccctccccggagaaccccactgtcactcgcgatgctccgaagacccgggaactaggcgaggaaggcggtggccgcctttttccagctggggtgagtcatttcctgcgacaggctccctcccccggaagtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccagggttggttgggtctgggggaggctggaagtctttcgagtaggggtctaaggcagaggtcttgagtgggtgctggcgttggaaggagcatgcggctggtcttgggagaggggcgaggcatcccggacagagtcttggaatggaggtgcaaaaaaggggtgttgaaagttggagctgtccagagaataactctaaggcagagctgtccaaagaaagagcatgaggcattccagtggagggtgtaactgaaagaaaggaaggagatttggactcttggaggatgggggagggagtatgtctggccagagttattggggagttgaggatttgaagggaagttgggggctctatggcagtaatcttagtaggggactgcgcaggcatcttaggggttgaggttctcctaggtaggagttttgggtggtttgttttgggcaagggtcttagaaggcaagggtgccctggggcggggtcttggataggggtctagagggggaatcttaggaggatggggggggttcctggggttgggtccaggccaggttatgttgtagtcaaggacagcagaacacaaggaaggagatgtcccaggggtggaaaatttagagtgctagggggaatcctagggtagagtccccagggcataagccaatctaagggaatgtctaggctggccctgaagggtagttaccaaggcatgagaaggggtcatcccaaggtaggcatcctgaaggagtttggggaagccggttgagggggaaaggtgtgagaggactctggggtggtcaaataggttggggtacagttagaagggtatgagcagaggagttcctggggatggcagaccaagcatagcagtcccagggccaagtcagggaggtacaagaagtgcatctcctagcccacttttgtctatttattgagagagtccggtgctaggtcaggtttgaagatgagaaatgggttgggagtggttccaggccatgtctggcattgggatcaagattggctggcggtggggaggagatatcacgggggcaccccctatcacattacttcctgacaagtcagtgagggccagcatgtaaagaggaggtgtggggtccacgtcagtgtgggcctggagcttgccaaacctgaaagaaggagggttcctggccatgttgtttgggatcttgggagcttagagcagagaccctgggactctctgtttttatctttttcttccccccgagacggagtctcgctctgtcacccaggctggaatgcaatggctcgatttcggctcactgccatctcagcctctcgggttcaagcaattctcctgcctcagcctcctgagtagctgggattataggtgccccccaccacacccggctaacttttgtatttttattagagacgggatttcaccatgttagccaggctgatctcaaactcctgacctcaggtgatccacccgccttggcctcccaaagtgctgggattacaggcataagccaccacgcctggcctgtttttatcttttttgcagtcactccagagtcagtagttagcagagtaggaggaggaaatcaggtgaggcagaacttggaggggagattccaggactcttctcatctttatcccatttgtatgcagaggaacaatcctgcaccatgactcaacagccacttcgaggagtgaccagcctgcgtttcaaccaagaccaaagtgagagaggattgggcctgtacccttgtgggaggaagcgaggaaaagaggggtcagaagtgggccatgggcccccagcttcctacctgggcattctttaaggcagtctggattccttccatcccccaggctgcttttgctgcgccatggagacaggtgtgcgcatctacaacgtggagcccttgatggagaaggggcatctgggtgagctgttggcaggggaggggcaatgggcagaagagctgggctgggcattggctcccacctccactgacaccctggtccctgtccagaccacgagcaggtgggcagcatgggcttggtggagatgctgcaccgctccaaccttctggccttggtgggcggtggtagtagtcccaagttctcagagatctcaggtaagtgccctcatcctgccctttggcccagatttctcggattcctggcctcccacaggcaccccaaggtactggcagatgaagacgtcagagtacttcagagtcacacagagaggaggcctacagcttggaagtcatggatcttatagcttgagaagcttggtgctttgttttcattttaaaaattctgattgagtgcctcctgtgtgccatgccctagagcacttactgtgagcctggaactgccctaagcactttacgtttattaactcatttaatcctcacagtaactctatggggtaggaaggatcattatccccatctttaccgatgaggaaactgaggcccagtgcagttaagtgactcatccaaggtcacacaagcaataggttttaaaatcttggagccgtcttcccaatacccccttggcttgagcctcaagtgccatcttactttaagggtttttcttgatgatcccatctggacaaggcaggagttgccctaggtgagtcacagagccctaggattcctcacggaaatctccagggtgcatggactaggaccctggaggcagaaatagttaccgaggggaagttacaggcctgagtgtgagtccctgtttggttgctgatgagctttgaggtccttggccagacactcaaccactttgaacctcagtttcctcatctgtagatgagtgtaacagtctagaacactcctctcagggatcatatccacaagtgctcgtgctgtgcgaggatctcactggttgtttattgaaaggctaagcaagtaggttgaggtccctgggaagcaggggtggatcctgtgtcaccagggctgccccttaccctaaaccttggccccgacaacccacccacctgcccagcagtgctgatctgggacgatgcccgggagggcaaggactccaaggagaagctggtgctggagttcaccttcaccaagccagtgctttctgtgcgcatgcgccatgacaagtgagcctgaggaggaccggggtgggaggtaggaggtccccacagtaagtgagagggatagtcctccctgggcatcccgccaccccctcacggccatcctgtgttgtgtgatacccacaggatcgtgatcgtgctgaagaaccgcatctatgtgtactccttccccgacaatccccgaaagctgtttgagtttgatacccgggacaaccccaagggtgagagggctcagatacacaggtgtaagggcatgaaacagtggatggggcagaggggcagagatgaggaaagaaaggaaggggcactcacacacagagaaatggggaaagaggcagggagatgctcacactcatagcctctccatctttccagccctcagccagttctccccacctccggacctgccccacccctgggtaccccagtggcagagcaaaaacacctcgtgaggacatgggtgggtgtgtcagggatccctgagcttctggggctgtgatagcagcttactagattccacagctgcagagcaaggaatggaatctgcctagctggcggggcgtgcagctgagctgagccccctcagggttcttcgggttaagcttatcgtggagggttgaagtctggtcctcatccagctctgtccattctgagatgctgcctcctcttcagccgcccaccccaccccccatcttcacaccctagggctctgtgacctctgccccagcctggagaagcaactgctagtgttcccgggacacaagtgtgggagtctgcaacttgtggtgagccgtccagtggacaagggtgggtaggttggtggactggcttccttgtggactcttggccccttccctccataccaccccaacctcagactcctccctcctaccccaggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactggtgagcacagggtatgcatggtgggctggtgaccccataccacatgacatgtgggcatcactgctgatctgtcttctagcattaacttcagccacgactcctccttcctctgcgcttccagtgataagggtactgtccatatctttgctctcaaggatacccgcctcaaccgccgctccgcgtgagtaccccctccccaccctaccgtgtccctgtccccctgcccatttaccatacctgggcttagccagtgctgcctgcaggctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattggtgagtgggaacagccccttggttgggggtactgcatggggcaaaggcctgcaggttggacctgaaaggattttagggccatgtgaggctcagcttcatcatcagtaagggggacagcactgggcaaaggcctggaggcagaccctaggtcctgagatgcctgagaggactggagcctgtggctgtggcagcctctgaccttttaccaccccccctcccccagccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttcccccc

SEQ ID NO: 37177 - DNA, 23778 bp, Homo sapiens
agacgcgtggagcctggcggcgagtgggggcgtgcgacggttactctggttactggggccgcgccgcgctggcgagagccgccgcccgcgagggatgctggtgaggaagccgtcgggagccgccgccgccatctgagggaggtaccctggaaaccaccttttatcggtggggaagtgcagtcgcggtgggcggctctgggggccagcgaaacgggaggcctctaaatctttaggttggggctgcattgccctggagccgcactcttgagtccgaggccatcttttgttggagaaggcgtcggcgttggcgttttcccgaggttgggctgtacagtgtctccgtccgcggaaaaagaagcctctgaacccgcgccggcccgcagcccccgtgccttccggccgctgctcgccgtcgccagaggctaggccacgtttcccccagtgccgaggtgtttctgtgaccctccctccactcccattcccttctgaaagggcacctgctcttggtgagaaaagaaattatagcacgaagagccagtatcagaagagtatccatcacccgcagcaaccgctcagggaacaccatcaaaaaagaaaaaaagggaatatctggatttcctgggcgaggaggagcgagtctgctcgggagctgttccagcaggcgatttttaaatactgctttctacgccctatacaacttggcttcacatacttttacactaactttatatgatttttaaaaactggtctgatcggacttctcgtcctgggacactgtttactggagtctggccggctctccgtgctcctcttggtacctcattttggggagaaccttaaacccactcgagcagataatctccgccttgaccggtgccaccaaagaagccttggaaccatgtggacttttctgggcattgccactttcacctatttttataagaagttcggggacttcatcactttggccaacagggaggtcctgttgtgcgtgctggtgttcctctcgctgggcctggtgctctcctaccgctgtcgccaccgaaacgggggtctcctcgggcgccagcagagcggctcccagttcgccctcttctcggatattctctcaggcctgcctttcattggcttcttctgggccaaatccccccctgaatcagaaaataaggagcagctcgaggccaggagggtaggttgatttcaaagcgggcagatgaatgtcttatttaggagtaggattgggttcactcaaatataagttttatttgaattgcaaaaggcggcaggttagatgcttgtatacattctcatgtattttttattttaaactctgctgtgccttggttacatctttgaccttcttaagaatgagtgaagacatttgtttcatttagcattggttgagcctcagatggaggttggatatttgattatgaaagatggaacgaaatgttagaatttcattttgaaggagaagaacaaccactttccatgatgaaaaagtttttaaaaagttcttgggtaaggattggatttgtgcctgaggaagaaagaaacgtgctgcgggtaagtccactgcttgtaagaagtgacagctgactggggaaagtgacagaacagtttgaaaagcaggcagaaggagaatgctcaacattttgaggcattgggctcaaagttctcctcccccgaatattggagcattgagtaaatgcttgtagtaatgtcctaacataaaggccaggtcttcaaataagggtgtagttgggattcctgcaaagggagcagaggcggccactgggagaagatgagggggaagagtttaggccagatcatttagggcatgttggcaatgagtgttcgggctttttcccaagagttctcccaagaacactggaggattttaagtatgggagtaactttattcggtgtttactttttaaaaaatttttgttttttgagacaaagtctcgctctgtcgcccgggctggaatgcagtggcgtgatctcggctcactgcaacctccgcctccctggttcaagcgattctcgtgcctcactcagcttcccaaggagctgggattacaggtgcacgccaccactcctggctaattttttttttttgtatttttgtggagacagggtttcaccatgttggccaggctggtctcgaactcctgaccttaagtgatccgcctgcctcagcctcccaaagtgctgagattacagacgtgagccacggcgcctggcctgacttttaccttttaaaaagaacattgcagttgctgtatggagaatgggttgtaggcgtacaagaatggaagcagggctatcaggcaagagactatagcagtaaacgcccacttgctttttaaatttttgcgccaccatttctggatgtgagatctttggcaaattgcttaatttctgtgagaatctgttacctcttccattagacgggaatggcaccacccttgctggtagttaatacctagtctataaccgcctgataatagtagctgttaatattagcctaggggtaatatacatctcttagggtgagctttatgagtagcgctgagttcagtgacatggtgcatgggtttgaggaatgggaaaggagggagagagaatccttaatgtttaatttgaacttttttgtattgtggtctgaaataatttcccttaaggtcactgagctctagttcaggtggctggaatgctgttcctgttttcatgctgtgtagagaaattttggagtaggaaaattgggttaccagcaatcaatattggttccattttgtgaacgccccaggctttctctttatttttttgtgaaccagggagttgttagattgtgatctattgactactaagttcccattagtgcttactctactgatcaggctctgcaaggcctgttttcctccagagctctcctttcagggtgtgtgtgtgtgtgtgtgtgtgtgtgtgtgtgtgtgtgtatataaaacaggaaaaacttatgaagaagcacatttttggttaagatgacaaaaggggcttgtcttgccccctacagtaatttaaatatagtcagttctggccattaagacatactaatgggaagagtagaatattgagatcttcccatagtaaaaggacagaaaagtatttttctgagagaaattaaaaaaaaaaaaagaatagacaaattcccagtccactatagaggtaaaagaatgctgggtggatattagaatcacagagtaaagttctaaaggattttaggcttcgtcttcctttttgcttgattattttttaaaaaccccttcaaatggcatttagtcttatcttaatcattaaggtcaaagaactcaaggaaggtggttccttgcaattctgtatctgaaatgtattcaaatgtgtgaatccatctaccaagaagaaatactacaaaattgaattgttcattttaaaaagccactgtgcactgttgttcttagtggtcataaatctctcaaaacaagactttgcatctttttatgatcaaagttaaagttttgctgtcagttcagccagtgacaggtttaatgtttttccttgttccttttttggggaccacctctttgactaggatctcttagagtatcaggatggggaaaaaggagggataaattaaatatgtgcttatatgttaaggaccaaaattgtaaacaagtcaaatctaagagtcggtatgagttatttcttctcttgtaattttgtttatttagataatcttcaattaatagattggtaggcaggatttgacaatccttttgtcatataaaagtgatattaaattaacatagatttttcaaatgaaaatccagaaagagaaaataaagatgaataatgaaaatatctaaggccgcacgcagtggctcacgcctgtaatcccagcactttgggaggctgaggcaggaggatcacctgaggtcgggagttcaagaccagcctgaccaacatggagaagcccagtctctactaaaaatacaaaattagccgggcatggttgcacatgcctataatcccagccactcgggaggctgaggccagagaattgcttgaatccaggaggcggacgttgcagtgatccgagattgcgccattgcactccagcctgggcaacaagagtgaaactcagtctcaaacaaacaaacaaaaaaacaaacaaaaaaaagaaaatgtctaaaaggtgccgaatagtttgtaacatgaactcaaatcagaagttgtaagtgatttgcatcttgtcgattcccaggatatatttgaagaatttagttattaatgatacagtttgccctataataagtctttgaagccccttataaacatttattatattcggcccagtgtggatttctaaatatgtctgtataacattttccaaatatcatgtttagaaaacaataaatatttaattttattgggataatatgacacacttttatttaacgaatattttgatatcattgatttttatatattatctagattttaaaatgtaacaatttgtttggtttgataatatttagtatctagctttagcctaggatgcaaaagtccagtgtgtccacatagcggtagcatgatttgaatctaacaaatttggatacctagtttacctttttttttttaaacagcgcagaaaaggaaccaatatttcagaaacaagcttaataggaacagctgcctgtacatcaacatcttctcagaatgacccagaagttatcatcgtgggagctggcgtgcttggctctgctttggcagctgtgctttccagagatggaagaaaggtgacagtcattgagagagacttaaaagagcctgacagaatagttggagaattcctgcagccgggtggttatcatgttctcaaagaccttggtcttggaggtaggttcatattgattttcaggagagttacgtggtatgaacaagcactcttcacttagaccatcctatgaccagtaagaaggtattccattttattttcatttataaaattttctatactcatttaccaacaaatttgcatgaaagtgagagcaaaggataaaataagcatttaatagtatgattagatgtgaattagacttaatgagatataataaaatggccaaaagattgtaatggtcaaaattaaggactggaaaatcctagaatgagggcattaaattttgtgaaaggcgaagggaactgtcatttgtagagggtatgttgtatacttgttacagtgttattacttagaatcttttatttaagcaccattcatccattcaaccagtgctttttaagcactggctattcatttaggaaatatttatgcactgtctactttgtgtggggatggggtggtggggtggggtggggtggggaaggtgggagagacacaaagaagcaagccctcccctgtctttttttccaagggcactaatcctatcgtgagagtctaccctcatgacctaatcaccttctaaaggctccatctccaaatatcatcacattggggattagagttttagcttaggaattttgggaggacacagacatccagtcaataccatatttgaacattttatgtcactaatatatatactagagtccactttttcacttgacagaaacatatttccaatactgttaaccattctttatcagtatctttttaagcccaagcatagttgtttttcagttgacttcataatgtacttcacttttcaaacttagatgaatgtttaggttattttcagttatccttttttaggtaacactatagtgaacctattcttgcatgtaactttaaagattattaaatattatgtctttaggatgaatttcttacatggatttccaagagtaagattattacatcgaaggatgctaatttcttcatggttcttgataattattgttatattttctaaaatataatattagttcatagtatcaccagtagtatatgaatttatcagttttatcataatctcatcagtgattttgatggtgtcctgttgtttcaatttttacttaattttttttatcgtttgaacattttttctgatttgttcactgtttctatattgctttatatgaatcatccatacatgtttttgtccattactattggcgtcttaatatttttccagtggtttttaatgagtaaattttattatatatacatgtattaatcttttgttctatttcatatgtctttcccaaagtattgttttagtttttatttttaaaattaattttttaactttctaattttcggttggcactttaaaaatgtgatattttctattgaaagttttttatttttcaactgcttttgctgctttagatttaagaaagaagtttttacatgattctgatgaattcagtgttttgtttgctgccatttaaattatttgatgtactaaaaagttctttgcagtttgtcctgagtcacttttaatggatagtatgtaatcatcaacagttgggggataactctaccctttccatttggtttggaaaatctactttttcatatattcagtcattatatataaattggggtttttttttgagtttccatactggttttattttatttttatttctttttggtgacaaatctacatattcatacattgaaagaagtgttaagaaggactaaatgtgttcctatgtctttatggcagaacaggtttactcaggagaggattatggtttatttcatgttgcattttctttctgaagttgaagtggaattacagacctgaaatagttatgttgttatctttaaatgatattacagatttgctaagactctcattgacttccagaagcattcacagtttctgaaatagttacattagttttgttcagttctccagatttgaaggcagagactcatttttgatgtgtgtgtgtcttctttggttcttagtttaacgctgggtgtgttaacagaattgattgttttgaactcgattgctttgcagatacagtggaaggtcttgatgcccaggttgtaaatggttacatgattcatgatcaggaaagcaaatcagaggttcagattccttaccctctgtcagaaaacaatcaagtgcagagtggaagagctttccatcacggaagattcatcatgagtctccggaaagcagctatggcagagcccaagtaagaccacagtttcaaatatataattactaaagaatcaatgcatttaaatttgacctttgtacaaataagattttataaattttaatgaatttttggggcatagtctagaacatatgtatattaaaataaactgtcagtcaaaagagtgttagatattcagtgcttttgttaagaatatcatatagagaattttcctttgacatggaactatgaagagttctcctttgactaaatgaaaattacataatttttatgtgacgggaatttagaggatatatttgtaactaaggcataagtccatttgtgcacattttggagtttgagtttgtggttacgatactttctattagaagtcaggatacaaaactgcaaggagaaatccctgtttcattctcactaaagacccagtctgttaggactggcttcttctcttgtttattaacttatatttaccagtaacctttaaaacactaattgaagaagttttaagcgtgagaaccctcatgtgactgacacagactaaagtattgacaaagcaagtgaagaagcaagtggacttaatcctttggactaaaaagacttgatatccatggaagaagagtatgttcactgtatgaaaatggaaaaatcggccaggtgcggtggctcatgcctgtaatcccagcactttgggaggctgaggtgggcagatcacgaggtcaggagttcaaaaccagcctggccaatatggtgaaaccccgtctctactaaaaataagaaaaaattagccaggcgtggtagcacgcacctgcagtcccagctacttgggaggctaaggcaggagaattgcttgaacccaggaggtggaggttgcagtgagccgagatagcgccactgcactccagcctgggcgacagagcgagacttggtctcaaaaaaaaaaaaaaagaaaatggaaaaatagtcccaaatataaagattataaaaattacctgtgatctttctgactagaaataattactctttcttttttttgagactgagtctcgctctgtcacccgggctggagggcagtgttgcaatctcggctcactgcaacctctgcctcccgagttcaagcaattctcctgcctcagcctcccgagtagctgggattacaggcacatgccaccacgcctggcaaatttttgtatttttagtagagacggggtttcaccatgttggccaggatggccttgatctcctgaccttgtgatccgcccaccttggcctcccaaagttctgggattacaggtgtgagccaccgtgccctgccagaaataattactcttaacagtttgcaggatgcattccaatacttgttttcccctctgtgtatgaatgtatgagggtatgtaaagtttctctgcctatattttattttttaacaaattaatttatttttaacaaattaagatgaaaatccaatgttactttttaaaatatttttaaaatatttaatgattactaatgattactaatgtaatcattagtaatatgtattaaatgttgataaattagaaaataaaaaacacacattggacacgtgtttgcacacacatgcatgtccagtttatatggataaactggagataaggaatttatatttaatttaaattgctgaaatgtgctgctttagaaatgtatttttttttattctttagtgcaaagtttattgaaggtgttgtgttacagttattagaggaagatgatgttgtgatggggagttcagtacaaggataaagagactggagatatcaaggtgagaaataccaaatgtcacctcttcctaagagatgttgtttttcctgctttttcacttacccctttaaaaaagtaggcttaccggtttacatgttgagtatctcttatctgaaatgctagggatcagaagtgtttcagattttttatttttttcagatgtttgcattatacttaccagttgagcatctctaatctgaaaatctgaaatttgaaatgatctaatgagtattttgtttgtcacattactgctcaaaaagttttggatttcagatttttggattagagatactcagcctgtgttatttatcaaatgaactgagttctttctaagccatatgcaacaggatgggtttcagattgcaacacattgttctttagaggacttcagaatgctatgcaaaaaacattttaaacagaactaatgtgaatagtttttgaaacagtaatatacatcagcagagaagcagaggggaactagcaggggaaagaaggcaagattcaacataaaagaaatgattcagataaaatgagcaatttaactcaggtaatagtaagagaatctttttaaaaacaatttatccttttattttattttattttattttgttttattttttgagacggagtttcactcttgttgcccaggctggagtgcaatggtgcgatctcggctcactgcaacctccacctcccaggttcaagcgattctcctgcctcagcctcctgagtagctgggattacaggcatgcttcaccgcatccggctaattttgtatttttaatagagacggggtttctccatgttggtcaggctgctcttgaacttccagcctcaggtgatctgcccacctcagcctcccaaagtgctgggattacaggcgtgagccaccgcacccggccaatttttcctttttttaaaaaaaaattatcgtagtaaaaaacatgtaattctggactgctccccatagggttaccacctcttagaaattgtcctctaatgaaggtgactggaatgttttctctgctcatactgtagtattataaatacatgtagtcatttgtacaaaaattcttctaagccctagctgctgactaaaagcactatatgaagttaggaaattttagaatgaaagaatctggctagtcccttgaatttgtaatgagattgactgctctgtgttacatgcctgccttgtagttgtttcccccattgtctgtcaaagtggagagtaatcccagatggtttgcatgggagggctacaaagggagatgatcctcagggactcagaggaagtatctaaacactggtcatgcgttatctgaagcccacgtaacagtttcttcaatagtattatcttcaactactctctataatgctatctgataatatatctaaatctcttcacgcacattttttaagaatggctttttttactgtgtgtttctgactactaaactgagtagtcttcatttctgttataggaactccatgctccactgactgttgttgcagatgggcttttctccaagttcaggaaaagcctggtctccaataaagtttctgtatcatctcattttgttggctttcttatgaaggtactgtaggagtgtgttattgtaatttcaataaaagaaacttgaaatttgaaaattattaaaacattttctttttatttgttttagaatgcaccacagtttaaagcaaatcatgctgaacttattttagctaacccgagtccagttctcatctaccagatttcatccagtgaaactcgagtacttgttgacattagaggagaaatgccaaggaatttaagagaatacatggttgaaaaaatttacccacaaatacctggtaagaaatagcatcttcagttcttacaaaggctgtgtctaaaataggccagagataaggatggcaggtgaaacattcatccagtcaaccagatattctggaactgaactatttaaactagcacttaaaaacagcaaaacaaactcccaaattaataaaaaaaagtttcgggccgggcacagtaggtcatgcctgtaatcccaccactttgggaggctgaggtgggcagatcacctgaggttgggagttcaagaccagcctgaccaacatggagaaaccccgtctctactaaaaatacaaaattagccgagtgtggtggtgcatgcctgtaatcccagctactcaggaggctgaggcagaagaatcgcttgaacgggaggcagaggttgtagtgagccgagatcgtgccattgcactccagcctgggcaacaagagcgaaactccgtctcaaaaaaaaaaaaaagttttgatatgtttttgtcacataatagcatagtttttagaataattgtttttattggcatatatggtatttttaaaggtagtctctggacacgaatctgactctgaattctttatctcttatacctaaatatttttgtgcttggtttttgtagtaatgacagctaccatttcttgaatgcttactataaagtgtttagcaaacataatttcatttaatctatgtaaccactctgtgaggtaggcattatcattattctcattttacagatgggagaactaaggttcagagagattagttagctcctccaagtataaactattagtaatggcagaaccagggttgatatcaggtctgtctggctcatatgtgcctgtttgaacagacatgtcctgtccgcagaatgtgagaattgtaagggatcttcaggatcatgttagttttgagttgaatataaaggcttcatgagatttagatagctttgtaaaaacattaataaaaattactttttcacaaatctaaagttttcatggtacagtttttaggatctttttttgagaatgggatgatataggaaagaaaagtaaaaaaaatttaagaattttgataaaattgaagggaaaccctcattgtcaattatgatatgattagagtaataggaaactatttttggtatgagtacattttgtttaaatattccgtttttttcaagttattttttaaactaagtgaaaccactttagtaacaaattattaacagaaatgaagtgaaatgaagtgggcaaacttagattttaaataatgacattttcaacatgtacatggaaacatttcaataaattttcatttagttaagccacttttgaagctttcagatggggaaattatgaatatttatgaaaagggtcatccattacctgatatttttagcatttatttttcttttattgtaaatgtggtggtttttcttttttttttcttttttccaatccagaggttaattggagtagagtgccctgaaattatggagagaaaccattggtaggtttatattaatattagttagattaccaaaattctactccttaatatgaatggaataatttttaacagaggcttctgctcctctattcccagatcacactgggaattgtatgacagttcattttctatataagtagcacagaaatttaaagcttgtttggaagtatctcagagatgagctgatcaaaccatttcatttttatagatgaagaaattgaagctcagagaggtagggctggcctcgaattccttttctagtgtacataccctcctgctgtttgtgaattggtagtgtatttcatctgattattacaagaatatattgattataatacattaaatattaaatatgacagtagtctgttaacatttggaagaaaggtaggtggttttctccctgtttcatttcatctgaatttgcctcattgttttttcattcagttgtatgtatgtttatattaatgttctcttagattccttagtcattccttggcattaacagctaagtgcttaatgaataattttattaatgaaataattagttcttgatttatcacaagggatatatgtaacaaccataacagatgtatagtaggcatttgtttatacttgataagaaaatatgtgatactttgaaattgaagtgttatgacccatttctttgggttggtgggatttattgcagatcacctgaaagaaccattcttagaagccactgacaattctcatctgaggtccatgccagcaagcttccttcctccttcatcagtgaagaaacgaggtattattttttgggcttattttataaaggaatcagtattccaaatgacaaatatatgattaaatttatactgttacgaataacttctgggacagatagtttgtcactgtggattagtgcattattaataccaaaattagttttatgatctatttagttgttaacattgagtgtatacaagtattgtgctagtcagggaaacaacaggtaaaaaactgaccttgacctagagaaggcaattttctacttaggaatgtagacagataattttacaacactgttgataaataaaacccacagattcagtgtcaagaagtgtgcagagcagggagggaagcttgtgaaatgggaggggtagttagggaggacgttgttcaggaaacagtggaaacaaaggaccttggacctggaggatgagtgggagttcatgaggtggacactaagatgaggaacttctaggtagatggaataacattgccaaaggatgagaaatggtggcactttcaaggaactcaagcagtttcctatggcaggagcatagggtgggtgtcagagtgggagacagaccattaacatttaatcttacagacaatggaaagtcatttgaagtgttttcttgttactaactttattgatatataattcacaaatcagtttgcccatttaaagtgtacagtacagtgacttttttagtatattcacagtgtgtgcatcaccaccacaatcaaatttagaacatttttatcttgcccaaagaaaccccgtacccattggtattcactccccatttcctcccaacactcagccctaggctacccctaatttactttctgtgtctagatttgtctatttgggatgtttcctaaaggcattgtatagtaaagccctttggaactggcttttcatttagcacaatgtttttgaggttcattcatgttgtagcatgtttcagttcttcatttgtttttatggccaaataatcttccattgtgtggctatattacattttgtttagccattcatcaattgatagatatttgggttgtttctactttttggttattacaagcaatgctgctatgaacatctgtgtgcgagtttttgtgtggacatatattttcatttttcttggttatatacccaagagtgatattgctggattacatagtagttcacgtttaactttttgaggagctgctagacttgttttccaaaatagctgtcccagttacattcctttcagcagtgtgtgagttctaatttctccacatccttgtcagtgaacacttgtattatctttgtgtgcatagccatcctagtagtgtgaactaggccttttatcattgtgctgatttgcatttctctcatagataatgatgttgaacatcttttcatatgcatataggccatttgttgtttggagaaatgtatatttagactttgcatatttttttaattgggcagatttaaaatttatgtattgttgagtttcaagagtcctttatatattttaggtacaagtcccttattagatatgtgatttgcaaaatttttctcattctgtgggttttctttccattcttcttaatggtttccattgaagtacacatggtttaaattttcatgtttattttttctttcgttgcttgtgcttttgatgtcatatttaggaaggctttgtccaatctaagttcaaaaagatttactcctatgttttctttttctttttttttttttgagatggagtttcgctcttgtcgcctaggctggagtgcgatggtgcgatctcggctcattgcaacctcggcctcccaggttcaagcaattctcctgcctcagcctcccgagtagctgggattataggtgctcgccaccgtgcccagctaatttttgtatttttagtagagacggggtttcgccatgttggccaggctggtctcaaactcctgacctcaggtgatccacccacctcagcctcccaaagtcctgggattacaggcatgagccaccatgcctggcctgttactcctatattttcttctaagagttttatagttttacctcttaaatttagctctttgatccattttgagttaaattttgtgtctgttgagaggaaggggtccagcttgatttgtttgtgtgtggatattcagttgtcccagtatcatttgttgaaaagactgtttgttccccagtgaattttcttgcccttgtggtcaaaattcccttgactgaaaggtaagggtttctttcaacaatattttgtagttttcagagtataagttttgcatttcttttgttaaatttattcctaagtattttaccttttttgatacttttgtaaatggaattttcttaaagaggcagtggcatgattagacttttatttcaggaatatactctgacatttttgtggaggatggtttggaggaaagtctagtaaaacatacactaagattaattattctgtcaatgatgataaaaggccagaactagggttgtaaaatgaaaggtaatgaataaatttgggtaatatctaggatgtagaatgtaaaaaacgtgatgatttggatattataatgagagtgaaatctcttgatgtaaattccaggtttctggcttagatagttttgccagccatttgctgacataggaacaggaaaaggagttaattgggttttctttcttttttcttagtttgtcttaaaggtttgctgattttatcttttcaaagaaccaacttttcattttgttatcttttgtatttttttcatttcatttattttggctctgatctttattattttctactaatttggggtttggtttgctcttgcttttctggttgagatgcactgttaggttgtttatttgatgttttcctgcttttttgatgtaggcacttactgctaaaaactttccctttaagtattgcttttgctgtgtctcacaggttttatatattgtctttgcatttttatttctatcaagaaatttttatatttacttcttaatttcttcattgacccactggtcattcaagagcatgtggtttaatttccatgtgtttgtatacacagtctccaaagttcctcatagtactgatttctagttttattccactgtggtcagagaagatacttgatatgatttcaattgttttttgaattttttaagccttgttttgtggcctacccatgatctatccttgtgaatgatcgatttgctgaggagaagaatgtgtattctgcagttgttggatgaaatgttctgtgaatatttgttaggtctgtttggcctgtagtccagattaagtctgatgtttgttgtttatctgtctggatgatctattcagtgctgaaggtggggtgttgaagtctccagccatgattgtattggggtctgtctccttagctctaataatatttcctttatatatctgagtgctccggtattgggtgcatatgtaattgttacatcctcttgctgaattgacccctttatcattatctaatgaccttctttgcctctttttatagtttttgtcttgaaatctattttactgatgtaaatatcactatgctcttttttggtttccatttgcatggaatatctttttccatcccttcattttcagtctctttgtggctttataggtgaagtgtgtttattttaggcagcagatcgttggttctttttttaaatccattcagccacttacgcctttcgagtggagtttagtccatctacattgaatgttattattggtaagtgcgtactattgccattttgtttttgttttctgattgttttgctgtcttttcttccgtcctgtttcctttctgtgaaggtaattttctctggtagtatgttttaatttcttgcttttaatttttttgcctacctcttgtaggcttttgatttgaaattaccaggaagcttgcaggtcatatcttataaccgattattttaaactgatgacaactgattccacaaacgagcagagaaaactaataaaaactctacactttatcctccttgctttttaacttttgtgagttttgtaccttcatgtaattgcttactgctcgttaaggtccttttcttttagattgaagaactcacttcggcatttcttgtgggaaagtttggtgttgatgaagtccctcggcttttgtttgtctgggaaagtctttatttctccttcatgtttgaaggatattttcactggatatactattgtagcataaaagttcttttccttcagcactttcagtgtgtcttgcccctctctcctggcctgtaagatttccactaagtctactgccagacatactagagctccattgtttgttgtttcctttctcttgttgctcttaggatcttttctatatccttgacctttgggagtttgattattaaatggcttgaactagtcttgtttggattaaatcaatcaccaatccttgcttggtgttctgtagctttcttgtgcttgaatattgatatctttctctagatttgggaagttctctgttattttttcttcaaataaactttctaccctcatctttctatctccttttaaaggccaagaacttagatttgctcttttgaaattattttctagatcttgtaggtgtgcctcattcttgattattcttttttcttttgtctcctctgtgtattttcaaatagcctgttttcaagcttactaattctttcttctgcttgatcagttctactgttgagattctgccatgttcttcagtaagttaattgaattttttatctccagaatttctgcttgattcttttaaattatttcagttgttttgttaaacttacctgatagcattctgagttccttctctgtgttgtcttgaattttgttgagcttctccaaaacagctattttgaattctctgaaagctcacatctctgttactctgggattggtcactggtgccttatttattattgttaatttagtgagttcatgttttcctggatggttttgatgactgtggatgttcaccaatgtctgggcattgatgagttaggtatttattgtggtcttcggagtctgggcttgtttgtacccatctttcttgggaacgcttttgaagtattcaaagggaagtgagtgttgtgatctaagtctttggtcatagcagccgtatctgtattaaggggcaccccaagtccagtaacattgtgacccttgcagacttgtagaggtaccgccttggtggtcttgggtaatatctgggagaattccctggattatcaggaaaagaactcttggttctcttcccttactttcccccaaacagagtctgtccttctttgttgagctgcctggagctgtgggggacgggtgacacaggtatgcctgtggccaccatgactggcgtgtgctgagtcagacctgaagccagtacagcactgggtattggtgaaaggcttgtggtgatgactgcctggtcaccgctgatgttccctcaagactcaagagctctacagtcagcacaaatccagccaggcttgtgcccttcccttgagggcagtgagctcctgggggcccaggactggtccagaaatgctgtctgggagccagggcctggagttgggaaacttaggaatctacttggtgctctattctactgcagctgagctggcacccaaaccttaagacatattccttcccactcttccctctcctttcctcaagcagaaggagcctctccccatggccaccagtgctccaggcctgcagtgagtactgcctggctgctgctggtgttcactcaaggctccagggctcttcagtcagctggtggtgaatgctgccagacctgggtctctcccttcagtacaatgggctcccctctcacccaggacggatccaaaaatgctgtccaggtgccaagacctagaatcagggaccccaggaacccacttggtgctctgtctcactggccaagctggtacccaggctgacttttggttcttatgaaggtgctttcctgtgtgggagggggatgatcgccagaggacttgctttgtatacctggatacctgtagattctttttattttcttcatattttaaggaggccttacaaatgtattgacattattggacttgtcattaggtttgtatatgagcttcatgagggcagaggccacactcttgttattaccatatccccagtgcctggccacctattaggtacccaacattgattcaaacaactcttgaatttttgcctcagcaaattttaatcatgatttgttttcatgtattttcacatttttcttattattagcttacatcagtaatctttatacattgagttatcctttttgttttgtctcaagggatgctctaaaataaaatcttcattacctctcttcataggtgttcttcttttgggagacgcatataatatgaggcatccacttactggtggaggaatgactgttgcttttaaagatataaaactatggagaaaactgctaaagggtatccctgacctttatgatgatgcagctattttcgaggtaagatcaattattttgacaaaaatgtctcaaaatggatttatttctgggggttaagagcagtggggctctgatggggagatctgtactaaggaacctgatgctttataatagctcttaggcatcttgcttaggcttaaagaacctgacttgcaacctgtgaatcttagagaatttctaaatttgaatattatgtaacacttgattgctatgggccacttagctcatagtggttgtaaatttagcttcagtgtcatataacccattgctctgaaggtgattttttattttttttgtaaatgataaacataaggcaatattacttgcagatagtccttagaaggataagtatcagtttgaggggattataaacatcagtttgtgcttttttatccttaccatataataaatgagctatttcttttttaggccaaaaaatcattttactgggcaagaaaaacatctcattcctttgtcgtgaatatccttgctcaggctctttatgaattattttctgccacagatggtaagtgtagacactttttagtgaatattactcaattgcagatttttagcgtaggaaaggaataaacaagttagtgatttgtccagaaataaaaatgttacctgagtttgctaactcccaagttggtagttttttaaaattccattttgagcaatagttgtagttttagttttagtttggaaggtagtggaatttccttagacaacattaatagcaatgcctcagtaacatattcattattttgaattcctctggtgcagactagatcatgcttgtcctcacacacacaagactgtgatggaaggtgtttttggccatgtattaaaaggcaatgtagtctttttcttcctaacactagtttcaatttctttttaaagtagtattttataaaatgaatacaagctgttaatcttgtccctgttgaaaagcacaagtaacaatgcattcaccctttacttatttggattattttggtgcttttgttactgtttccatattatacagaggtcacggtcaatgtatatattagagaaaacacaacttagcagaagcagtgttagaaatggaggaaaagaggccaggcgaaatgattcatgcctgtaatcccagcacttcaggaggccaaggcaggaggatcgcttaaagccaggagtttcacaccaacctggacaataaagcaagaccccatctctacaaaaaattaaaagatcagcaaggcatggtggcgtgtgcctgtagtcccagctatttgggactatatagctcactacagtgagctatatatagtgagctatatgaagtgccactgcactcagcctgggcaacagagtgagacttcatcttctaaaacaaacaaacaaaaaattaaaagaaatggaggagaaaaggcaactgtgccacctcctcaccacagcagtgtacacatcagtttaatagtaggttaatgaaactaggcttttcagttttcaagaataaatactgactcatatgccactactctagtatatttgcaacatagctatttgtatgatctggctgaggccctagtgataagtgctgtggttataattacaaaagatgatacaataaaaatgctttctgtagcctctataaccattaactcttcctaaggaaaaaaaacaaaacaaaaaccccaccaatctcactggttatgatttttccaaacaaatttctcttgctaaattggcatagaagttaaaatggctggttgggcaaatgaaagtaactaagtttagagttttgggcaaataaaaagaactaagtttagagttttgggcaaataaaaagaactaaatttaagagtttttctgagctcttctttctaagcttttctaacttcttgagttcttaacattatgaatttaaatctaccaacaaaacaacattttttaaaagttacaagattggaggaggaaagacctttattggagcaaaagtttacctgttgcatcctttactttttaaaatctgttgtaaagaaaaatctgggcatacctgaacagaacattgattctaaatggttaaaaaggttatcaattgattacactacattgtgagggttttatgagttactttgaaaggtattaaaaactttatagatataaggaattattatttatcgctactcacagctctcttcacttgataatttactgcttagttagagatactggttggacatcttagagactgggaatttggtttctagaattgtgttaaaaagagcttccaaagtattttgcatcacttaatgaattaacagcaaaatcaaggaagtaccttttaaacaactcttccaagacctaaatattagtagttatttactaacagaaaaaagtttattcatatttatattactctccataatgctgattatggaattcagaagaaatcctggttgttgaaattctaggactagatatttaaaaattatctgcaagatgtagcgtttgttatttctcattttttctgatatatcattagcatcctacataagtgtgtacacatatttgattattttacaattttattttagattccctgcatcaactaagaaaagcctgttttctttatttcaaacttggtggcgaatgtgttgcgggtcctgttgggctgctttctgtgtaagttgtgatggcacagaggatacaaacctgccagattttcttaggactgttcagttgatgaattactgcaaatctttcttccttacacattttgatattttattatctgttagtatcccaatgagaaggtggcccaaagaaatgaagaaacgcaatatttagtactgttttctttctagggaacagcagttaaaggtggtggtagaggaagctataacccttgattaaaatagaagcttgttttttgcctatggatttatccatatgttctggtctgtgggagccaggaataattgagaaattttaatttaagaattagtttcattgaagtacggggacttatacaacccagtattagttttgagcgtacagacatatgtggaactattcttggaaagtctacaaagtgaaatctatcgagttatttctcatttgcaaagtgatcctttgagtcatttctcataatctataatctgaatgttaatactgatatttttaaaagccctacatcccaacagaccaggccatctagatatttcagcgtggtgtctcaggatgagtaaacaaacagctaaaaatatatgacttatgtaaactagagttacaggagttactagcttttctgaaagggatatattctaagtattttttcttaaaaaaaaaaaaaggggggtggggggtttgctcctgccatcaaacttaacatgcagacatatttgtgacgtcctctaaaatgtagaatgtttcatacagaattatgatgcttgggtaaaaaaaagtaggatgtttgttgagcttcgtagattatatgtaattggaacctttggagtaaattttagtttctgagtcttaccaatatgtatttttttctattacagattgtctcctaaccctctagttttaattggacacttctttgctgttgcaatctatgccgtgtatttttgctttaagtcagaaccttggattacaaaacctcgagcccttctcagtagtggtgctgtattgtacaaagcgtgttctgtaatatttcctctaatttactcagaaatgaagtatatggttcattaagcttaaaggggaaccatttgtgaatgaatatttggaacttaccaagtcctaagagacttttggaagaggatatatatagcatagtaccataccacttataaagtggaaactcttggaccaagatttggattaatttgtttttgaagttttttgtatataaatatgtaaatacatgctttaatttgcaatttaaaatgaaggggttaaataagttagacatttaaaagaaatgattgttaccataaattagtgctaatgctgaggagaactacagtttttcttttgaatttagtatttgagatgagttgttgggacatgcaaataaaatgaagaatga

SEQ ID NO: 37178 - DNA, 57690 bp, Homo sapiens
agtgggtcgcgggcctacggggcgggggcggggcggcagtgagctcggccggcaaccgagggacccgcgtccaggtgagtggcccccgccgccgccacgcgaaggcccgggaccccggcgagctgcggggcctgggccgcgggctggggctggagccggggcggggaggggagggcgggccgggcaggacccgggtccgcaggccgcctccagccccggccccggccccggcctcgacccccactgggaggcgcgcccggcctaggccgcagcctggcgccccggggaaactttgggaggaaagttccggccgggcgtggggcctgggcctgggtcccgcggcccccgcacccttccccctgcggtcgcccggcaactgcgatcccgggacccccggcccggcccccccgagatccccagcccccctgctgccccgctgagcaggaagtggggacgggcgcacctgctcgcggcctcgccctctctcaccacctcaccgggaacagggaaggatttcgtgcgcatttagggcgatcctgtaggtgaggagggcgagttccgccgggaagaagggcagggagacgcagtcccactccgaccctggccttcttgtcccgcaggcctgtgtgcacgtcgtcccggggagggtgcccgcgagcccttgtccgttcccctgggctctgtttttgtttttaatttataaatcttagcagactacacacggttgagaacttgctacctaaaacctatctttggtaatgtaattttaagaggttccttctttcgccagttatattttggtactcagaagaatacgtctttagactttccaagtttataagcccagaccaagactgttaggtcgtcacagcacctcagcctccccgcttcatgggaggaccggcgacgaggcagtgggtgtcggggtgttgcaggctctcctggggtgagggtcacctcccaggggcgtttctatctgaaccgtcctctaggacaggccctggcctagcctggctccggcagctttgggatgactgcccggaacacctggagaaggggtcccattcggtttggttggatagacgtttctcgaatgcctgctgtgggcctggctgggtgctgtgcggccttcccaccagctggatgtgtggtgaggacagcggagagttgaggagcccggaactggtgcaggggccacatgctgggaagccacggccgtccctgctgcccttcctaactcgtgcccatggcctcttttctggctgtcagcctcaactccttcatccggacatgtagcactttgctgataagagaagcaaacgagatcattttcttgttttatgttttgagatggagtctcgctttgttgcccaggctggagtgcagtggtgcgatcttgactcactgccacctccgtctcccggcttcaagccattctcctgccttagcctcccatctagctgggaccacaggcgccggccaccacgcccgcctaatttttttatttttagtagagatggggttttaccatgttggccaggctggtctcgaactcctaacctcaagggatccgcctgcctcagcctcccaaagtgctaggattccaggtgcgagccaccgcgccctgccatgaaatcattttctaccacagtctctgacacctagtgcgcaccccggaatgccagttaccttccccttgttgaggacaggaactttgtcggtggcacttcctccctgcccagcccagtgcctgccacagtgtcgtcttttagaatgtggcaatgagtgagtgagtgactgagtctccctcatagaatttaccctgttttcttcatgtgtccatctattaatgacagctcttaccccagcagacgataatatttaataatgattgttccaggactgttacgagcatgtcgtattcactttctttgtgtgatcttcacaacagtccactgggcaggtactgacattatccttagttcattcatgaggaagctaaggaacagagaggttaagtaacttacctaaaccacacagcagtaaattatgaaatatggatttgaacccaggctccagggttcacactcttaaacactaccctgtactgccttttaatatcaagattttcatttaacattttcgtttagaatattctaatcatgctgcattactctgtgtcagaatttcgggattttgctacatatagaactaatagactttcttttttgtgagcctgagtgtttacaaagccatttcattttttctgaaataaagtaatttaccgtttgaccattcaggattttgccagaataccttccctgccacccagctcctttgttactggcagattcagtggtggtctctgtgtgaagagggaggactgaggggcatgggtgctgacaggcgtacagtccagactctgaggtctccgttctgagttcagttccaggggacttcacacactgccttagagtacacacgtaggacatttttcttccacgcctcgagtgcgttgagagggtcagactctgctgtgttccacatgttaatgagaggtgctgtttgaatgtgaaaaaaatgccacttgactttcatcccagtgtctctcctctgtgccgtccaggagatgccagcagatgggtcttggaatttttttttttttgagatggagtctcgctctgtcgcccaggctggagtgcagtggcgcgaactcggctcactgcaaacgcgaactcagctcactgcaagctctgcctcccgggttcacaccattctcctgcctcagcctcccaagtagctgggactacaggcgcccgccaccacacctggctaattttgggtcttggatttgtcattaaagcttgctcgacttttaaagttttagtacattcagccaattacaaaagtgacattttgtataagggaattgttgacacattttaggttcttatgctgtcttcaagcagggaagctgccatctcctcaaggtgatttctttaatgtccccatgcaagccatgtcttgtctggccgtgcaggcacagctggcgccgtgccttcctgagtcacagcatctttgcgaaggtggtgcgccagaccagggctcttgggtcctgggtgggttcccactggctcctgccttcagtgtctttgcctgtaagacggattactatgtggaatctgtgaaaatataacatcaagtgtctgatacgttgtgggtgcctgggccgcccttggctccaacacctgctgaagctggagcctctcagcagtgcagcagtcacaccctcaggtgtcccgggatctttgggtgtgggctgattttctcctagtcattgtcatacttcctgtttgggtgttgacatttcgtttagtgtttagcacagattgtcaggtacgaggtttaattccaatatgtagtacattttcaggttgatttataaccttatctacactgaaaggaagtcagtatttgaacatgactgattattaaaaaggaccgaagtcctgagttaatatggtgggttctggtttgatagtttaaatgcactttccacatatgctagttgatttgtaaatctgctgtcatttttgctttttcagagtgttcttgctagtgagtttcaggcatggtgtcccggcctctcaggctgctggtttgggctagggtcccactgtggaagcgtggtggtgtcccggcccacctctgcagctcttgataataaaagcatctgttaaatagctcacagcactgtttgcgtgaactttttggcacttctttccttttccttccagattcagaaaagaacttgggatcattcagcagaatgtcacagcatccacattctttccgctggagcttctgctgatgcaaatcctgtgacctctgagttgagctgagtggtggaagtgagcttttataagggactggatctgagactcgtgcctgatgtttgtggctgtttctctttgcttgccttctgttttcagtggaacactcgcttgatgtattttgagaaacaaactctgggatcagtcctgttgagctagtggctggctccatagtttggggcctgaagaggttcccgcaccctcagggcttgtggcggtcatcaggcctctctcctgggtgtaaggtgtgtacttctcacctgcgcactgagggcctgggggctgtggccccgacgctgaggcaagtcaggggtgggaagggtctgaggggctcttggctgagcagacactgagcacatttctttatcaaaggcgctgggactgcaaccttcaggggtgcccagagagcgcctgttgtgggctcatacggggagttcttggaggagcaccaggcagggaggactgtagtgtgtagggagttgtgtggagttttggttccagaaaagacggaggcagctgtagaggaaggaggactatggtgtggaagtgagtgcctgtgctttgtactgaataaacctaaggctgatccaaggctgatcgtgagaaagagccccctgtaacctgggaccttgtgccactgtgctcggccagagagcaacttccattattgccttaaaactagggggactgtgattcagtgacatttcggtgactccgataatgacggcaggtgtcaggtgcgcacagggcgtggggctaccctcttactgtgaaagaggacacgggctgcgtctgtggtggcgagctcctgcgagtgccctggctctggcttggcctctcttgatgatgtagcagagctgggagtctcgctgtaatcatcacccgtcttccaagtaagtctcacctgtgggaaatgctggaacacctgagcggaagcagagccagggcagtgcctgagctggggccaggggaggggtcccagtgcagaggtgcccgaggagccctagcgcctgccccgcagcccctgccccgcagcgcctgccccgcagcgcctgcccggcagctccgcctcttcagtggctcggctgtcagggtagaaggctcctgggttaacatcatggagttttcacccctgcttctcatcagaaaagctgggggaactttttaaaaagtgtgggttcaaggcccagccccagcttcactgagcctgggtttcccgggaggggcccaggaagagatgtgtttaacaagctcgggagggtctggggtgggtcctcagcggggagtccaagtgctggaggcccacggtggggtcaggacccttttttagatcaaggacccctttgagaacttcatgaatatgaataatgtgggtcattattctggggaaaaaaatgaacgaaaaattttttttcctgtttttttaaattttttaattaaaaaaaaattttttttgcagagggtaggggggttagagattggtggttttccctgaccttggtttgaagccctgcctgtaggtgctcaggaagcacagttggcagccacgtgggcaggtctgatgttagggtgacaggtttctcagcacagtggaccccattagggctgcacaggatgaagatgggcacgatggtgaggagggcctggagctgaggccacagagaaggaggcggccagagggcaaggacgcactccagcaagccagccactccttggctgggcaggtgccctggggaaggccgggagccctgcaggacaacagcctctcacctgggtcactcacttccctttgctgtcttaattttcctcccactccctcaccgcgtcctccgcctgctgtggcccttgctgggttgtgagatgtgggtacaaggtgtctccttctcctctagctgcagccgcaggctgggctcctctcggggccgttggttttgatcatcagagatacacagcggcggcgggtcgggggctggctggactgctgctgcccttggagtgctctccctgccctccggcatggctttctgagagcagggcgcccgtgagctgtggggcatgcgccctgtccattgccttcccacccagtctcgtgggccgcattggaacagctttttattgtgttgcataaggagaaggttgattaaaacacatgtttttgtacggaagcgcttgcattcatcttgtgtgtttggaaatacatcgtactgcattacaaggtaatgttcctcgaggtgcgtggtgtatttttggcaattaatattccacaggaagcagttaagtcagcgacaagacttgagggagttgactgtggtgagtggggcgctaggctccgcttccgggacgtcgggccacactggccgcgaggcccagtgggaaggtttgccactccccacagctgcttcttgggaccaagccgggctcacctttgcctgcctctcaaggtcaccctcttggcatggagaatggtaaacagtgggggtgctgctgtctgcacagtgggagaggttcacctgcctttctcagtgtagaaacttcctgcgtgaattctggactgatgcagagtcctcatgtgcacctggcaagtttgcctggctggcacgcgtagcacagggccttcccgagtcagggttgagccattcgtgtgtccacgctggtgtcttaggataaagggctgaaatctgttctttttttttttttttgagacggtgtcttgcctctgtcgcccaggctgaagtgcagtggcgcgatctcggctcactgcaacctccgcctcatgggttcaagtgattcttgtgcctcagccttctgagtagctgggactacaggcatgtgccacctgtaatttttttgtatttttagtagagatggggttttgccatgttgcccagctggtcttgagctcctgacctcaagtgatctgcctgccgtggcctcccaaagtgctgggatgacaggcgtgagccaccgcgcccggcctgaaacctgttcttcagctaaggcgtgttacattctgtgtggtgttagggagctggtttgtgatgagccacgtagagccccacgctaagaagaaccatacaggcctgaagaaggcggagaggttgttcaggttaaaaagcgcagacctagagccagctggttctgtgctcagaagggctgtctcctggagcttctgatgcagttggacttaaccttatttggctaaaggatcaagaaccagtgttcaataaaggtcactcttgattccatcccattgccaccaaaacacagtgcatttaagggcaaaggcctgagcggccagtcgtacgtgcctcactcgtgacgggctgcagatggtgacgaggacagacagccgtgcacataccccttgttaaaaaaggtcattgttgtgaatggcatatgacttgtttatttggttctaaatttatacaaaatctgtaaaaataaccgttaagcttttacaatgacaggaatattaaggcttgatttttttcctcgacaattggcagaaggcgtgtttcagtgagcacagacggagcaatccagggaggtctgggaaggaggaatggggcctggcctggcggtgtccttgacggccctccatcgttgtggggttggtgtttgagaggtagctgtggcgcggggccggctgccattcccgcgtctcctcgcagaggcctggacctgcgcctggggctggcaaagccctctgctctcgctgctgccgccgcctccatcttcctccaccctctggtggggctggtcacaggcagggcatggtcccatgatggctcagccccatggggccccgggacgctgtgtccaggatgggcgccactgccgtgggtggctgttgaagtgaagtcaattcagctgattagcatccagcattcagttctccctcacgtttcaagtgcttgtagccacctgtggcccatagggacgacactggacagatgacatttccagtgccatgggagagtctaagctcagctctgaagctgtgaaatgttgagtctttgttttagttaagttttgtttttttgcaaaagaaacgagattgtggcctggtggccagctgggtgtcagtggggtgagggcttctaggcgtccgggtgatgcatgggctgagtttgcaaagtggatgtgtcaaggctgaaatgctagctgagaagcattgcccacgctaggcttggacacgcagggagggatgaggtgtcagagaggccctgactggtcactcctgccccagggcttagaaggtgctgggtgaagagagctgcgcccctgtccctcagcccctgcccctccccctcagtgccacacggaggtgcaggcatctcacaccaggttctccctgggtccgttcatgtcacagcaggctttgtcttgctgtccatgatttcatgttcccatcctccagccttgatccgggagacctttctgttctttaatttccacagagagctaattctgtccttaaactttgtgactctgatgctcgtaggtgacacttgtttcccttcctggtgctctggcaacctcgcagtgtcatggtggcatctttccaagcatttgagtggccaggttaggccctgccaggtcgccgactgctctggggaaggagaagtcctgcagggatgtgacagtggctttggtttgctccttggccggccccagcctgacctagttctgctctgcactgtggttgggctcacgtgttagccttgaccttgagcggatggcaggtgctcttcagtgcacgatgctgcaccgggaacttcgcttggccctggaagctggtttgatgtgcacgtcggcttgagtgagtgcagggatggctgagcttgcctcttggcttaggcactgaagatcttcctgtgggtcctctggggtcgcttgctctgtggttgtgctggatgtggcctcttgtggagcagaaccaggcctgtggaacccattccctgtgactgccctggcaccttggcttatgattgctgcccccacgccgcagctgcctccctgcgaagctcagcgggaccgcggggactgagggactgtagctccccggccatgcctgaccgcagtgtgatccctacgggaatgagtttgaaagtctctgccagtggctttgacctgtcaggaggaggagcattctttgacctgtcaggaggaggcaggaggaggcaggaggaggagcattctttcaaatggaagtagtgttggatggggtccttagggtcctttctttctttctttttttttttttttgagctggagtctcgctctgtcgcccaggctggagtgcagtggtgcaatctcagctcactgcaatctcctcctcaggttcaagctattctcctgcctcagcctccctagtagctgggactacaggcacctgccaccatgtccggctaatttttgtatttttagtagagatggagtttcaccatattggccaggctggtctcgaactcctgaccttgtgatccgcccacctcggcctcccaaagtgctgggattacaggtgtgagccactacgcccggccccttagggtcctttctaagacagaaccccatcgttgttaatagtgggaacgttttccctttcagcaaaataccacataaggctctgtgcacagttgtttatttgttagtgctgcttgctgatgtatttttaaattatgaaataaaacttatattttctctcttttctttttttttcttttttcttttcttttctttttttttttttttttgtgacagggtctcgctctgttgcccaggctggagtgcaatggctaaatcttggctcattgcaacctctgcctcccaggttcaagcgattctcccacctcagcctcctgggtagctgagattaaaagtgcacgccaccatgcctggctaatttttgtatattttggtagagatggggtttcaccatgttggccaggctggtctcgaactcctgacctcaggtgatccgtccacctcggcctcccaaagtgctgggactgtaggcatgagccatcgtgtctgggcagaactgtatgaacttagaattgatgtttaacctcagaagtgattttagaatctttttgtgatcagtgcactctctgtgtccagcatgtccggggtgccctgcctgtttctgatggacagagtaacaacatgtaattgaacttccagcaggtcgcccgtggtggtcagcaccggatccccagtctcgttcaccaacttcctgaactgtcagatctgctttatttatttatttatttatttatttattttttaagagacagggtcttgttctgttgccctctctggagtgcagtggagcaatcatagctcactgcagcctccaacacctggggtcaagcagtccttctgccttagtctcctaagtagctgggacttataggcacgtgccactgtgcccagctaatttattttattttgtttttttgtacagacagtatctcactgtgttgctcaggctggtcttaaactcctgggctcaagccatctgccaccttggcttcccaaggtattggggttatagatgtgagccaccgtgcagggcccacatctgagaaaaacataaagatgggtttgtacgacttgagtccaagtcttcataccagtggtaggacattttgagatcctggtgggacggggacagcacctttaagaaagtgtgctggggtccttttcaagggactggtgagttccctgggctaggggaactgagactcactggggcctgcagggatggcgtccttggggccaaggaagtgccccccaaccccccaaaaaaaaaatctcactggagaaggacaaagggcaagaggccagcagagatgcccagcacagactcaggccccagggtttttctctagaagtagaaaagggagaagttgaacagaaagagccccttaaaacagacagaaaaccccagcaaagtttgttcctgaaatactctctctggggattgttttctgagtgcaaagtgagatctgcgcgtggaagaacatattcaggaaataaactctgccttcctaatgctttttcttaaacatttaactttctgtatattcctcaactttgatactcaattatgaagcctaacttttgctttttaaaattatttttgctttttaaatttttatttatttgttaataaaataaacagcctctgtcgcccaggctggagtgcagtggcgcgatctcggcttactgcaacctccgcctcccaggttcaagcaattctcctgcctcagcctcccgagtagctgggattacaggcatgggccaccacgcctggctaattttgtatttttagtagagaaggggtattctccatgttggtcaggctggtctgaactcccgacctcaggtgatccacccgcctcagcctcccaaagtgctgggattacaggcctgagccaccacacctggccccacccaggcctctgagaagtccaggggtgggcagatgggagggaggaaggactgaggacctggctggggcaggcgctcctcgaccccatggggccatctgtgcttcccagcacaccctggtcctcctgtcttttctccctgcccccaaggctcactctgagctcagctccagggttgcccccttaggaacttgcccaagaagggccctcctgggagcaccttcgtgaccggcttcatgagggcgggaccaccacagttccacctcaaggcctggcaccaggtaggctctctgtgagtgtttgttgaatgaatgagtaggatcatagttgtcttgcatagtcatctgtatagttgggtagtagtatgggctctggataaggcctcttcatttttctgggccttggtaagtgtagaaggagacacagggtgtggtgcctgttatggcaactccttcaggagcgaccgggaggctgtgttggaattcactgtcgcacatgcagatgtgggggtctgagggcactgtgacctctgggtgtccctttggttgttgaccggaaagccctccccaggtgggtcttcagtcttggttggaccacacggcacaaacacacagtagcaggcgacatcggtgtctcagttgtccagctaagcttgtgtctggcatcttaatcctcattttaaagatttcccataagctgtgattgatttacctttgacattagacttttgttataggcaggggagcattttaaaaaaggctagcgggccaggtgcagtggctcacatctggagtcccagcaccttgggaggctgattcgggaggatcacttgagtccaggagttcagcactagtctgggcaaaatagagagaccctgtccctacaagcagttttttaaacaattagccgggtatgatggtgtacgcctgtggtcccagctactcaggaggcgggggtggaaggatggcttgggtgctggaggtcaaggctgcagtgagcggcgattgtgccgctgatgtcagcctagatgacagagcaagaccctgtctccaaaaataaataaataaataaataaataaacaagcaaaagggagaataaaatggtttctaattctaacttgccttctattctgggaggcttttcacatagtgcagagcaatagattttttttttttttttttttttttgagacggagtctcactctgttgcccaggctggagtgcagtggtgcgatctcggctcaccgcaagctctgcctcctgggttcacgccattctcctgcctcagcctcctgagtagctgggactacaggcgcctgccactgcgccggccaccacgcccggctaattttttgttttttagtagagacagggtttcactgtgttagccaggatggtctcgatttcctgacctcttgatccacccgccttggcctcgcaaagtgctgggattacagacaggcgtgagccaccacgcccggacaattttttttttttagggttctctcaaaaagatattcatactatcgtgacttttttttttttttttttaagacagatttttgctcttgttgcccaggctggagtgcagtagtgcaatctcggctcactgcaacctctgcctcctgggttcaagtgattctcctgcctcggcctcccgagtagctggtattacaggcatgcgccaccatgtctggctaattttgtatttttagtagagatggggtttttccatgttggtcaggctggtcttgaactcctgacctcaggtgatccgcctgcctcggcctcccaaagtgctgggattacaggcatgagccactgcgcctggcctgtcgtgacatcttaaaaatgagcaggaatcctcctaccatcagatactcactgtgtttagatttccactgtcttataaatgtctccatgaaatcctgtctgcctgtgtgtaggccttgtttgcatcctgtttcaagcgtcattttaattggtatgcctttttttttttttttttttttttttttttttctggagacagggtcttgctctgtcactcaggctagagtgcagtgatgcaaccatggctcactgcaaccttgatgtcccaggctcgagtgatccttccacttcagcctcctgtgtagctgggaccataggtgggcgcaccaccacacccgactaatttttgtgtattttgtagagatgaggttttgcaatgttgcccaggctgatatccaacccctgggctcaagcgatccacctgcctcagcctcccaaagtgctgagtttacaagcgggaaccactgcacctggccagtatgtcttttttttaaagacagcttttttgaggtataattggcatataatcaattgcacacatgtaacatgtacgataggttttgacacgcatgtgcacccgtgaaaacatcaccataatcaagatggtgagaagccttccctctccttctctctttctgtctttgtaattgatttgttggagagactgggttggtcgtgcatgggttttgctaactgcacccccacgttcgcaggtagtcgaacatggtgtgcccacgcctaagaagtggctgctcagtcaaagtcacgaggtttcctttctcctcccgggcgcctcctttttcaatgtggttgattttctgcagaggccagctctgctgggcgaggtgccaggggtccgggtgctgctgctgagtcgccgtggtgtggcctctggtctctgtacttccctaggttgggaagtgtgttaggctgttcctgggttgctataaagaaatacctgagactgggtaattgataaggaaaggtcgtttaattaggtcgcggttctgctctacgggaaacatggcgctggcatctgctcagcctctgaggaggcctcagggagcttttactcgtggtggaaggcgaagcgggtgcaggcgcctcacatggcgcgaggaggagtgagagagacgcctttaaagaagcagatctcatgggcactcatccttgcccaggaccaggaggacagcaccaagccgtgagggatccactcccatggctcaaacacctcccatcaggcctgcatccaacaccggggatcacatctcaacaggaggtttggtggtggggacacatccagaccatgtcagtagataaagctagaaactggacaaacctgggctcagtgttccgggcaaaactgcttcagcagtggcagtgtcatctctccccgggaggcacccaaggccgtctctcggggttcagtgcctggatgtgtgaattctccagtgtcgtctaatggtgatggtcacgcacctgtgtgccttgttcatccatttgctgggatgcttccataaagcgcaatttcctcacctgttacctggcgacagtggcacagcagtgtgtgtagggaaggcaggatgctatctccttgattgccagtttcaaaataacttgtgggcttactggcatcatccaccatgaccagttaatctcctttttaggatcttaggaactctggacttgaatgtattcaccgtgtttcagccttttcccatgtactggtgctcagattgtctcctctttcttgtgggagcttctgtaggttcatcctgagtcattcggtgagagcccctggcgtagcctgtgttgtgctgctacagcagtgccacaggctgggcagtttagaatgagcagcaatgtgcaggctcctcgttctggagtctggaagtccagtccaaggtgctggtgtctgctgagggctttcttgctgtcatctcatggcagaaggtggaagggcaagagaggagggaagagagcgggagagagagaggagagagggaaagggagggagaaggagggggaggcaaagggagggggagagagcacactaaagggggccaaactcgcccttttatttatttatttatttatttttgagatggggtttcactcttgttgcccaggctggagtgcaggggcgtgatcttggctcactgcaacctctgcctcccgggttcaagcgattcacctgtctcagcctcccaagtagctgggattataggcacttgtcaccatgcctgggctaattttttttgaatttttttagtaaagatggggtttcatcatgttggccaggctggtctggaactcttgacctcaggtgatccgcccacctcagcctcctaaactgttgggattacaggcgtgagccaacacgcccggccgactcacccttttataacagacccttttataaaacagcattaagccattcctgagggcagagccctcacagtcccaccacctctcaaaggccccacatcctaacattgtcacatggcagtcagatctcagcatgtgtttggagggacgcacattccaactctacaccccagtctttctgggcaggcagcttccttgctaccatggcaagaggagcccagtcctggattcagccgcgtctcctcaggaagccctggctcctcagtgctctgaagggggaagcacatcgctgcagttgtgaaggggacctgagtgagtgacagcaacttctcccgtctgcaagggcaagcacaccctggccgtgagcagggctgtctgcgccggccttcaggggctgccgcagtctggctgggaaggagggaggaaccgggagacactggagagtctctcaggggacgtggtggctgtcctgttgtctggagggaagcagctgctgctgccccgtgcggctgtggcagggctgcgggatgagccgcttgaggggtcacccagcactgggggccgttctcgccccggcgccctcaccctcagaactgtgcagagagctctgggctggtttttgtatttttgacacaagtaaggatgctgattttggcttccttctcttgtcgttcatcaaacgctgcttttcctgatgggagacactaatgtgcatgagttctagaatattgagctaaggtcgttgtgagaaaatgtaagtttacttcagtttatcctgggagtagctaacttacatagcagcctcaattctctagaattgatgttggtttcaggtagttgtgaaattttagacataattttccatttacttatacagccacttgttccagcctctggtgaatgtttgcaatgattttcagcaaaacttccagagccgtgtttgaacctcggatgctgaacacctcattgaagctcacctgctctctctgactgcccccatgactttttttttttttttttgagatggagtctcgctctgtcgcccaggctggagtgcagtggcgtgatctcggctcactgcaacctctgccttccggattcaagcgattcttctgcctcagcctactgagtagctgggattacaggtgcctgccaccacgcctggctgatttttgtatttatagtagagacagggtttcaccatgttgtccaggctggtctctgaacccctgacctcaagggatccacctcaagggatccaccggcttcggtctcccaaaatgctgggattacaggggtgagccaccacaccctgcgcccatgacttttcccaaattaatgttttattgttttcttacataactgtagataatgcttttaattttattttaattttattttaattatttatttgtttatttatttcgagacagagtctcattttgtcacccaggctgaagtgccgtggcacgatctcagctcactgcgatctctgcctcccgagttcaagagattctcctgcctcaccctcccaagtagctgggactataggcgtgcgccaccacgcctgtataatttttgtatttttagttagagacagggtttcaccgtgttggccaggctggtcccaagctcctggcttcaagtgatccgcccacctcagcctcccaaagtgctgggattacaggcgtgagccaccatgcccagccaataatgctttttagaaacaactcttgttatagggctgaattattggtctgttattcattgattgatcttccgttataaatgctccctctcgtttactttttgaaattatgtttgtgatgtgataatttattttactaatttgcttacatggaatttagattgattttaggatggtgaatgggtatttttaaaatgtttttaaaccgtgaaacttctggaagctaagtatgccaaaatttttttccctttagatcttcagtgtctattggatttttccaagagaaagtttgtaaaattccttacactgtagatgtggatcagatacgatgattcagtagaagagcacatgtcaggggcagtggaggctggctgctgaaggatgaacggagaggaagaattctttgatgccgtcacaggtgagtcaaaagagaaccaactggggacgtactggaagggtgaacgtccctggattcagatgttggacctggcgtttggggtgtaaagatgctcagtaaagcagtgtgtgggtgagcgttcacgatcccaaacacggactgttcagcaaaacctgacatccatctcagaggtgggaaaagccttgactttggctgacagggtttaagtctcccgaagagtttcctggggtgcggatattttcatttgtctcctgagatagccatcttcttcccctatttctgcttcatgatgagaacgttctagatatgatgaccctgtcttgcttggcactgcttgatgcatcccatcagacagcaaacccctgggtctgcagctgcgctcacagccgcagagtgcagttatttttttctttcgcacgatggtttaaagtggcggcatgcagcctgtggtctgaatgaaatcctgtggcctaattgaaaagaatgtgttttggcatccagtcactcaaaaaaagaagaaaatgaagaccgtgttgcagggctcatgggcatgtgacggggcggctagaggaaagggcaggcggggctggcagcttggccttccagagccgccccttctcctggcacagggaagagcctgaaaccctttgagctcgtgtcttgtcaggtcctcatgttcattctccactcttctgtgcctcggagtcagcatctggaattccgcttgttttttctggaaaggaccattgctggtgggaaggggcatcaggagattctccttgatgttcccttgtccttaggcgtcgggatcagaaaggagtggctttggaaatgtggccgcaggccaggaattagtgatgatctttagaagcacttctgcggttactgccgctcaaggatctgtcagggtctctatggccatgccccaaggacacggcgatggctccgttggcacctccagtctgtggccctgccagggtgggtgtgtcaggagggtctctgtggccacaccccgaggatgttgatggctctggtggcgcctccggtccgtggccctgctggagcgggctgattgtcccgaggctgtgctgctcctgtacctgcgctggcagctcaagatggttgacttactcttatccaaaaccccaggagaaggggatgatgcgctccttaccggcttcaaaggctcaatttcgaagtcattttccatgatttcgtagctgaattatctgcagcgtgtttgcctcggatgcactctcagaggagggtccatggagcttgcaactcatccatggtggttctgtgttctctgctgaatcccacacagcggagggattgtcaggctctcacacccttgggctgacctctagtgggatgccacgtctgtcacagagagcgcagccttgaggtccctcctctcctgggagtctcataggatgtcctttttgtctggggtcttggtgtgactgatactttcccgaatacctctggccatttttttttttttttttgagccagagtcttgctttgtcgcccaggctggagtgcagtggcgtgatctcagctcactgcaacctcctcctcacgggttcaagcagttctcctgcctcagcctcccaagtagctgggattacagacgcccaccaccacgcctggctaatttttgtacttttagtagagacggggtttcaccgtgttggccaggctggtctcgaactcctgacctcaggtgatccacctgccttggcctcccaaagtgctgggattacaggtgtcagccactgcgcctggccaactctgagctttttgagtcagtttgctgtgacttcccagggttcccagctgtgtgtgatgtggtactcagatggactccactgttctaggagccacagggtgtgcggggctgtggggcgttgctcctgcatggcaaggcctctccatgtgtccccaaggatgaggtggaagggacagacatctaggtgacaagaattttccccctcagttcttgggcttcaaaacaaataatggaaggaaaaaaccacttcatctctttatgcgatgaaatacccgtgctagaggtagactctcgactccttcaccgcctataatactcatctgactttgtaactctaatttcaaaagtatgtaaactaagcagttattaaatgaatgacttcattaggcatttaatttgtcttaagaatcagtgccattcaaaggaaaggtttggaggacatgaacagtgtgtatgggattaagggctatgaacgcagaggggctaataaaaacaagggtttccgagggagccgacgataggagatctcagcttcctcctttgctcatctgtattttctgtttttctacaataaatgcatgtggtgtcttagaatgttattaggccatccgagtagcgttggctgagtcggaggctgtggtggctgccaggtcttagaatgttattaggccatccatgtagtgttggctgagtcagaggctgcagtggctgcccgggatgtgctgctttattcttcggggtgggggcaggtcctgccccacggaattcccttaagtagggaatgtttttaagataacttcagagtgagaagttagagatgttgattttgggacagagagcaaaacatgagagatggcagggtatttcagaaactgtgggccatttcaggattcctttttaacccatcctctcaaaatcacgatgtcatccaccccagcactgcctttatggatggactctgctgtgtggaggggcaggacacagcagctttgctttgttcttctggagcctgtggcagactcatctgcgtgtggggtccgaccacagttgtctacctgaccctcccgggcttgtgcccctcacgtggagccctcagaccctggaagcactgggtggttgccggctgctgcaggcccagagcccccatggaataaactcatcgcggggacccagcccccactccacccggctctggagcagaacttggcccttccagcaactcagactgacaggagttgaagggagacgtatgttcctgttccctagttgcccgttctgtcctggggaagggcccaccccaccagggcagcggccggccgttcttctccaggacttttgctccaggagtgcatgcatggctggatctcactcacattctaaagagctccttctccagagtcccccttcatccggagtccactctgagtccagtcacatgtgtggcatttccatgattgttccctatctgggtacagtttagtggtgcctttgcgtgccacgatggtctcccttgaaacactgtcagcaggcgtgtttcagaccaagacgcagaccttggtcacaagccctgagccacaacgggcgcatcgcagccttgggatgggtttgaatccgatagaagtggcccacccagagcatgtaggtcacagattaaaatgatgaaagggttccttctggaagatgaagctcatggcctgggactggacctcaaatcacaagcgtgggaggagcctgggcactggagctcgctgggagcgcgttcttaggagggaagctccgtggcaccctcctgttctctctgtaccgtgtctgcttctggagaaccagagttaattcttccaaatgtgtccgttcacacaactgagctctgtagtcacctgcttgcatagtcagaattcttggaggtaggcttttaaaaaatctttcaggtccagcgaaaatgaccattttcttgtctcgcacaggctttgattctgataactcttctggggaattttcagaggcaaatcagaaagtcacgggaatgattgacttagacaccagcaaaaataataggattgggaaaactggggagaggccctctcaagagaacggaattcagaaacacaggtatgttctctcacgtctgctgtttctaaaatgtgtctgtaatcaccccaaaaatactctgcagggtacccctcagccctcacgagcattgagctggagtggcacccccacagctgtctggcctccccatccggacagcctcctctgtctggccagcaagggttcagagagactccatgcctctcttggctcctggaatccacagatggcaattttttgagcagtgcctttccccatctaagaaatgcctctgttcccctccctgccctcaggagttgctgtgagaggatttggggtgacacaggctttgtcagggcctggcaaacagtacatggcgtcttgatcatcagaccccttgctgatttcctacagatctgcctgcttttccatgggcggccaagttcatcctctgtctcagcggagttctattgcagtgtgttcagctctgacccctacaggacaagaagcgtttaatttccttgttgtagcaagacctcattccctttcctcctcctccacgttcgttttcatgtaggtagagtccagtgacagtggccatcacaagaagtcttcagtccttggctggtcgcggtggctcatgcctgtaatcccagcactttgggaggctgagacaggtggatcacttgagcccaggagttggagaccagcctgggcaacatggcaagaccccactgctagaaaaaaattaaaataattagctgggcatggtggtgcacgcctctggtcccagctacttgggaggctgagtcaggaggatcccttgagcccagaagttcgaggctatggtgagctacgatggcgccgctgcactctagtatgggcaacagagcaacaccctggctcaaaaaataaagggaagaagtcttcagtctttgttgatagaagcacgagccaggcgcagtggctcatgcctataatcccagtcctttggaaggccgaggtgggcggatcatgaggtcaggagattgagaccatcctggccaacatggagaaaccccatctctactaaaatacaaaaaattagctgggcgtggctgtgcgcatctgtagtcccggctactctggaggctgaggcaggggaatcacttgaacccgggaggcagaggttacagtgagccgaggtcacgccgctgcactccagcctgggtgacagagtgagactccatctccaaaaaaaaaaaaaaaaaaaaggcacaaaggcaggacaagtgtcaggtgggacaggcagtggccctggagctggtggcattgcgttgcaggctccaggcacagccgctaatgtgtgtctcagctccagggagctgctccagcctggcctcaggctctccttcgagctgtaggcccacacgcctgcttggtgggtccactctggcacccacatgtgcatctcacctgttgtttgttcgttctctcaccctacagatatgggagcccccacccccgctcctgcattccccgttttctagccctgactctgtggtcgctttaaatgctgttaggtccttcagttcttccatttgctctgcaacatgcccgtctacccaaccacccttgtttccagagtggcctctgcatccctgccttttattcctgttgttgtgcagaggcatttgtgtatatgtgtatttattgtgtttgagacggagtctcactctgtcgcccaggctggagttcagtggcgtgacctcggaaacctctgcctcccaggttcagatgattctcttgcctcagcctcccgagttgctgggattacaggcatgtgccaccatgcctggctaatttttgtatttttagtagcgacagggttccgccgtgttggccaggctagtcttgacctcctcaagtgatccacctgcctcggcctcccaaagtattgtgattaaaggtaggagccaccatgcccagcccagaggcacttttcaaaagacagatctggaccccccccccaccccgtcaccctctgcctaaaactcaggcaggatgaccacatggccggcctcacactcctgctcctacagaactgtgaatggcgccctgttatactagaagaaatgacccagctcggacagtgcaccatgtggtcactcacctcttaggaagaaagccagcaccctcacctgtgccctcaggcctggccccgagccctgttgcctcccgtcccagctgcaggggcctctttcaggtcctcgggtgtgtcagctccctctgctcccttggcctggggcctcttttctcttctttcatgtctgttgttcctacgcatcccatctccatgcagggtcgtatccttgggggatgcgacctgaccttctgcagagccactttcccctcctggtagcacctccgaatcacaaagtattcactgaatgtgtgcacggacgatggcggagcagagctgggtgctggcttccggcagcccgggcctggtactcagcagatgttccttttcttttccaccctgcctcatagctgccatgtcctttccctcctgccccctgacaccagtagtgtgccctgacccagctgccctgacgtggcattcccggggcatagctcgggagcagagcagacaagagctcgtgctttcatcactctggaggtcagagtgttggtgccaaggttctgctgggtgtgaggcaaaacgcccctcaaagcagcttccatgaaatgggagttcagcaggagagccctggggtgtccctggagggctgtgagcagcagggagccccgggcccctactctgcagcaccttctttgcaccctgctctgtggtgtcctgtgtgggtctggcacgcctctccccaaatccaagtttatgtctccattcaggcgctcccctcctagatggagacagtatctcattccagctccacgttcctggtggggagaccagggccccgggtcagtggtcccggttgatgagtggtgagcagtggtgggggtgagggtctcctggtgcaagcatgagggcatgggctccgccttgcagccgactggaagattacctggaaagaaatgctcctcaggaaagcaagcacgtgtttaaagggcggaacagcttttaattcaggtcactcttgctgccctcttacctctgcctgtggtctggccgctgccccagggacccagcaggagcccccagaaggctgtgggctctgcgggcagagggactccctccagctgccaccctgtcctccagctctgagaggaaacaacagcagggccactgcggggccaagactgcagagtcatctttgttgtcatgaccattcccaggaagccctgggaacatgggtgtggaaggcctctaggcagcagtcgtgccctgtgtccctaggcatgccagaatgtagaaatgccaatgtttaggagtaaaaattaaagagaaatcgtcattgagcacagcctccttgagtggtcagagtcctgtgttgaattcacccacacgcaccccttttgtgcttcgcaggacatcgctgccggctcccatgttcagcagaagcgacttcagcgtgtggaccatcctgaagaagtgtgttggcctggtgagtccgggggcccgtgttcacacatggggctgcaccactgactcctgggaaggtattgcagtgctggtggtttaagaaaatgcgctcttggccgggcgcggtggctcacgcctataatctcagcactttgggaggccgaggtgggcggatcacgaggtcaggagatcgagaccatcctggctaacacagtgaaaccccgtctctactaaaaattccaaaaattagctgggcgtggtggagggcgcctgtagtcccagctactcgggaggctgaggcaggagaatggcgtgaacccaggaggcggaggttgcagtgagccgagatcgtgccattgcactccaggctgggtgacaagagtgagattccatctcaaaaaaaaaaaaaaaagaaaaaaaatgcactctcatgtttataaacagcatgagattaagacaataaaacaggaaaagaacaagcaagtcaggggaagaggtgttctgtaggtgaaacgggacataagaaccatcctgcaagcacccatccagccctgtggcctgcgtgaggtgggtggggcttccgtggcaccctccctggccacatgctgagctgcaggaggggtgtcagcctttgtcaggtgctcagggtttgggacagaaaaaccagctgggaatgagcacccagaagttacagactttccctttcatgatctttcctgactgtgagaacccaagctgtgcctcacaggggcggggagtgtcccgtgcctcctgtaccgtgctggttcctgggccagcgcttgatgcctgaaaactcacatggcctgggaatacgtgtcactcttgcccagaccatgtcttctagtgctggtgattttttgcccttatctgttttagtcctttttttttccagagggaacttcactttttcttaactttttattttgaaataattttagacttacggaaaatcacaaaatagcacagagcattcctgtagacccaccacccagctcccctgatgccggcatctctcggaataaccataggtcagtgaccaaagcaagaaatgcatcttagctccacatgtcacttgtatttcctcagtgtccccgatgtcgtttcctgtcccaggaccctcatggcatttgggctcctccacttggtggcagctgctctggtctgttacttagtggacttttccttaatttgggtttgtctgatgttttcttcttagaatgaggttctgtatttttggcacacacagaagtgaggtacccttgccagggccttgtctgaggggctctgtgatagccgcatgtcttgttagtgggactgttaacctgatcacttggtcaagtgtctccactgcaaagttgctgcatttctctttgtaatcaatgttttagggaagacacttggattctgcttgccaattgtagcatccattggtgggttttactgaaatcattctaatggagattttccattctcgttcgttcttctacctttattaattggaattgttctgtaaaggagagctgtcccttctcccctaattatatatttattcagttatttatttgtattagtatgaactcatgagcatgtattttattctgtgagttgaattccagtatagtccttatttacggactataaataattgctcaaagtgttctacctttggtgttgagagttcttctaggttggtttcccccttctgctgaacccccatccttttctgaacacttatttcaggcactaaagaatgctctagttcagcttatattttccctgccttaaccctggaatcagccacttccccagggagcccattcactgggtaatggtgtttagaaaccacaatccagtgctgggtgagctcattgctgctgaggtatcattgcctgcaggccctctcagcagacagcactggaaaatacgagtgtgctaatgctcatgcatacacatctgtatttctgtatatatctgtatgtttcttttaaaataaaccatttgagattttttttctcttttctgcaatgttttttgtacatttttgactatgtggataattcaggtcttgacaaaaatatctgtcttggtatagatgaggaatgtcttttgtgaacttgacaaaccacctaattttgactctcttaaattctgagacaggctgggtgtggtagtagctcatgccctcaggaaagctgagggaagaggattgcttgaggccaggagcttgagaccagagcctgggcaacatagtgagaccccaactctacaaaaaaatttaaaagattagccaggcatggtggcacatgtctgtcatccagttactggggaggctgagacaggaggatggcttgagcccaggagtttgaggctgcagtgaactgtgatttcaccactgtgctccagcctagatgacagagggaaaccttgtctcttaaaaaaaaataaataaagattctaggaccaaaagcatcttttcaacaacatgaagtgatgtatattgcattccctaggtgagggttgtggagagattgaggtgaaagtttcatgtgagcacgtaggactggcaagcatagtagaaaggcgctgggaggggccttgtggggcagctccaccccttacacttcactttgaaacactcccctttggaggctttggtggcactccactctttttactacttctcagcttgtattgaaaaaacacaagcacacttggcaacgtggacagtcccaacatagacagactcagacagtggtgagctcatgtccccatagctggatctgcagtgattggctgtggctcgttctggatccgcagtgattggctgtggctcgttctggatctgcagtgattggctgtggctcgttctggatccgaggtgattggctgtggctcgttctggatccgcagtgattggctgtggctcattctggatctgcagtgacgggctgtggctctttctgtttggtccacaccccccacttctctcctccctcgtattttgaagcaaattccagacatcttttgtttgtaaatatttcttatgtatatttaaagggtaaggattcttttttaatgtgactgtgatattattattatactttagaaaataactttagaaagtcatttaatatcatcagatactcaatctatgttcaaatgtccagtggtctcacgtgttgccctctggtgtttgcagtcctgtgtctggaccttgtttgtgtccctctgtcaggaagcctttttgttgctctttctctgaatttaaaagctgtgggcaggccaggcgtgcgacggctcacgcctataatcactgtcagaggctgaggcgagaggatcgctcgaggctacgggttcagaaccagcccgggcaacaaagtgagatcccatctctacaaaaaagaattagccgggcatggtggcgcatgcctgggctcccagctactcgggtggctgatgtaggaggatcacttgagcctgggaggttgaggctgcagtgactggtgatcacattactacactccagcctgggtgacagagtgagaccctgtctctaacaaacaaacaaagctgtgggcgctcagagtctgggtccactaactcactgggagttgctagttggagctgtgccaacatgatcaccctttattgattgccggggatagttctggatgtcttccagtccacaaattgttccatctttggtcagtgagagtctcttcaaggtggcccggagtcctttacaaaaggagcttcaggcctatcctgtgcgtttactgtttggggtctggcatcatctacttgtccagggagagaaggagaattcaggaccacagccgggctctcaggaggccaccggggtagtcttatttcgaggtctgttcctacagctaggaactgtgtttttgtttgtttcagtgatgcttcaaatttgggccaacaggctccacctaacctctgcggcctcatgtctgcgtctcttttctccctcactgacagtcccagttttctgcagccctggcgaggacagatttagaccggcacgcagttgtgactcactcactttgccccacatacctgtgggaccagctctgctgccgacagtgtctttgctgagacagcacatgtctgtgcctcctgcagttgccacttgtcattgtcttcagggtatatctcaaatgtctgcattattttttatttatttatttttttgagggagtctcgctctgtcgcccaggctagagtgcagtggcgcgatctcagctcactgcaacctctgcctcctgggttcaagcaattctcctgcctcagcctcctgagtagctgggactacaggcgcctgccaccgtgcccggctaatttttttttttttttttttttgtatttttagtagatacggggtttcaccttattggccaggctggtctcaaactcctgaccttgtgatccgcccacctcggcctcccaaagtgttgggattacaagcgtgagccaccgcgcccggccaaatgactgcattttaaaaccacctgggtgcttcttcgctgggtgattgtgccaccaaaggaatgacataggttcatttgtttcatttttgatattgagagatgactttttaaaatttaattttctttttaaattatgggtcctgcatcaaatttatcaagcaaggtatattccaggagagtcagcttcctgtccctgtcccctcctggtgctctctgctttccccacaggtgaccaggagccaagtttagggcatgtctttcatgcgtcacacagctgattctacatgtatcttctccccacttctccccacttctttacataaatgagaggctttctccaccttttaaaattcaatagtatatccatagcaacatgcagtgacttcttaatctatttatttatttattatttctttttagagactgagtcttgctgtgtcgcccagtctggagtgcagtggcaggatcatggctcattgtaacctcaaactcctgggcttaagtgaacctcccacatgagcctctggagtagctgggactacaggaacccaccaccatgcccagctacttttaaaaaattttttggcagtggctcacgcctgtaatcccagcactttaggagtctgaggcaggcggatcacgaagtcaggagttcgagaccagtctggtcaacatagtgaaaccctgtctctactaaaaatacaaaaaattagccgggtgtggcagtgcatgcctgtaatcccagctacttgggaggctgaggcaggcgaatcgcttgaacccaggaggcggagaggttgcactgagccgagatcacaccattgcactgctgcctaggcgacagtgtgagactccaactcaaaaaaaaaaaaaatgtttttttgtagagacggggtctcactttgttgcccaggctggtcttaaactcctggccttaagtgatcctccccgccttggccctgcaaagtgttggaattacaggcgtgagccatctcgcctggccgacttctgaatcttttaatggcgcggcgctccctcacatggctgccacctagcttattggactggcgccctgttgttggacatacgggtcatttctgatctttcatggatccagccgtgcggcagcaaagagccctgcatgtgtgtttggccgaggctctgtgggataggttcctagaagtggggctgctgggtcaggggcaaatacccgtagagtttgctagaagcagcccagtcccctcgtggggctgcatcactgtgcatttccacagcagccggggggctttccctgggtgggagttgcacacagttgcgataccatctctcctctcctgagcaaggcagcgtctcccccatgctcagggctgccaccggccgcacttcccggcctccctggtcccaatctctggccgctgtggactgtggcctcttctagtttaccaggcgtttagagcacgggaggctgttgatcctggtctggaatgtaaattgcaaatgctcccccatctgtctgcttttctgctcattctttcggggcttccttctttctctgccacgtgttcttgcagtgccgagctctgatcacaagggtcacctctcttcctgctttcctcggcagccacattcccttgtgcagtcttggccacacccatgtgccggggctgcctcagttggaatccagttctagcccctcctaagcccacagtccccgtgtgtccagtgccatctggggcctgctcgcccctgcagcagcctgagccgcaggctctgtgcgtctgccctgtgctctcagcctcggtccctgcactcgtccttgacccagtgtctgagcagagcccccctcccagcacggacgctgagttttgggaacctcgcggcccaggcagagcgcgtccttgtggtgctgtgcacaccccgcccaccctccgtccaccctgcgcatgcagtgcctgtggtgtcctgaggccttggtggggccgtcctagtccctggtgcagacgaggagcctgagaggcttagcagctcatgtgtgtgtcagctgggaacccacagcaagtggattccaaagcctgccatgtccctgttgccactagcacctcctcctccactccctcctggcctctctgggtcctctccttgtccctcctggcctctctgggtcctctccttgtccctccctgacctctctgggtcctctccttgtccctctctggcctctctgggtcctctccttgtccctctctggcctctctgggtcctctccttgtccctctctgggtcctctccttgtccctctctggcctctctgggtcctctccttgtccctctctgggtcctctccttgtccctcctggcctctctgggtcctctccttgtccctctctgggtcctctccttgtccctctctggcctctctgggtcctctctgacctctctgggtcctctccttgtccctctctgggtcctctccttgtccctctctgggtcctctccttgtccctctctggcctctctgggtcctctccttgtccctctctggcctctctgggtcctctccttgtccctctctgggtcctctccttgtccctctctggcctctctgggtcctctccttgtccctctctggcctctctgggtcctctccttgtccctctctgggtcctctccttgtccctctctggcctctctgggtcctctccttgtccctctctggcctctctgggtcctctccttgtccctctctgggtcctctccttgtccctctctggcctctctgggtcctctccttgtccctctctggcctctctgggtcctttccttgtccctttctggtctctctggtcctctccttctctccttgtccctctccctctgcctctgctttgcccaccccagaccctgctccttcctgaagagcctgccctgaggtgacagctgtgtttccctggaatgcctactgcccttgggatccctttcctggaagcccggtgggaagagtggcccctgtgggcactcgtccccttggcaccttcccagcttcccccactaagccatgcgccctgccgtccagggcctgggagcagacacctgagactcctttgccaactcggaaggccttaggggaaagccacatggagccatgttatgggaggcctcatttgccaggttcaggtgtgtccgaggcatcctggagggacgggaagccagggactatttttaacggcgtgggtggctctgcctgggaccactactctgtttttttgtttttgagacggagtctggctctgtctcccaggctggagggcaatagcataatatcggctcaccgcaaccttcacctcctgggttcaagcgattctcctgcctcagcctcccgagtagctgggattacaggtgtgcgccaccatgcacagctaatttttgaatttttagtatagacagggtttcgctgtgttggccagactggtcttgaactcctgacctcaagggatccacccgcctcggcctcccagggtgcttggattttaggtgtgagccaccgtgcccagcctgggaccactactctggaagtggggtggagaagatgtggagtaggggagggggcgcaggtgggcccaagagcccttgtggcagtctctgtgtctggaatggggcggtgggctggggaggcagagaggattcaggggtgtcatgccagagacctctgcaggctcagcacagattgtgtgtcaggtctgatggcagctgaggctcacagggcagggccgatggggcagggagtggctcacccatggggggtttgaagatccggttcaaccccagaggctgcggctccatgaagggatgctcagagcaggggcatcgggcagcccagcggtgtcaggaaggcagcagtaaccagcgagtcttccccatctttccaggagctgtccaagatcacgatgccaatcgccttcaacgagcctctgagcttcttgcagcggatcacggagtacatggagcacgtgtacctcatccacagggcctcctgccagccccagcccctggagaggatgcaggtgggccttaggggtgccaggcaggagtttgtcatgaaagtgatgccccttgcatgtctggccacacagtcttggggccccaggcatctgtgaggactcgcacagctccccccagtgttcagtgccatcctgcctggcggtcgtggcatttgtcctgtcaccacaggtgtgtgatgacagaacttgccggaaatgccattgagctctcagtggccccaagagctccctgctgccgcctcctgccgggagactccgcctcttggagctgaaggtggcggtgggctctgcccttgggcttctcttgggtcctgttgcaccaccgcaccccatgtgtgtgcatgtgtgtgactgtgggctgggcacgcacggtggctcatgcctgtaatcccaacacttcgggaggctgaggtggatgaattgctcctggaggttgagaccagctgaggcaacacagtgagaccgcatctctacaaaaattttttaaaacttagccaggtgcagtgttgcatgcctgcaatgccagctacttgggaggctgatgagagaggatcgcttgtgcccaggagctagaggctacagtgagccacgattacgccactgcactccagcctgggtgacagagtgagaccctgtgtctaaaaaataacaaaatacaagtgtgtgactgtgggtgcacataacgtgtgcacgtgtgtgcgcatgcctctgtgaatgagtgcttggggtgtgtgtgttgagtgtgtggccttgtgtgtgcatatcagacggagtggctgacattgctgcagcatctgccagaagggcctggctccgggggtggaaggcagcacccagttccttctttctgtgctgtcgggggagtggcgggtgatgaagggcattccctggaagtcctataatctcagacacactgctcggggaaaactgaaaacgcacacggaacaaatagtgacagaaaccaggtgcccaccgccctccacaagaggccatcttctccagcgcgtttcctaactgaagctgtgcctgtcccccccgtggattatttacagtctgtggctgcttttgctgtttcggctgtggcttcccagtgggagaggaccggcaaaccatttaatccactcttgggagaaacgtatgaattaatcaggtaaggggggaaaggcccatcataaatatcttgtaaatggaattccttggatgacagataagtttgattctttcactagcattgattcctctgctctgagaataaactgtttgaattaagagctcacgaaagcgtttggatgctgtaggcgagatgtttcacacacacggggtgttgtgctagcgtgccacggcgtctgagtgagtgtaaagcgctggcaatgagatattttagtgtgttcgactcaagcgtggagatagcgcgcactgtagacgcttccgtgtgtgtgtgcgacgtctgtgaaatgtgtaggattgttgtgagcttcaccgaaaatggaaataggtactaatgagcaaaactaggctgtttcactaaagcatttagtgaacgctattgaaaaagcaggtaaatccaaacacaggaatgattgcaaagaggagcttcactcccaaggccacgtttgccaccacagcctccccagagttttaggaagggtcagacggctctggccaagggagagttaaccagaccacgcctcatctccagacatccctgaaacttcttcctatggaactttcttctaggcagcgttgccatcccttcctagagtctccccagcttccctcctgtctctggtggccctcacctcacagacgtgagactgactccaagtcctagaactctgaccccagaggtccagccgggccccagatccgttgtttgtggctgggcctctggaaggactggttggggttctcttcacccacctggttgccctggggactgctgtggttattcacagaatcatcctgggattctgcccaggtgacagtgcccacccacaccaacaaatgaagtcaaaagcaggccagaccatggcatgtatgtggcagtgtggtaattcctcagccattgagcagcctggctggggctccggggagctgtggatgagagggatgtgggtggcttccttcagggccgtttggtgatgtctaaaatgatttttattccactgcccgtggaccccgtcattctcttgtagatgcatgcaggtgcccatgggcagatgtgtagggagagtcagcagagcacagttcagctgctgtctctgtgacagggctaagctgtggttctgaaggagggaggggcagggcactctcgctgcacccttcagtcttccgactgtcgaggtagcccagcacacagagctcactctgggaagaaggagcttgctggtgggacacccttcactcttctgactgtcagtggagcccagcacacagagctcgctccgcctgcctggggagaaggagctggaggggcgtgggtggttatctagacaagtctgctgtgcagaatgcaagctgtttgccacaggctgctgggctgcacgcctccctgcccaggaacagagtgcagacgggagggaaggcgggctcctttatcatcttgttttattatttttctgtgaaaaagggagttgagccaaaacaattagcctcttatttggattctgggttagttgagattctgttgggttattttattatgaagtctgtttgtttttttaattacgagagagtgctctttatagaaaatgtgtaacattgagaaaggtagaaaagatgaatcaggcataatcccatacaagacaatagctggctgggctcacgcctggaatacctgcaactcaggaggcgaggcaggagcatcacttgagcccaggagttcagttacagtgaccgtgccactgaactctaacctggactacagagccagaccgtgtctctttaaaaaaaatgagaggaactgtcagcattttgttagactttcttttgtgtgtgtttcaaaatatgataatttaatttgtatccctttttaacatgtcataattttcctgtgacattaaaaactttttctaaattagagtgtttcatcgattctaagacgccttgttcacgtggcagcacttctacatgtcagtttcttgttcctttttttttttttgagacgaggtctcactctgtcgcccaggctgaagttcagtgacatgatcacggctcactgtagcctcgacctcctgccttaacctcctggatatgatcacagctcactgtagcctcgacctcctgggctcaagttatcttcccacctcagcctcccaagtagctggaactacaggcgtgcgccaccatgcccagctaatttttgtattttcagtagagacagggttttgctgtgttgcccaggctgctcttgaactcctgagctcaagtgatctgcctccctcagcctcccaaagtgctaggattacaggtgtgagcctctgtgcccagtccaagtcatagtttcatttgcagcatttttttctttctttcataaaataatggtgtgcagtgcaatgaatggcatcttgggttccaagaagtgcagttcctttgaaacttaaggccgctgttttggggccctttattgtattttatgtgttattaatgattgagaatttttttttttttttgagacggaatctccattggttgcccaggctggagggcagtggcatgatctccactcgctgcaacctccgcctgctggttcaagcaattctcctgattctccgcctcagcttcctgagtagttgggattacaggtgcacgccaccaggcccggctaattttcgtgttttcagtagagacagggtttcaccttgttggccaggctggtgtcgaactcccaacctcaggtgatctgcccaccttggcctcccaaagtgctgggattacaggcgtgagccaccacgcctggccatgattgagatttttatcaatagtgagcaaatggttgtgggatttggtttgcttcagatggactcttttccagtgtgtaaagagtttaaaagtgcgtgcccatgtttgtcctagaaggtgtgtcagcactgcctgtcagaccattttgggaggatgcgttgttagtagtacaagctttcctgcacttctgtatataaatcactatgcagtttggagaagcaacataaatgtcacagcttcaaattctaatctgttcctggctcatcctggctgggtcagctgctggtccttacccacatgctgcccgtgcgtgaatgccaactttgtgttttttgtctgatttagaagttggctggcactgggcagccgagcacctgttctcaagatgtcattgcctttgagcaagtaggactagtttggacagagtgtggcgtggtgacagcagggtccagcaggcaactgtcggtcttggcacaagctgcagggagcagccctgcttctgcttctgggaaaggggaggctgaggcctggacaagggaaagactggccacgagaaccacttgtgagggagtcttctgttctgaattcatgtagagtgtgcttccttttctagatatttctcttgagcagtattcctgttgctgcctgccagccttctcgtcctctggtcagcgtgctgtgccactgtcagaggcattgacgggattggctcttaaaaaattattaaaatgtcttgaaaaagataaatcaggccgggcgtggtggctcacgcctgtaatcccagcactttgagaggttgaggtaggcagattgcctgaggtcaggagttcgagactagcctggccgacatggtgaaacctcgtttctgctaaaaaatacaaaaaattagccgggcgtggtggcgggtgcctgtaatcccagctactcgggaggctgaggctggagaatcacttgaacctggaggcggaggttgcagtgagccgagatcacgccactgcactccagcctgggcgacagagattttgagattccatctcaaaaaaagaaaaagaaaaagataaatcagaagaggaaagaagttctagatgatagagaagaagccttgtgggtgaaaggaatgcaagccgcctgggctgggtagagcggggcgtgccgccagcacccttccccaggggctgcacccggggccggagctcctgctgcacagccagaagcaagctatgcaccttcgcaacgccgagacacgtcgtctgtcatgagttcacttccagatcgtccttgccagtgtctgccatgtgctgtgtgtctgtgagaccctggcagtctgtcaggttaggggccatggacgtggaccaagtcctttcctgataccctggatccctacagatcccttgttatagctaaaaatacacattcttttctcagacaagtattcattttgtaaattacataccttggtagtcaaccttttaaaatctaatttttcaactttctttcttctgtaatgattggaaattctgattccagttaagttggtaattatgtggtttagcttttctaatttttaatgactacaactgtaggtgtattcacagttccggaacaattaaaagctgacattttgattgaaaaagagagtacactaaaaatcctgttcctggacaggagtattttggggtataagccattccatctcggaaatttcaggggccttgtagaaagacaaggaaggggcacccccttcagaaagggtttagggtcctgagttcctgggcaatgggagtccctcggggttgagggtttggagtcagaggtgtgtaaggattgcttctccacctgcgtctctgggtacctctagccagacactgctgtggctcaggtggagagcaagcggggcatcagggtggaggcctctcctgcaccattgcgctctctgggtgggtcagatgtgctctggaagccatgtgtgtgtgtgtctgttgccagcgttaggccaagtgcgatgtcatgtttgtgtgtgtgtctgttgccaacgttaggccgagtgcgatgtcatgtttgtgtgtgtgtctgttgccagcgttaggccaagtgcgatgtcgtgtttgtgtgtgtgtctgttgccaacattaggccaagtgcgatgtcgtgtttgtgtgtatgtctgttgccaacattaggccaagtgcgatgtcatgtttgtgtgtgtgttgccaacgttaggccaagtgtgatgtcatgtttgtgtgtgtgtctgttgccaacattaggccaagtgcgatgtcatgtttatgtgtgtgttgccaacgttaggccgagtgcgatgtcatgtttgtgtgtgtgtctgttgccaacgttaggccgagtgcgatgtcatgtttgtgtgtgtgtctgttgccaatgttaggccaagtgcgatgtcatgtttgtgtgtgtgttgccaacgttaggccaagtgcaatgtcatgtttgtgtgtgtgtgtctgttgccaacattaggccaagtgcgatgtcatgtttgtgtgtgtgttgccaacgttaggccgagtgcgatgtcatgtttgtgtgtgtgttgccaacgttaggccgagtgcgatatcgtgtttgtgtgtgtgtctgttgccgttaggccgagtgcgatgtcatgtttgtgtgtgtgtttgttgccaacgttaggccaagtgcaatgtcatgtttgtgtgtgtgtgtctgttgccaacgttaggccaagtgcgatgtcatgtttgtgtgtgtgtctgttgccaacgttaggccaagtgcaatgtcggagaggtggtgttgggtgtttccgccacatgttgtggcatggagggcccctgcttcccagcgtcctgtgaggggctccacatgatgtctgagctgccctttcttttattttgctgccattaatgtgtctctcttttttattctttgacctagggaagatttaggattcagatttatatcggaacaggtcagtcaccacccccccatcagtgcgttccactcggaaggtctcaaccatgacttcctgttccatggctccatctaccccaagctcaagttctggggcaaaagcgtggaggcggagccccgaggcaccatcaccctggagctgctcaagtgagtgtcggtgcgtcctgctgagatccgcttcctgcagaaactgaaatgggtgctggtgatgtggagggaaagcttccttcaggaggaaaccctgtcatttttctcctgaggtggggacctccccacagcagaaacgtcttcagatgagcttcctgaccagggtcccgtgttgctggggtgcgtcctcacgtctgcagttggaattcgcccccctttcggtcacatcattcattgtatgaccagggtcccatgttgctggggtgcatcctcacgtctgcagttggaactcaccccgctttccggcatcattcattgtatttcttgtcttttgctgcataactgtcccaaacttagcagcttccacaccaggctggcaggtgtctgagggccggggaccgtgaggttgcggtggcaatgagggttgggttgcccatggcgcctgtgtcctggctccccttctgggctgcttgctgcagggcactgcctcccacagggggagagagctgagaaggaagccagggaagtggccctttgcacactcccccaccctgtgctcatgtggcaggggtgacttagggttggaatttgaaacagcgtgggaggggaccctctgagaggctgcttgccacccctcttcactctcagcctaaatgctccccaatccagtgtcaaccaaagacacctcagagcaaaacacaagtctccaacaaatgccggccgctaagacccgacagacacagaccggatgctggcgtcctcctgggccaccagttctgagacgtgagtcttgccaagccactgcctgcagtcttgttgtaggcagcaggtcctaacaaatacatacagaaataagtaataaacgacaccttgcctgatgaagcatttgatttgggttttgcttcacattggccctgcctggatggtggctagaaggttccacaaggacctggagaagcccctgagagtgtgtcctggggctggtatggccgagtgcctgttgtgcagtggccttgcttaattaagaggcatgcagaaatgagaagttgcacaccttgctgataaagttgcacaccttgctgataaccttgctgatgaaccagtttgggttccacccccaggaaattgagagaattccagacgtgtggcaaaataccctgctctgagcagatttctgccttcactgtggctcccccacgtagcaccttagaacatagggctgctgatctgctgcctcacattggtggggtgttttcttcttgggcagggccatttgggaggatgaggagtaaaggaaacaagtatgtggagtgcggttgaaaaccctgcacccctccacagccatgtgccagctccccagaaagccagggccgcatgcccaggaccctgcattactgccgtgtgtgtttcgtgaggtggcctttcttttgacgacttcacaggaaagccatttgtctttgttcagtcttctttgattgcttattaacttgtcttgacatttaagtagaaagctttgtagatgctacaaaggaaagaagaagtacatttcaaacgcatgctaaatacacagcctccgtcgcaggggcttcaaagcagcgtgctgctctcccgcgggtgccggttgctgtgacccagccccgcctggtcgttgcgtcttgggtcacgtcgtgtcttggcttttctggactctcactgcttgttttctggtgtcttcacagacataatgaagcctacacctggaccaaccccacctgctgcgtccacaacgtcatcatcgggaagctgtggatagagcagtatgggacagtggagattttaaaccacaggtgacagcaccccaccgttgggtgagagcgcgaggctccgggtggggatgggcgagccggggagcgtgagcatccgtgctcctggtgggttttagctcagcctcacgagctgctgccgtgtccccgccagcccaggcatagcagctgcctagacttgactctgaccggtgttggccatgaatgctcctcgttcaagacctcgtttttcgtcacggttgttactttaaggctttgagctatgctgaagagctgtgtcattgccaggtgcagcgcagtggccgtccacggccgttggccactgtctaggcttgaatgccctattcctggaagctcatgactggtgggctttgccttttcaccactttagtgaggtataatcgatgcatcataagactcgcccattctgaatggacacttaagtgatttttagtaaattgaccgaatcatggagccgtccccacagcccatttcaaacacttccatcgccccaaaggcccaccacacccatttgcagtcaccccccgcctgccccaggggcctccaccgcgcttctcctgttacagagttaccctttccggctgtttgctgtcttgcagcagaaacctgtgtttgtttttctcacagaactggacataagtgtgtgcttcactttaaaccgtgtggattatttggaaaagaacttcacaaggtggaaggacacattcaagacaaaaagtaggtccttgccaagtgttcatggggcaccactacagcctgtgtgtccacgttagaagggctcaggtgctcctgggcctgcgtgtgcctacgtgcatgagacgcgggtacaccagtgccatctgttcatggtccagaagtatgactcttttttgttttggaaagacattttgttattgagcataaaaggaaataaagggtatttttgaatgtagtttctaggtggcttgttactggggccatcttcttttgataaaattgtcttgagaagtcagctatttccactgggagatgagaggggactgtttcgcagcagagctgaggtgggtgggaagtgtggccttgcgttttccttctaccagcaccccatgcacgttgtcaggcaagactcaaatgtgttagcttgaggggcgtcagtgtcacgtgaccagttcactccagtctttaaatcagggactttcgcaagtttttgtgagcagagaaatggtcagtactgttccaacaaatttttcagtttttttctccccatttgggttaattactttgtaatctgggtctcacatttgtttttttcgtaaggaatttgagccatagaatgtcatgaagttccttctagttccaaaaatgtagacatttcccattagaaactagtccccaatttaaaacagtcagggccaggtgcagtggctcatgcctgtaatcccatcacttctgaggtgggcagatcacctgaggtcaggagttcgagaccagcctggccaacatggtaaaaccccgtctctactaaaaatacgaaaattagccaggtgtgatggcgcacatctgtaatcccagctactcaggaggctgaggcacaagaatctcttgagcctgggagatggaggttgcagtgagccaagatcacgccaatgcgctccagccggggcagccaagcaagaggctgtctcaaaaaaataagacagttggtgtttctgctctgtccaccctctatggtagaccagaaatgcacccgtttgaacagcctataaaataaaatggccaggcttatgactgaccatttctcccataaaacatgtgaggatcaacatgtggacctagaagggacagcagtcttacaacagggtagcagtcatcagtgccttgacacctctcccccttggaactcagcccagggagcagctggctgtctgtttccagaaataggcgggggcgccgaggccaacactcgctgaccctcagtgagtgcatgtaaaacatgtttttccagaaccgggcagggaccccgaggccagactcgctgaccttcagtgagtgcatgtaaagtgtgttttggttgtctggttttccatcctaaatttaagggtgctctgtccttggagacagagttgtccccaggctgtctactaggtgaggcctggcccagttccccgcgtctgtgtgctggctctgcaggcactgcagtgacaccgtcccctcctgggtcccgagtctgtcagagttgcacttcccgggagtctgtggtcacggttgactcttcccagcaagaggcgaaaggagaaagaaaatggagtctggcactatttggcttcatcccttttagaatcgagagctctggtggccactctgcaaaggtctctgggttgttattgatgaaaaaaggcaggcggggaaccaaagatcaagcaagcagcattgactgcactgattgatagaaaagggctgaaggacacacacacaacacattgagtgtgttgaaaatgatcagtgggcgcatgcagctttacattttaaaacgctcactcttttttgccccttcccgtctcctgcagccccctggaccaaccatcctttgggtttccatcccttcccgtctcctgcagtcccatgggccatctctcttttgggtttctgtcccttcccatctcctgcagcccggtgggctgtccatcctttaggtttccggcccttcattttcctttccgtggtgtgtatcggggctacgaatggtcccagaatgcaaattttcaccttcgcatttatgtccagagatgtcccaagatgcataagaaaacatacctgaggggaatttattccagggtgccacatgtttagacaaatggtttgtaatgactaagacttgtctttaaaaatcccatttaattacagcaaaaagaagctctttatgatctatggcaaatggacggaatgtttgtggggcatagatcctgtttcgtatgaatccttcaagaagcaggagaggagaggtgaccacctgagaaaggccaagctggtaagggctggggcgtccccgggcagagctgagccctgggtgctgagggctgccaggccgctgctgcctttagctcacctgttggggtcccagggaacctttgggccccaccaggagagatgaatgtgcagaatttgtctgtccagatgaaccatatattgtgggttccagtatcagtgagggggtttatctgtatttctttccattttttttttttttcccctccaggcagggtctccctctgttgcccaggctggagtacagtggtgcagtcataactcactgcaacctccagctaccaggctcaagcaatcctccctccttagcctcccaagtggctaggactataggcatgtaccaccatgcctgactaatttttattttttttagagatggggtcttgctatgttgcccaggctggtcttgaactcctgggcttaagcagtcctcccacctcggcctcccaaagtgctgggattactaataggcatgaaccacaacacccagccggcatatctgtattttggttgcacggaggctgctgctataaaccgtgggcaccagtgcccacgagtcatacataattgctggcccccatggctggaagtatctgagggaacctcaggcaaggccgtttcttttctggaagctccaagttctgggtccttcttaataaatcttctcgctttctttgagttagcctagacatattgttaaaaatcaagtgaatttcaattttttgtttttagttgtgagtaccagataatatattcaacagccagaaagtactggcaaggcttttccccttaaagctttggaatactcattatcttaagactagttgttcttgaacttaaaaataaaagggatagttcaaaagaggtgtcctattttctacataatgaattggaatgtaccaaacctgaaatgttcaatatttatttaacggaaacattcagcctcctccggatcccaagtgttttttatgttgttgtattcatttgtgctgttagacaccttttctaatcaccctcttttatttaaaaaggaaaattctgcttacacactagacagacctagaagggtaaatccatttagcgatgtcttttgatgctttcctgctccttgaggtgacctagaaacgggagttttctgtgaatccttgtccttgagctgcggctctccctcgccccagcctcgggccatggtgcctacagccagtgtgaatacagctagtgcaggaagccctgggctttgactcgcttgttttcagtggtctccctgaagagctgcttctggaatcattcccttttctaggacccatttattttgagaagcaatgtggcaggttttgtcttttcatcagggtgtagagagcctgaaacccccacacaggagccacttcttgatgggggcaaagctgcgctatctagaaagctctcagtcccagaacctgccttctggagaggcgccatgtgtgtgaatgaacctgctgtttggaaggcaccgctgtgtcgtcgcactcagactccatgaagccaccgctgtgtcgtcgcactcagactccatgaagtgctgtttcgcgtgcaccgcttctcccgaagggaaacacgcctggccactgacttccttcatctccacgaagggaaacgcctggccactgacttccttcgtctctgcgaagggaaacgcctggccactgacctcctgtcgtcacccgaagggaaacacgcctggccgctgaccttctgtcatctccgtgaagggaaacacgcctggccactgacctctgtcgtctctgtgaagggaaacacgcctggccactgacctctgtcgtctccactctgggtgtccgttagaacagacagcacagccctacgaagggagtgtgagctgctttagggactggggcccagctcctctccgtacagtgatggacagacagtgtcatagactggagaggaaattctattttctccttagtttaagaaaaaaaaggccgggtgtggtggcttacgcctgtaatctcagcacttttggaggccgaggtgggtggattgcctgaggtcaggatttcaagaccagcctggctaacatagtgaaaccccgtctctactaaaagtacaaacaattagccgggcatggttttgggcacctgtatttccagctactcgggaggctgaggcaggagaatctcttgaactcaggaggcagaggttgcagtgacccgagatcgcaccattgcactccagcctgggcaacagagcgagactccgtctgaaaaaaaaaaaaaggagaaggctgcctggctctgctcaggtgactggtctgaaaggcgctctgagaatagctgtcctcctggccaagagcggcctggccccgggcagccacacagcagggttctgtgtttcaggatgaagactccgggaaggctgacagcgacgtggctgacgacgtgcctgtggcccaggagaccgtgcaggtcattcctggcagcaagctgctctggaggatcaacacccggccccccaactctgcccaggtctgtgtccctccatggcctgacgtctctgcctgctcatgtcacacccacctctgggcccagccccacggctcttccctgtccttgggcccttgcctgccgcctcgcctcagcctgttgtcccagagcagacaggggcctccgccattgtcggagtggcttctgttgtccctggagctgcgtcccggccctgtgcttgtctgccttggggcctgctgttggggctgggcaccgctgctccataggacatgcaggtcgaggtgtggacgcatgctcagctgcgtgtcagagctgcccgccgggcacacatgcttgtgcttcccctgggaacatcagacagacgtggccattgccggccaagtgcgtcttatcaaaagaggcttccaagcctgtttggggagattgctttctcacttgtcaatttagatgctcaaatgccttgtgatatttatttttgaaaattgcacttataatttttattaaatatatgataaactacatgttttatgacaaataaaatatgtgatatatggttatatgataaatatcacacgtaatatcttagtattttttataaattcttatttgtatataaaatttatgcaacttatgcaattttgtacgtcccataaacagagcagaacatgcgtaaaatacagaaaaggaagcaaaaccttcactttaagcacgttatctcaacagtcactgttatcatttgagtagagtacgaactggtttaacaatgctattttcttttttaatagaggcagagtctcgctctgtcacccaggctgcagtgcagtggtgtgatcttggctcactgcaggctccaatttctgggctcaagtgatcctcctacctcagcctccctagtagcgaggaccacaggcgtgtgccaccatgccagactaattttctattttttgtagagaggaggtcttgctatgttgcccaggctggtctcgaactcctggcctcaagcattatcttcctgccttggcctcctgagttgctgggaccacaggcatgagacactgtggcctgccaatgatactattggtattttaaatttattattaggaaaattgcgtatgttttttttcagggaagtctctttaaagataactcatgcttccagcctttggctcagcgtatgtgttgagtcctcctgcctgccaggccctgtgggcctgggcactagaaccaggcagacgaggtcccaggagggaggcggggcaggtggttgactcacacctgagagccaggtggtgccttgggtgccagggagggcatctgagtgctgtggcttcagtcatggggtaggggtgggggtgtctagggattgcgtttgggcggaggggacagtcagggcagagacccctggagtagactagtgtgtgagggcccagggggccatggggatgagggtggagggggtgcaggggtctccagacgacttcagtatttgctgtgagtgacatggggcaccaggagtcatttgagcagggggtgacgggtgctgttgatgtttcctgtggcctttctggctgcttgctgagatgctgtgagggcagcaacagaagagggaggacacgggtggtggctggagggcctggctgtggtgggaggacctgagtggagccagggccctgagggctgcagaggccggaggctgtgggtgcagaggctgggaggctgtgggtgcagaggctgggaggctatgggtgcagaggctgggaggctgtgggtacagaggccggaggctgtgggtgcagaggctgggaggctgtgggtgcagaggccggaggctgtgggtgcagaggctgggaggctgtgggtgcagaggccggaggctgtgggtgcagaggctgggaggctgtgggtgcagaggccgaaggctgtgggtgcagggtgctgccgcaggcctgctcgggtgtgctgtccacaagacgccgagcagacagctgcgagccagaagtcaggcagagcaaggctctgggagtcctgggcacggggggactgtcataccctaagcattccagttgttaatgtgacaaattaacttgctccagggctgaggctttggcaggtgaaggggtaaagaggaggaacctgtgggcaggtgtggctgagggcaggaaaggagcaggtacaagctgagggtttagcagtgggagacaggtggcgtggctggagtgtttccagcaagctggtgacaaatctgttgatgagattgtaaagacagaaaaagaaatgtgtgtgagttttgctggtatacctcaaaatgcaaacgttacagccgcagtgcatgatacgtgcttagtgaagacggcagaggcattgaatttgcaggtggaagacgtgagcggaagtaggttcccatggtggcagtcaggtagcacctgcgggatttcaggggcccactgggggtcttggagcatagtccatggttcagaggccctgctgaggtcgtgtctctgtgccttgctccacagatgtataatttcaccagtttcactgtgagcctcaacgagctggagacaggcatggagaagaccctgccacccacggactgccgcctgcgccctgacatccgcggcatggagaatggcaacatgggtgcgtccacgcagtcagaggaggaagcttggggccaaggacgccctggctagggtgggagagcacaaagcactcgctggcagaagccaggctctcgcctacaaggggagccccgtccctctccctaaacaaacaggcaggctgcaggccttctaactaggcttctcagaccgtctgtggtgaagggctttaaagatctctcgcctgcctcagaccaaaccttttgtaaataaattaaaattacattactagaaaatgaaatgaaaaaatacatacaaagtacaaatcctaggccgagcgcggtggctcacgcctataaccccagcactttgggaggctgaggcaggtggatcacccaaggtcaggagttcgaaaccatcctggccaacaaggcaaaactccatctctactaaaaatacaagagattaggcggtcatggtggcgcccgactgtaatcccagcttctagggaggctgaggcatgagaatcgcttgtacccaggaggtggaggttgcagtgagccgagattataccactgcactccagccagggcgacagagtgagaccctgcctcacaaacaaacaacaacaacaaaaaacacaaacaaaaaacaaagtacaagttcctaatttgttattattaaattaaacaaaagttaagattacatttagaaaactgcacgtgttccactgtgaggatccgtgtagccatcagtgcagtcactggcacgtgtgtggcgtgtcctgcagcctcacactctcccggtgggctctgtgcttgcagcgttcatctgtaacatggcagatgaacaactttctcactcactcatctagatggaatccgcagtgaaactcctggctgaggaggcaaatccaaagtgtcctgggttttgagttagtaatgttttatttatttatgtttagagtcgggatctcactctgtagcccaggctggactatagtggtgtgatcttggctcactgcagcctcaacctcccaggttcaagccatcctcctgcctcagcctcccgagtagctgggactacaagtgcatgccactacacctggctaattttttgggtttttttttttttttttttttttgagacggagtctcacgctgttccccaggctggagggcagtggtgcgatctcggttcactgcaagctccgccttctgggttcaggccattctcctgcctcagcctccccgagtagctgggactacaggtgcccctgccaccacgcccggttaattttttgtatattttagtagagacagggtttcaccatgttagccaggacggtctcgatctcctgaccttgtgatccgcccgcctcagcctcccagagtgctgggattacaggcatgaaccactgtgcctggccaggtttttttttttgttttttttgttttttttttttgagacagagtttcacacttgttgcccaggctggagtgcagtggcgtgatctcggctcactgcaacctctgctcacaggttcaagagattctcctgcctcagcctcccgagtagctgggattacaggtgcccgccaccacacccggccaatttttgtatttttagtagagacagggtttcaccatgttggccagcctggtctcaaactgctgacctcaggtgatccacccgccttggcctcctaaagtgctgggatgacactgtgcctggcctaatttttgtattttttatagagatggggttttgccatgttgcccgggctggttgccaactcttgggttcaagcgatccgcctgcttcagccctcctaagtgctgggatgcaggcatgagccaccgcgcccagcttgaattagtgatgttttcagagagaaacccagctcacgagtgtgacctgggaatggatgtaacttctcatgctttgtattcagaatgtgtgcccagtccttcacagaagccacatggcagttacccgggaaggtcaaggctaaagggagctcgtctttgggagatgggctctgagttgcacaggtggggctggctccccgtcctgagcgcctgctcgcacaccagggcattgggtggtgcctgggccctgcctgtccttcagactcctgcacccgcagactttgagtagtgctgtcgtagaacacgcagcacatgcagcccccatgctctactcagctccgcttgggaagggccctgttggcgtgccggccgctgtggcctcggcaactgtgattgtgtttggtctcccgatcacagaacctgttgtctgtggcattccagccacagtgagacatgccaactagagatctaggtgcatagggggtggcggggtgcggttctaaggtctctgtctgacctaaactgtttgcttggatcctagatctggccagccaggagaaggagcggctggaggagaagcagagagaagcacggagggagcgggccaaggaggaggcagagtggcagacgaggtgagtactgtggtagccacgcaggctggggcagcggggaggccccacacacacctggggacggcggggaggccccacacacacctggggacggcggggaggccccacacacacctggggacggcggggagtgccttctctcacccccacacccctgtggctgggcagttactgttccatggctccattaaggtagtgacaccagtggctgcccctgacccatgtggttcccactgcccaggtaagagcccatcctagcttagcgcacactttgccgagaccacccggctgggggtggcctgtgcagagtgcctgtcacctcagacccgggtctactgccgggcctcatggtgtgttggcccaaagctttcttttcaactgtggcaaagttaaagagaaaatgttgcctgaatgtgactgctccctttaggaaaacacagctggtgagtgtatgggtgaggtcccccaggggccacagcccgtgtgtagggaggtggcaccgtgtggaggccacgcctgtcacaccgataccacatcttcctgtcagtgccactcaggctgatcttcaccccatgacccagaaaggttttgtgaaaattaaatcccgtgtgctgtgccgtggcgtctgtgcacatggaggctgggacggtggcatgggctgcgtgggcctcacagaagcatcagctgctgggacatgattcctgtttctgtaactgtcctaagctggctgtagtttgttctataatagtcataagagaaaagaaccattgaataaggattcaatcaataatgtactgtaataagtataatttaaaaatgtatttataagtaaaatgttttagtttgttagaaaaatctttgggtgtttgtgaagcatcttaattctgtaggccacctgcttggtaggattcgttctcaaggcccaacaacaatgatacccggtggcttacatgtggctggcgttttgaaaccaattctcactgtttgggcttccaatttaatttgatactaggctttgaatggtttgatatttggaatttgcccttaatccagagaaaaatcagcttcaaaatagttaacctttcctcatttttttttttttttgttgttgttgcccaggctggagtgcagtggcgtgatctcggctcactgcaagctccgcccctccgggttcacaccattctcctgcctcagcctcctgagtagctgggactacaggtgcctgccaccacgcctggctaattttttttttttgtatttttagtagagacggggtttccccgtggtctcgatctcctgacctcgtgatccgcctgcctccagcctcccaaagtgctggaattacgggcgtgagccaccgcgcccggcctgttcattgtttttttaaagtgttaaaaaaaatatactgtgaaaataatgatcttttgtccttcgaagaaaatgtcttctcctttgtgagcgctgcccccaccccacccccaacactaaggacacccctcgggccctgagtgccagccgggggctgtggacggcggctgaaccagcgccaacactcaggccctgtgctaccttctctttgcctataatgtcttcctttgtcctcagttaaaaaaaccaatacttggtttgctttaaatgacagcacatgtgaacagtgtaactgcttttgccttgaaaagggagaggcattatttaggctccagtaacttctctgataagggcccagtgtgaggattttgtgttgagttaaaccctcaagattttgttgggaagtgaaattgacacgggtggctggatatctttaggttccagcattcacatgaccacgtgatcaataattctccgttgaagttgttacgctgggctgcattttaaaacccacgttaccgtgatggtgctgagttgggggaacacactcctgcacccagaacagggctgcgttttccttttgggctgagcatcttctgacccccctcccttgtatccggcaggtggttctacccaggcaataacccctacactgggacccccgactggttgtatgcaggggattactttgagcggaatttctccgactgcccagatatctactgagggcctggaggggcctggggcccgggaccggaggctgacgaggctggacttcctcgagtggccactgtgagcctcgtcacagcagaaaccaacttttctaacgactgagttcgcggagatagcatcatccctgatcaaggatgtaattctaattaactgttgattgccaaacatttcactctgctgtgccgtctcttcataaagcttcacttgggatcatcgtcttcattaaggtttcaacagggaaattcttcacggcgcccttttatgtggcagaaatcagctggggcttgtttagcttccagcacactctcagtcatagcatgtgtagctaaaggaagtaatgggaaggggttcatgttctctttataatgcagtggcaaaaggttctgaaagccttttaaactcgaaccagtgggggaaagatggatcttgaagctaatcctgcagagagttttatagaggccagggattgccttctaaattatgataaaacagaagtgaagagtttcagagcatcagattgagtgaaaagttgtcagattctgtattttttaacaatcttcaataatgtaaagattacttttaaaatatttaagttaaaactacttgaatagtattttgctgaagagcaagatatgcattaatcaccggttttatactgtccaaaatgaagcatccccgtgacaaaccagagtgggcagaagcatcgagagcgtgacaggaaatcccaagactgcttccgcctcagaggcgtcccggctgcgattcgctgccctgttgtcagtgaggcctggctgtcaccgcacaccgcgtccgtgtctccagggggttcctttcttctcacacgtcgcgtgtacccatagcactcttgtgtttctgtttttcccagtatgcatgtttaaaatagaagtgacaagaatcacatccggttgtgtcctgtgggagggtcagaggcagaatctacttacagtggtgtaattaaagttatttaaccaaaaataggtatgtgtccatctcagcattcacctttatcaagtgactgatttttttttcttttctttccttttttttttttttttgagacggagtttcactcttgttgcccaggctggagtgcaatggcatgatctcggctcaccgcaacctccgcctcccgggttcaagcgattctcctgcctcagcctcccaagtagctgggattacaggcacgcgccaccacacctggctgattttgtatttttagtagacacgggttttcaccatgttggtcaggctggtctcaaactcccgacctcaagtagtctgcctgcctcaacctcccaaagtgctgggattacaggcgtgagccactgcgcctggccgtgactgattttttttcatgtagaattgtcaacacgagagatcacagtggagcactttgaaagaccgtcggttgtgtgcacgcacgcacacactcatgcacacgctgacacgcggttgcatggagtccaggttactcaggccggcacttctgagtgacaggtgccacctgcgtgtgtcttggcgtccacatcacacctgtgacggaagcacttctggaagtgaacactcgttttgaaagcttgattttgtagctttggaagctggaagcgatggtgtttggtgccgagtcctgtgtcatcctcggggcctatgagctccgtaccagccactcaaaagtgtctgaacagaaccgctccgtgactggtagctgggtctgaggattcaggattgtggcgttattcaaagaggagactttgaaattccccgatggctggaatgtggagcccaggtgcctctggtggagggtcatctgcttttccagactgtggttgtgaaccggctccttctccaagaaaggttgcaagctgagaacatccagaggtgagactcagacacattgaaagtgactgcatttagggaggtttaacgagttcttactgatcattccacttgttactggttaagataatttgcccacgggtttgtttccaagtcctcttctaggaccaggctcctggtatttcaggggctggttggctgcacagacagcccctcttctgctgtccttgaggacagacaccaaaccagaggtggaggaagaacggtaggaaggctgatggcaaaagcggctgtgtgtcgaggttattttaactttttactactttttgttactgtttctgcaaatgctaacacataaaccatgacctaacttttgtcaccttggatatctattgaatgttaaacatctctaataaagatggccaccacttaatgtgtggaaagtgatggccttctcgtgggc

SEQ ID NO: 37179 - DNA, 224264 bp, Homo sapiens
gcgcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggaggtagaatggatccccttggccttcccctgtgggcgggggcgggccagggtgggccgcgttgccaggcagccctgccgtgttgctaggcagcctggtcgccggcgtgggcgatgccggcgctggggcgggagccgcgagggtgggaggccctggggcgtttccgggacgtggagttagcagggttctgacttgaaaaacgacggcaaagcgtgttcttgactgcttctgagcacctcacacctttcagacccagggcgcctttattcccagctggaagcccagcttagagcaatggtgccactaaaaggggtgtgttggatgtgaaaataccctttggaagtatttataagcctgcaggaaatatgttttccttattttcttactctgctcccttcattacccatttcaagaagcaacagaacctgtgcagagtgtgttttaagttacactgtatgtttatttttgtttatgttgaactcggtgtatacttgtgagaataagcttgcattttttattttgtgcaagtacaacagaacatattgagagtgtgttttaagttatcctgtatgtttactttacgttgaactcagtgtatacttgtgaaaataacctgccatttattttatgtggatttatttctgaagttcattcaatctgatttcaatcttaatccaccattaactttgaaaaggttgagatttgaagtgactggttgtatttaaagtaggtggagtgtttgtaagttctaattatccatcatggatagttgatctagctgcttcagcaaaaatagttatttcgggaatgtgactagggtttctaattgtggaccattttggtgagagttatctgcttacataattgaagatagtttttcctggttaagttgtacacctacacagggctcaaaatctgaattgggtttaagatattaacaaaattttaatagctgggtagagacagtgaaaaaataccctcatatgcagagtgattgtttccctttctctttattcttagtctgaaacaaatattgtgtgttcaattttaactaatgtacctctcttcagcttttaaattttaacatgaaagtaggtcatatgaaattattggtgaagttctgctaagggatttagagaaccactgttaaactgaaattgtatttacaaatataaattaatgattttttttagcacttggtatttgtataccatattccaagagttttagatttaggagttcacgagaaaggtagaagagtgaagaaaaagtagacagttttttttgtggattaccaaagcaaagggcaataaaagatgatgaagaactccatggaaattgtgatgttttatctcctaggacgatccctaggaccacgccaattttcatttgaagggtgtgaaccccaaagtattttaagactgaccttaatcaatttttttttttttgccagtgttaaggatgcactggtgacacagcctctggaggtcctgatggcaggtgcccaaggtggtcagggtacagctggcttttatacattttagagagacataatacattgatcaatacatgtaaggtctacattggtttgatctggaagggtgggacaactcaaagggggaggggcatccaggtcataggtagatttaaaaattttctgattggcaattggttgaaagaattgttattaatagaaaggaatgtggagaccatggttttattagccagatgaagcctccaggtggcagacttcagagagaatagattgtaaatgtttcttatcagacctaaggtctgtgttgatgttaatgctggttggcttttccagaattccaagaagaaggagggtataatgagcatgtctggctcacttttcccatcgtcgcctgaagtggtttttcaggttagctttgggatatgccctcggtggagaagaggggccctttcagatggctggggcagaggtcggagggtgcttacatttttgtttttcgtttacaaggggaaaaaaaaaatctaaaaagtgtacatgtttacagcatctgagtatctccaataataagatgactttaatatgtgaaaacatttgtggatttagtataattaaatctaaattacagcaacatgtttctattaaaattttttctcgaaatatatttttgaaatgaaaaattagggagaacattgttgaggattaaaaaagtttttcttgcaaattagttttatttctcctaagtaggagcacttgatttcactgtatgacagtattacagtgtatgtatattttactgaagaaaagaagagcaaaataagagcttaaatagttgatgttttcaagactgtactttcagggatcatttctatagtttgttaaatacttggtgttctgatactttactcaataagcatgcgtatctctgaaatacaggccattccgtatctggtactcactaagttcacaaactgtgatctcttccaatattggaagggaaacacgctatattggaaagtgtggtcaccaatgtggtattttcctagtgatagcccagggttattttgacagtatgtggtctctttctgtctagctgactttaaaacctgatgcctatgataagatttggcacaatggaacctggaagtgtagcagttgaaagttaatttactattaatataataaatattattgacatatgtaccagagtagttgatttagcatgaacagtgtttttcttccttctagaggggaagccaaactgaagtcttaagttgagcctgcaatcaggaaaggacattagttgatttaaaggaagtaatatttagtagttatgacagtaataccaccatggatggatttttaagtcagacagatagatggtcaagttacaattcagcctctaattttatgacatcaggcaaacgacaaactctctgcattttagtttgcttgctttaaaatataaatataatacccatatctcaggtattatgtatacatgtatgtaacatgtaaaatatataactatatgtatataaagactgtatataaaatgcttagtgcaatgcgtaggatataataaatggtcactaagtggtagctgttactatgtattcctcatttaaatgaaagcattagtgtaatgagatcctgaaatgcggtaagatttttttgaattggttttttttttttgctaaagaaactaactttataataataaattatatggtctgtggaatagtctattgcttatcatgaaacaccgagaattccaaattctcttacgttgtttgaaaatttcccaggaagagatttggtatcatagaagacttggtgatatcccatggatttgtgtgtgtgtgtgtgtgtgtgtgtatgtattatgtatatgtttgtacacatacacatatgcttcttcgtgaagacattttcattcattaaaaacaatgttttgttatattccctgttggagaatgtggttgagagagttaagtgaataggcaaagaagattggaaatttgtatagtcacttttcttaattacattgaatatagtcattaaaaactgatttttgaatcctcactgatgttaagtgatgtgagtttctgggagactttggctttttagtagtgtatcatttgcctatctagtgcatcttgtgtttcttttattttgacagtttctctctttctaacttcattaacacttatcagttaatcagcttcatttagaattgttttaatttataatgacctcttctgataatgtgaaaagagctccaattctgtaattatttccagtacacttattgactttgccatcatcaaaagcagctgttataataattaatttatcttatctgcaatgaatgtgagtagctaataggccatgatatgtaggtaataatgaatatgcaatatgaaaaattgaagagctcatgttttctaagcgatcaattgtttgactaaataaaacatatttcaattgcctttgacataacttctatatgtcattaatgtttttaagtacattttatattgggatgtataatatccagttagttttcgtggcacagctgtgaaacagagactttactatcttagcaaatgataaaaggggagaggagggaggtaagcaatggatgttacctttaagcagagaacttaagtggaagaaaaagtttgcagtgataacacaggaaatcatggtagttatgcattgatatgtacgcatatatgcacagaatatataggtgcaggcaatgtgatttcacttaggttagattgtatgtatgaccaccccttgaagcgtgattggaaatagccaaagctgcttgtcaggaatgccatagtgtcatggatgatggcagaagacatgggattcttgtgtcacagatgaaggatagtttattatagcaatagaatggtctttatgtacatatggttctatattttacatgttacatacgtattatgtgttacacacatgtatacataatacctaagatgtaggtgttatattttaaaacaaggaaattaaaattcagagagtttgtcatatgcctgatgtcgtacagttagaggctgagttataactggaccatctatcttggtggtcagtattactgtcataactattaaatatttcttccttgaaagcaactaatgtccacagcaatagatagtttattacccagcatttgtactggttccttgagcttcagttcacattgagcaacatgagggggtctaggtgatgcccactcatgtagtgaattacactgcaggagaggaaccttgcatttaagaaaccaaggtctttaaaaatgggcagtacacttctttgacctcttctctaaagggagacattatctttattaaactcaaaagtaaacactcatttttctggagggggactctgtcttctttgactatgtgctatatgcaaatatccttgaaaagatggtccagaacaagtcagtcagtccctgcattagcaagttgtgttagaaacccatgaggaattgtctgtccacgtaagagataggagcttggtcaaaagagaacattttcagggtatttttctccacatgcaccaccagcatgtttagtcccatatatgtgccctcttccacacatagggcacagagaaggggaaagagtggaaacataactcaagctaaagagtaatcaactcttaaccttttgctgcatttactttttcattatttccctctttagccctacatattcatcgattttagatgtgagtgtggtctgttatgcctgtgactgctgtagattatttcagtgatcttcagcgtttatttggcatgtcagactatctcagactatcagatatctctgatatttggcatatcagactataaattgctcatctccataagaattcctcctggagtatcatgctaatcctaccaggatagaaaatttacttttggttaagtgtaggaataatgtgttccccagctggaaaacaagtacataaacaaaggtttatttgttatataacagtgtgtgtatgcacatatttgcatgtgtgtatgtgtgtaacaaatggatatttctcctggtctctatccagtctttatttctatcttttgggcaagatttctgcagcttctcaaactgagcatgtctgaaagggaactcttgatccttccttcgccacatctggcccatgtgttttctcattgctgttttatggaaaacaaattttaacattctggcacatcagtttttatctaatcacttgccggtataatacagctttgtagttcttaccctgtattttgcagatagtacacagggatgctggcttcacataatttcttggggagttgtacatggactattttacaagaagtattactgttttttttacatagataagtaagacatatataaatagattgaatattaaggcttcaaagatgttattcagaagaataattttttcttttttcttttgggagacagagttttgctcttgttgcccaggctggagtgcaatggcgcaaacttggctcactgcaacctctgcctcctgggttcaagcaatccccctgcctcagcctcccgagtagctgggattacaggcatacgccaccatgcctggctaatttcgtatttttagtagagacagggtttctccatgttggtcaggctggtctgtaactcccgacctcaggtgatctgcccgtctcggcctccccaaagtgctgggattacaggcatgagccactgcacctggcctagaagaataatttttttcatggtagttggtatctgtttgcctgcctgcctgcctgcctcccagttggcctgtctctatttctttttaatgttggaaggcacaaggtcaacagtaagtttagagagtgatttgaaatctgttataaaagtctaagatagaatagcatcttgttgtcatttaatgaacagaaaaaagttaaaaatatagtgaattatttatggtatatttattattattaaaattttggttaatcatgtaaagatacctaccaagtttgatatttgaaggtgaaaaataaattttctttccccttgatgttaccatgagaactcaagtacctataatgtaatggaaagggcactttagtacaggttaaataagttgtagcactgattttatttaatggaaatatttgtgattttagaagtataatttttagaaatggcataacatggttgtcattgtgatttgactcaacttttggaaatattttggtacggagttttctctgcttggaaacagcaaaccattgccaagttagtttctaggagttttacagtaaaactaaaggtcataaattgtgaaatctttttgctattcatattaaatactaaattgaatgaaataccttagtataacttactgaatttaatgaacttggtggtcgataataaggcttaaattatatcaggaaaataaaaataaaacaagcaacaagcagacaggatactaggcatttgacttagttagattgttgtcgtagattgaatgtttatgttcccacaaaatttataggttgaaatcctaactttgagtgagaaagtattaggaggtggggcctttgggaagtgataggtcctcaggggtgccgccctcatgaattagattagtgcccttataaataggaccccagagagctctctggtcctcgttctcccaagtgaggaagtgccctttccattgcattatgggtacttgagttctcatggtaacatgaaggggaaagaaaatttatttttcactttcaaatatcaaacttggtaggtatctttacacgattaaccaacattttcataataataaatataccagtaaataattcactttatttttaacttttttctgttatttttaactttattttattttttatttatttttaattgttttttcttctgtgagaagatagcaatgtgagcaatctgcagtccagaagggagctttcaccagaacccgaccatgctggaactctgatcttggacttccagcacccagacctgtgagaaataaatttccgttgccccctagtttatggtaatttgttatagcagcccaaacgaacgaagacaattgtatataattttcacaatatctttgcctgatggttgtgacaaactatttgtctaacttttgtctttactgacagtagattggtttggtttaagtattgagagaagctgggacacttgccagccctaagcaataatttctatcagttaaagatcatcattatttcagcatcttgcaaattattgttttagaagtgagtatatgatacagttgtacatggctttgggaaagtttccttcttctttacagagggcacacaaggacgggaaattttctcatcctgtctttggagtgtgtgtatgagaatgtgatgctttggttgctgaaaccatcttattacctcgaaagtacacgcctgagggcaaaaaacagcatagaaaaatgggaagaactgggtacttgatgacatgtcttagccttgtaattgctctctcaactccttgctttgtgagttaataaccttccttattgtttagcacatttcaaattggatttctgatattttgtatctaaaatcattctactaagggaggtattgttgaattaagcattttgcccatgactgtacaacttgtatgtttacagttttactccagaattctccttctaccctatgttttaataactagctatacaacgctatttgtcaattacatattaaatatcagtaggagattgttgaggtacatgtagccctccctgatccttgaatctcagtgatcactattaaaaagcatctgtgcatgtttggaagagaattttccatgtgtttcttttagtgaaataagtgtttttattgagtggattgaagctctgtgttaaataatgtgtgaatcaaaaaaattgtaggaaaaagattggaaataaatttaatatgtaccttaaaaattgttagtccaaggaatgggtagaagaataatttatacctcaggtatatttgctgcatacaatgtgttttctatatgaatgctttttaaaagtacttatttattttattttattttttgagacggagtcttgctctgtcgcccaggctggagtgcagtgggctatctctgctcattgcaacccctgcctcccggattcaagtgattctcctgcctcagccacctgaggagctgggattacaggcgcacgccaccacatctggctgatttttgtatttttagtagaggctgggtttcaccatgttgatcaggctggtctcaaactcctgacctcgtgatctgcccgcctcggcctcccaaagtgctgggattacaggcgtgagccaccatgctcggcctaatgtacttacttatttttttgtgtgtgcctataattgattggtaggtgttttcattttaaaggcataccaaatgaaatacaaagagtcatttaacttttatttttagaatattatattttaataatattcttttggttaacatgtgagttaagttgaaggaaaagaaaacggggcctcccttaaggaagggagaatgctgattggtccatgttttttagaattttcaaggggagtaaaagtttttctcgtactcataatagtggagtggttgtgctgttttttgccattgtttcctgtacatttttcctcttgaagcatttatgaggaaggatggctgaatcaaggttgaatactaccatgatggtgtagcaggacgagccgcagacaagaacccctcagacactgaattgtagaaggaaagggcttcattcagctgggagcatcagcagactcacatctccaaaaaccgagctccccgagtgggcaattcctgtcacctttaagggcttacaactctaaggggatccatgtgagagggtcatgatcgattgagcaagcacggggtacgtgactgggggctgctcacacctgcaccagtaattagaatggaacagaacaggacagggattttcacaatgcttttccatacaatgtctgtaatcatagccgattaggtcaggggtcgttctttaactaccaggcccagggtgtggcaccgggctgtctgtctgtggatttcatttctgccttttagtttttatttctgttttctttggaggcagaaatttggcataagacaatatgatgggtggtctcctcccttaatggcacttgaattcagcttggctttccattgacagccacatgagttgcatgcttagatgttggacatagtgtaaatcataagagaatagtaactgtagaatgtgattttacaaaatattgcattatagaatgttagagcaggaaagtcaggtttcaggctaaataacaaagctgggactaaaaacaaggtttcctcataccagagtttgtgttattgtattctcatgctccattatcaagaatttatgctgtcagggtcttaccctcctaccctgcccccatcccctgtcctttcgccactttcatactgtttcattactatcatgattctttcctctgtctttttgtagctgatctttttttaattagttagttaattatttttttttaaagatagtgtctctcactgtcacccaggttggagtgcagtggcatggtctcatctcactgcaacctctgcctcccgggttcaagtgattctcgtgcctcagcctcccgagtagctgggattacaagcgtgcaccacaacacttggctaatttttgtatttttagtagagacggggtttcatcatgttcgccatgctggccttaaattcctaacctcgggtgatctgcccgcctcggcctcccaagtgctgggattacaggggtgaaataaaatggtaacttacaaagtgttaaggaccttgtaaaaattctagataaataaatgtggattctagttcctttgatttaaactctgtgttcttgggaaagtcacttaaccgtttggagcagcagttgtcctcaaatgtaaaatgagagggttgaacaagatcaggatttctgaacatggtaaatgcagaaaaagtttcccattagttctctgaaattacatacattttcatttatggaataaatgtgtttttctggcatatctttaatttttattaggttctaaaaatgcctagaaactactagagtagacttttagatcctttctagatttttaagattatataaaatatggtaatagaatgatttatggtagtttctctatatatcaaagctaattttatgttttagaagttgactcatgataacagtcttgctttgatttgattaaaactttcttataaagaagcctaaataacgttaattttcaacaatttaattgagttatatgattcgtggggggtaacaaaaactaattgtggctgagctgtgtaagttcttttatttgactgtcaaatagcaattaaatttacactcattatttttgcctgtttcaaatacctaatctacaaagccataaattaaatcagtaagctacttttgttcattgctgtagttttcaaagaacttcataggtgttatataccacagtaactcaggagaaacaacttaagaagttatttgtcttagtcattactgccggtctcttgtgttcaaggtacgtgttataagggtaagaaacaaaatattctgcaaggttttaaaaaggaatgggagggtactggttgtattacttcccttttctctgtatcccttttccttcaaaagttacttctgttgagttagcgtcatagcatttgtatacatagttcataatctttgtttttggattttcacagggttccatcatgacacagtaaatagatgattccagggaactttatactgtgttttaccgatttcttagtaaaatagaaacttcttgagtatggagacttctttgatttgatgtctatgccattttaattatggcagaagcccaaagtagacaagccttatatgtttgattcctgtttgggtgttgatttcttaagtatgttgtaaatgtttttcatattatgtaccttttgatgattttacgtagaaatactattattgatgtaagcaatacaaaataaatatattggagtatcatcatcctaaaatatggcacatgttactgaacaaagtgccaagttattgaagtttctccaatatgtgatctgtcattttttgtcaacaaatatttattggtgaatactacatgttaggtaggtacagtgctggattttgaaggtagagtgatgaataagacagccattgtcccggatatatcctactgctcatagttcagtgggagattcagacagaaaatcaggcagttataatgtaatataagaagtcaataaactgggaaataatgggcgctatactagcatattggggtgagctgaaaactaaagagctaatcataggaaataacccagtgaagagggcgagtgctaaacagcactggtaaaggtccagcatatgaaaaaacacagcaaattcagagaactcaaagcttggtatggctaagtttagaatacacagggtgggggaatagtggattgaggccagagtggaagtgaggatcaaatcttgaagactcttcttaagccatgttaaagaatctggatctgaacttgatcctgaaatcggtggggagaattgaagggttttatcttgggagtgacaaagtgaggtttatatttagaaggattgctatggctatgctgtggagaatagcttaggtggggatgcaagactggagaagaggcttctgcagatgtcaaagtgagaggtaatgatgacttgaaattagttgtggcagtgagaatgaagaaaaatacttggattccagagttgtttaggagccagactagacagtactcggtaattggttgtgtgcggaatgagagaaaaggagacaagggtgatgactacatttcttgataaaagggaaattctatttattgaaataggaaacaggagaagaaagattttcgaaggaagataacatgttcgtgtttgagaatgtatgagatgcctgtgtgatatctaaactgagatgtttgagaagcagaatatatggaaatgaagcttcgatctgggctgatgataaaatagacttgaaaatcattcgcctaaatgggaattgaattcatggtggtggataaaaatcacccagccagagcacttacagtaaaaaatagaggacctgttgcaaacccctcaaagataccaatattttggtgtgctgcaaaagcgatgcttgcaaaagatccttggacttcgttgctggaggagcttagaaggaaatgcagcagaattttggatgtcacaggaggagaatgttccaaggagaggtcaacagtgataagtttggactttgctgctggaggagcttacaaggaaacacagcagaattttggatgtcacaggaggagaatgttccaaggagaggtcaaaagtgataaatgttgaccactgagaggttaaataacaactgaacagttcttcggatttagcaagaacggcttcattgcagtgttacagtgaacactagaatgtggtaggttaattaatgagtgggttgtgaggaagtggaggcagccaacacttcttctcaaacaatttgctgtgaatgggaagagagagttaagtggtggtagctggagaagaagctgaaatgaaaataaagaatgttatgtcaggtgactgagaaggtaggaggaaggaatgggaagtggagaacagctgacagcattagccttatatggaaatatggtagttgttacggttgttcgtagatactttgttttcccccatgcatatggtagtgtcaggctgttcagactgccataaccatcagatgggcagcatatacaccatacaaatttttttctcacagttatgggagctgggaagtccaagatcaaggtgacctcagatccgtgtctggtgaggcccactttctcggagatggcacttctctgtcttcacatgattcaagggacaaacgagctcccttggacctatggatttttgattttgtcatctcttcaaaccccaccttccttgtatcatcacaatggtgataaggtttcaacataagaattttgtggggatacaaacatgcagacctagcaggtaggatttaactttcctaatattttgaactcagcatggccacatgactaactttagcctgtgaaatgcaaggagatgtgtgtcattgctaggcagaagcttgcagcaccattgcatgctttgctgtattcttttttcctgtcttgtgctgactgggaatgtttgagatggtagatgctttatcagccagggtctctgaatgaccagggtgagcagcctccctgacaactcacaatgaagaaatgtacttttatttatttatttttaaatactgagatttggagctcttagtgcactatagtctaacctatttggattgtttcaaggactgttgacttttgcattttactataattttttttttttttttttttgagatggagtctcactctgtcgcccaggctggagtgcagtggcgtgatttcagctcactgcaagctctgcctcccaggttcacaccattctcctgcctcagcctcccgagtagctgggaccacaggcgccctcaccacgcccggctaattttttttttgtatttttagtagagacggggtttcaccgtgttagccaggatggtgtcgatctcctgacctcgtgatccacctgcctcaacctcccaaagtgctgggattacaagcgtgagccaccgcacccggccaacattttattataattttaaatagctactgtggaaataggtaaattgactcagaaagcaatgaagcgctgctaaatcgtgtgaagggctatttaagtttggggttttggcaaggagattgaaggaacacacattatagatatagagaatgtaaggaattggttgttattttgaaaaatttacataagatttctccttgattaggtacgtaggtgacaatattataatagcagtctttttttttttttttttttttttgggggggacgagatcttactctgttgtccagggtggagtgtagtggtgtgatcttggcttactgcaacctctgcctccttggcccttggttcatgtgccaccatgccaggctaatttttttttttttttttttttttttttttttttttaaagacatggtcttgctctgttgcccaggctggagtgcagtgctgggggatcacagttcactgtggccttgacctcctgggctcaagtgatcctcccacctcagcctccccagtagctgggaccacaggcacttgccaccatgcctagctagtttttttgtattgtagagacgaagtctccctgtgttgtacaggatggccttgaactcttgggctcaagtgatccccctgccttggcctcccagagtgctgggattacagtattacagtcttaaaatgagaaattgttaggcagttaatggtaaccttcatttctctcatattttacttcgaaggtctcaaaccaatttcctgatgttttgatatttttatgaatcagataagccctttcatgtttgtaatatttcataactgttggaatattgcatgtatctaaagaatcttgtagaagtttagcaacatttgatcatttattctaaggaggcttttgtttagaagtattaactttaggtaaatttcttacggactctttcagctgtgggtcattttatgaaatataagccaatgttgatttataataatttatagttctctgataaaaatatatcaataatgtatgctttctggatataaatgatcaaaaccattagaaaatagaggtaaaaatcaattttattttttatttttttattttttattttttttttattatactttaagttttagggtacatgtgcacattgtgcaggttagttacatatgtatacatgtgccaagctggtgcactgcacccactaactcgtcatctagcattaggtaaatctcccagtgctatccctcccccctccccccaccccacaacagtccccagagtgtgatattccccttcctgtgtccatgtgatctcattgttcagtccccacctatgagtgagaatatgcggtgtttggttttttgttcttgagatagtttactgagaatgttttccaatttcatccatgtccctacaaaggacatgaactcatcattttttatggctgcatagtattccatggtgtatatgtgccacattttcttaatccagtctatcattgttggacatttgggttggttccaagtctttgctgttgtgaataatgccacagtaaacatacgtgtgcatgtgtccttatagcaatacgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctctttctccacatcctctccagcacctgttgtttcctgactttttaatgattgccactctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgtgaaaattttctcccattttgtaggttgcctgtacactctgatggtaatttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggttgtcaaagatcagatagttgtagatatgcggtgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctataaattaccttgggcagtacggccattttcatgatattgattcttcctacccatgagcatggaatgttcttccatttgtttgtatcctcttttatttccttgagcagtggttggtagttctccttgaagaggtccttcacatcccttgtaagttggattcctagatattttcttctctttgaagcagttgtgaatgggagttcactcatgatttggctctccgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttgtttccttctcctgcctaattgccctggccagcacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaatttattgagagtttttagcatgaagggttgttgaattttgtcaaaggctttttctgcatctcttgagataatcatgtggtttttgtctttggctctgtttatatgctggattacatttattgatttgcgtatattgaaccagccttgccgtcccagggatgaagcccacttgatcatggtggataagctttttgatgtgctgctggattcgttttgccagtattttattgaggatttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccagttcctccttgtatctctggtagaattcagctgtgaatccatctggtgctggactctttttggttggtaagctattgattattgccacaatttcagctcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatcggtggtgatatcccctttatcattttttattgcgtctgttcgattcttctctttttctttattagtcttgctagcggtctatcaatcttgttggtcctttcaaaaaaccagctcctggattcattaattttttgaagggttttttgtgtctctatttccttcagttctgctctgattttagttatttcttgctttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcattttgttatgtacccagtagtcattcaggagcaggttgttcagtttccatgtagttgagcagttttgagtgagattcttaaccctgagttctagtttgattgcactgtggtctgacagacagtttgttataatttctgttcttttacatttgctgaggagagctttacttccaagtatgtggtcaattttggaataggtgtggtgtggtgctgacaaaaatgtatattctgttgatttggggtggagagttctgtagatgtctgttaggtccgcttggtgcagagctgagttctattcctgggtatccttgttgactttctgtctcgttgatctgtctaatgttgacggtggggtgctaaagtctcccattattaatgtgtgggagtctaattctctttgtaggtcactcaggacttgctttatgaatcttggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagtctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcatgatgatgttagctggtgattttgctcgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgttaagtattttatttctccttcacttatgaagcttagtttggctggatatgaaattctgggttgaaatttcttgtctttaagaatgttgaatattggcccccactctcttctggcttgtagggtttctgctgagagatccgctgttagtctgatgggcttccctttgagggtaacccgacctttctctctggctgcccttaacattttttccttcatttcaactttggtgaatctgaccattatgtgtcttggagttgctcttctcgagaagtatctttgtggcattctctgtgtttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccatcgctgataccctctcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcctgtagctgagagtaatttgatcgtctgaagccttcttctctcagctcgtcaaagtcattctccatccagctttgttccgttgttggtgaggaactgcgttcctttggaggaggagaggcgctctgcgttttagagtttccagtttttctgttctgttttttccccatctttgtggttttatgtacttttggtctttgatgatggtgatgtacagatgggtttttggtgtggatgtcctttctgtttgttagttttccttctaacagacaggaccctcagctgcaggtctgttggaataccctgcagtgtgaggtgtcagtgtgcccctgctggggggtgcctcccagttcggctgctaggaggtcaggggtcagggacccacttgaggaggcagtctgccagttctcagatctccagctgcgtgctgggagaaccactgctctcttaaaagctgtcagacagggacatttaagtctgcagaggttactgctgtccttttgtttgtctgtgccctgcccccagaggtggagcctacagaggcaggcaggcctccttgagctgtggtgggctccacccagttcgagcttcctggctgctttgtttacctaatcaagcctgggcaatggcgggtgcccctcccccagcctcactgccgccttgcagtttgatctcagactgcagtgctagcaatgagcgagactccgtgggtgtaggaccctccgagccaggtgcgggatataatcttgtggtgcgccgttttttaagcccgtcggaaaagcgcagtattcgggtatgagtgacccgattttccaggtgccgtccgtcacccctttctttgactcggaaagggaactccctgaccccttgcgcttcccaagtgaggcaatgcctcgccctgtttcggctggcgcacggtgtgcgcacccactctcctgcacccactgtctggcactccctagtgagatgaacccggtacctcagatggaaatgcagaaatcaccatcttctgcgttgctcaggctgggagctgtagacaggagctgttcctattcggccatcttggctcctctcttcaaaaatcaatttttaagtaggccttcatagctaagatggaaatggaaaaacagcagcagtaagaacagctatgcaggagtctagcttcagagatcttggagataagaacttcccggcattttcttataacctagttggggtatcactacacaattactgcgtgaggttgagtactgtagtgatttaccaacactgttatcttacggttttcttctgagatgttatcattcgtggatggtatataagatatcctgttctaaaaaatcttatttcttagtgtggcatagctaataaaaccgcttcgcaatttatctttccatccgtcttatctcctctcccttaagatgagtaatccactttaagcgttaagaaataggatgtaaagtgtaagggtggtttgtgggtatattagttttatattgatgcataaaaaattgccacaatttagtggcttaaaataacacccatttcttatctcctagtttctagatgtcagaagtctgggcatggtgtagctggattctgtctctgttaagggtcttaggaggccaaaattaaggtgagaccgggttgcgttcttttctgaatctctgggtcctcttctcaactcattcaagttgtaggcagaattcagcttttggtagttgtaggaaggagtttcttgttttcttcctgcttgtgttgctctcagttctttgctgccaaccccaggttccagccatggagcaccatctataggcagttcacagcatggctatttgctttattccagatcactaggatcacttttgtgacacttcttttaaaatgttttcctgattaggtgaggctaatccaggataatctctcatttaaataactcagagttaatagattagagaccttatgtttgcaaatatttgccatataaggtaacataattgtgggagcgctgttctgctatatcacaggtcttgtccatgcccaggggaggcagttacgttacagtggttcattggggattatttcatttatgcctactaaagtgggcaagcctgcacttttagattttatgtagttttaaatggtggcttataaaacccatataaacaggcatgacagtcaatgtatgggacagtattatttaatataagacatttaccaatgactataaaattaaagtgatgataactttatcatcacttcataaataacttcatgtgtgtcagtcagggttcagtcacagatgcaggaccactagaaggtgaatctctatgtctctcgatttatttgcaatggtgtgaacctgttaagtagtctctgaaaggctactgtttgcatggtgatgttggagattgtggtctgagggcaggccgttgggaagattgctgtaaggtaaggaagattcaagaacaagctggaatcccagcattttgggaggctgaggtgggcggatcacaaggtcaggagtttgagaacagcctggccaatatggtgaaaccctgtctctgctaaaaatacaaaaattagctggttgtggtggcgcatgcctgtaataccagctactcaggaggctgaggcagaagaattgcttgaaccggggaggcagaggattcagtgagcccggattgtgccatagcactccagcctgagtgacagagtgagcctccatctcaaaaaaaaaaaaaaaaaaaagaacaacctggaacctacaaaggtggactgaaaccatcctcagagtagttttaaagctcatagttcttaaattgcatgatactgagaaaatagttattcataaaagtaagcacttgtaaataagaattatttcaagtaattcacgtatcttgtagtctcagaatacctattaaactggtctggaagtctggaagattgataggcattttccttttcatgaggatatgaacaattaaaattcaaagttaaattttcattgagtctgaaacaattgtttggtgggacatacttttaaaatggattttaatatattaaatgctttaaagaaatgtttccctcttcctctccattataggagaaaccattattattctgtcagataattacttgaagtttcaaaatttttaaaaagtgtcttttaaagtattagtttagattttttttctaatttttgtgactggcacttcaaaaatcattagaaacttcgtaacaatggggatggaattttcaaatcgaggttattaatattatggagaatagtagataactaagtttgggcagccatgttgtttttgagttaacatttctctaacagctaaaataaaaaataaaaaagtgatttcttgtctcatttgaaatattcatatacaaatcttaacgtcatccagctgtcaacagagtagtattataaaaaagaaaattgtggaatccactgtctaccgtatattattactgaatattattgaaagatacttaacatctttttaatacccccttttgtttgtgaatatgtgcagtgtctatttgaacacatttgtcaacagctttagagctacttatgtcattttccttctgtgtctttcattcttttattagattttattatatttcttttacatccgttgatggtgtgccagacctgtttaccgtatgagttttctcttcttcacagacacaagctagatgacatttcccagtgtcccatgtttagataggacattgtgacagagttctaggcgatggagtgtaaacagaggtgatctgtgtcgtctgcagcttgacccatcaagatttccccacgcttgtgctggagtgtccactcccaccctgttctaaggactcatcttgtttgcatcacaagcttccccgtgtggttctgtgttagtgtgtccctgagatttggaagatagaagagaaggagagaggccactgttctttacagagagctgaggcagattcatgggcagatatgaggtttgaagcattgttcagggaagtccaggatgaccattgtatgcattttgtattgttgctgtaacaaattatcacaaatttagaggcttaaaacaacagcaatcgattatcttacagttctggaggtgggatgtccaagtcagtctcactgggctaaagtcaaggtgtctgcaggtttgtttcctgctggaagcgttgaggggagcctttttttttttttgtcttttgcagtttctagaggctgctggcattcctcattatttcttacttggcatcattccagtctctgacttccattcccacatctgaaaaactgactctgattttcttgccttcctgttacagagacccttactattttggatctacctggctaatataggataatctcttcccatttcaggatcatttgtttagtcacatcttgtgtcaggtaaggtaacaattaacctgtttcttggaattagaacatggacatctttggtgggttgggaaggtcccacttttcagactcccacagctacctgcttagctgttgcagaccaagatagttggtggaagctttcaagacattcatacactccaggtgtagaaattcaccaggctcttgagaatcttctgctttggagctataggcagagattgtatctgttttctttaactttgtttcttttgtccttccccagtggtgttttaagcttcatctgattctctgtattaaatactttcatgcttggaacacatgcagtggtttctgttttcctgactgaagtctgatacaaagctctttccctataactaggttgagaatgtaaagagggacctggaaagccatgtgttgcggatggcagagcagccatcagcctaggtgtggatgactgtgtggtacagtctccttaatctcctgaatttggctctgtactattatatggatgtaagccactaaaattttggggtctgtctggtactacaaaactttctatagcttaattcattcttactaataaagatgacttattaaaaactaaataccaaaacaaatatcatcgcttatgatgtatttaaacacacctgattcagagtagtacattttccttgttttttctgtccatcgtttgttaacaaagccactcagcccctgaactaacttactggtatgcattctcagtgtcttctctagacaacgttatcagaagatgctacagtttccatatttacagcagtgattcatgtaatatatcttttgccatgactagactaaaacatagaattcagaagccattctttagtagtatgttccctcttatataagatgcagcagttttattgtcagtgtatgttcatcatcagctttattaattttttcctggagctcagaaacggattttagtggttggcgttttgaggaaaacaactttaaatcattttattattcctcataggattattttgaacatgtgctattgttaccattttaagatgagggggcctaagtttaaagatttttgtcacatggtaacagctgctaaaggaaagagctggaccacaacaactgataaggaaaaaagtttaccacttttttcatcatatattcctcagaggaggtatatgtacttgtttatccgacttcacagaagacacatttttttgttgttgttgttgttgttgttttttttttgagacagggtcttgctctgttgctcagactggagtacactggcacaatcacagctcacgacagccacaaccaacctcctaggctcaagcaatcctcccgcgttagtctcctaagtagctgggattataggcacgtgtcatcatgactggttaatttgtgtgtatgtgtttgtgtttgtagagacaggattttaccatgtttcccaggctgctcttaaatttctgggatccagttatcctgcggcttcggcctcccaaaccattgggattgtaggtttgcccggccaacacatattcttacaggttgtaacatgagtcatattttggtcttcacttagtgataaccaccaggaggggcttttatactatgtgctcttggctaagataatggcaaattgggaatgtgcaacaaattctagtcatggctcttttaacttagtgatcttggttaagccaccatatctttctgggtcacagtactttcggcagttaagaattagacttgagccagatccaagattctttgaactctgacattttatcattccttttaatgaaggaactgaaaaacatttcggggcagtggggaagtggaagcattattttcagaagaacactgaagttagtattttttcaattaacaaaaagttcttcctaacttactgtttctttacttagccaccaaacattaatcactgtcttggttctagcacagtagtttaaaacgttttctcatcaaatattagcataagatcctttgcattatatatcttcaaatcatccatggaaacttgcccagagtaggtacttacttatttaacatttaaaatagtagcaaacattttcacatacttaagattcctcttaaatagttaagtatcataatcctgacaggtcttcaattgtcaatggctttgcatataaacctgagtagctctcttgtatcgctttttaaatatcaacttgatgaaatcctttgtcatatgtaagattgcagtcaagcatgagagtgagcaaaaaataatgtgacatgatgggttgggatagatactagggtgaaatgaggatggatgtctacatagggacaacttttgtaagtggttggaatgtaacaaatggtttttgcctctctacaaaattttgtggttattgtgtgcacattttgaatacttagctaaggactatctcctgtggcatatgccgaactaaaaagcactaaaaaattactaagatgaatgccatgtttgcatttgggttgttggtaatgaaagacacattgagtaatgtgtggtactccttatttttgtcctctgtaggcctccactcctttttctcctctttgttttcatgttaacaacccccttttctatggccacattggtagcatattatcaggcaaggctacacatattactcattcctcttgtcacgattggcacaaggttgggaaagtgactagagccattctctgagatttgtccaaatggaactagcagaatgattaccttgctcattggcctgtgaaattggaaggatgtgcttttcgtttgtctctcacttgggcacgaaaaagtgtggtgtgcagatgctaagcaaaaaacacaaagagaagaggcattcatttattccataaagatttaagcactagctctgtgccagtccttgttctgggtgccatcaatgcagaaataaacaaaatgtataaaaattgttgccctcagggagcttctatagctagagggagtactgacaataccagttaagttctcatatctggtcattcctgaaaccaaatttatcttcataccttattactatatgaacttataaagtccattttgcctaaactagattgaattaggcttatgtcatttgtgatttaagatgttttgataaacatgaaagacatttataacttctttcagctttcattaagaagataatacagaaattaaaaatacacaaattctttttttttttttttcctgtggagtcttgctttatcgcctaggctgcagtgcagtggtataatcttagcgcactgcaacttccatctgccaggttcaactgattctcctgcctcagcctcccaagtagctgggattaaggtgcctgccaccacacatggctaatttttgtaaaaaaaaaatgtaaattcttattggtatatttgtgtaaaactttgtcatgtattttcacacttttttccatttttggtacttggagattacattatcatttatttttttttcctcatatttcattctaagctttaacctcatggttttctggcaaggcacattggttgactactttctttagtcattcaggaggaaataactattttgtttagtaaatattgccaagtagacctgatttacattagatagttttgctaagtcattattgtgcggcttgttatatattaaatgatcaaattttgaaaattataaaaaatcagtaacagtttcctttattactgtatgattaagagtaccatgcgaaatgtttatttatagtcttataattgttgaaatgtttttgtcccatctgcttctgcatttggcataccaagtactgtaagatagataagctactaaattcttttagtcattcttccattgcactgttctgcgtctatatctctatatagtttttcttgctacttgctggaaaatacatgggcagtttattttcatggaaaatatatactccataaatatagatgaattgaggtgataatcagagagtttcctcgtgaatttgagataaaaaattacagcatcatgataatgaaactatatacacacacaaagtttatttaacttgccttggaatatatgtgtaattatcctgacatctggatctgggcaaagataatagcttatggccagaaggagccaggtatttagaaggagcgtgagtaaataatttatgattcaaaccaggacatgtgggagagaaataaagtgcaattaataattttgctgagatgacaggagtaaactgggactttccctgggctaacggggacatctcgttacgtgagttagaggtagggtagacggtttgaaaatggatacatagtgtttgatgcatttttgttgattagcataatttttaggaatctcagttgaaaatttttcttccttgtctgtttgtattcaaataccgtgtcacactcttgtgtatgatttgtaatccatttagtgcggaccaaaggtttaacatgttgctttggtggctttagtgctgcttatttctctaatttttaaattcagcatttaaaattttgtcatactgcttcagtcacttcatcgcttaagaggcaattcattttctttaaaaataaataggtttatttgtatccattataaataattttggatcctatatatattgatggaaaattttgctcaaataaaaccttcaggtttataaaagattcccacattattactactcttggttatagcttgtccatcgcattataaattcttgactactttctcattgtagggaagttctgattttgcatgttatatgtcatctgtgcagagtaatttatttcacaaaacactccacatctttttccagtgttaaagcaaccttgttttataatgtattttacacacacacacacacacacacacacacacacacacactcttactgaaacacatctaattgaatgttgactaagttttctaatgttgcttgctggaaattggttgaaagattgtattctttggtttgaaataagttgcaactgtatttatagcatatgaagctacataaattcagatagaggcctatgtcatttttttccctgtgtgaatcaaaagagcttggaagaagaaattggaaatgactttaaaaacatgtgattgtttggatttaattaagcggatgctacgatttatattttgttgttacatttcaatgtagttgaactaatgataactaccatttatttaatatttgctaactattttacatgtattatttcatttaagcatcatcacaagcttagcatgattttattgtataggtgaacttcaagagttgaagtaatttgcctggaatcatgcaacttgtaattgggccagtattcaaatgcagaactgacttcaaagctgttcttctgatttaagtactcttttatcagtgcttctcatactgaaagaagagagtgaatgcatacctctggggatgtggaagtgcagcatgaagctgccggattgttcaaaatatatatttgatcttatatatattaaaacattttgcaaactttgctttctattccattgcctattagttttttttttttttttttttgagattgagtcttgctgtgtcacccaggctgaagtgcagtgatatgatcttggctcactgcaacctctacctcctaggttcaagggattctcctgccccagccagagtagctgggattataggtgcctgccaccacacctgactagtttttgtatttttagtagagatggggtttcaccctgttggccaggctggtctcgaactcctgacttcaggggatccacctgcctcggcctcccaaagtgttgggattacaggcgtgagccgctgctacccaccgctattaattttttttaatgaaattgttttatactttcaattgaatacaggtgtaactttgagacatgggcttggtgccagaccactataataaagcaaatattacaataaagagttagcaagttttttggtttctcagtgcatttagaagttaggtttacactgtattgttgtctattaaatgtgcaatagcactctgtctaaaagaaaagtatatataccttaatttaaaaatgctatattgcttaaaaaatatgatcttctgagccttcagtgagttataatccttttgctggtggagggttttgcttcttgttgatggctactgaccaataagggtactggctgctgatggtgggagcagctggcaacttcttaagaaattaagttggccacattgattccctctttatttcatgaaagattcctctgttgcatggaatgctgtttgatagaattttacccatagtctgactttttgcaaaattggagtctgtcctctcaaaccctgccactgctctatcaactaagtttatgcagcgttctttctccatcagagcttttgagtgaccaggtgctttggctgtgagctgtaatatattgagaggaatcttttttttctgagcagtaggtcttaatactgggcttcaaatattcagtaaactgtgctttaaacataggtgctgtttttcatccaggctttcttgttccatttatagagcacaggcacaatagatttagcttaattgcgctggaccttaggcttttcggaatggtaaatgaacgttggcttcaactttaagtcaccagctgcattagcccctaccaagagattcagcctgtcctttcaaaccaggcatcgacttctctctagccatggcatcgccttccagtagaaggatgtttagtctactctgaacatccgttgtttagtatacccgtctccatcaattatgctagctaaatctgggtaatttgctgcagcttcttgcagcataaacacttgctgcttcatcttggacttttatgttatggaaatggcttctttctttaaacctcatgaaccaacctctgccagctttaaatttttcttctgtagcttcctttcctgtttcagccttcattggattgaagagacttagggccttgttctgaattaggcttggtttaaggggatgttgttactgatttgatctatccaaactatttaaactttctctgtatcagcaataaggctgttttgctttcttaccattgatgtgttcactggagtagcactttaaatttccttgaaaacattgcatttgcattaacaacttgtctaactgttcggtgcaagaggtgtagcttttggcctatctgagctttccacatgccttcctcactaagtttaatcatttttagcttttgatttaaagtgagagacatgtgactctgcatttcacttgaacacctagaggtcattgttgggttattcattggcctaatttcaatgtttttatgctttaggcaataggaacgtgtgagaagagtggaggtggggaatgggtggttggtggagcagtctgaatacacatgacatttatcgattaaatttgccatgttttacgggcaccatttgtggtgccccaaaacaatcacaaaagtgacatcaaagatcactggtcacagatttccataacaaataataataatgaagaagtttgaaatattgggagagttaccagaatgtgacatagacactgactgagcacatgctgtgggaaaaatgacacccatagagttgcttaatggagagttgccatcaaccttcaatttgtaaaaaatgccttatctgtgaagcgcagttaagcaaagcacaataaaaggaagtatgtttgcttaactattgcttcagtatagtgttctctctctttctctctctctctctctctctctctctctctctctatatatatatatatatatatatatataaaagtttttttttttttgggcataccatcaagtcactcctgggaggcctaggattattctgtttgagaaagggagtcagagctgccttccaatccacatccagggtaattaccagttttaaccttactgggcttgtttgtgtcaggcagttaagctgttcctacacaatagcgtggcggtgggaatggctaggttggcttgccacacttccgtagattgtgctgctgaagatagaaggagcccagtgggtttatatttcagagcacagtagttagctgaacctgaacctagctggcttgggttcagatggtctctccttcccccctcatcccttgagggcaatgcagagggagccgctggtggatgctttaactcagtgggttggtgtcacagctgaggaagttgtttatgaaccctcagacttttaaaggggctgctagcaaacctctaattttgccctgcaggagatacagctttattattctggtgaggaaacaaaacaaatctgtcttctgcctcagggaagccctgcttctgaaggctgattttttttaatgctaacatcatctaaacatactttggaagaaaactgtgcagaaatgtcatggagaattgtttcgtcagaacatgtcatattgcaactttcctgacagttccaaatatggggggtgataggagggggagagaatattatcttcttcccagtagatggtagagaatgaagaagctgactaaaccagtccttttcttaggtaattttaggcacttccataccattttttggtgatgttttgttcctggaagttattccagacttttttgtttgaatcctttattgtcttggatggacctaacaagagaagttcagcattcaccgtcaagggaagctcactggcattcaattgtcaatccatttcacagtcacctgttagtgttttgtgcacagtgagtgccctcagtaatttatagtatctccctaattccttactcccacccttcctcttgcgtttctccttctctctctttgtcttaatctatagagactccaccttttgcattcttcatcgttgctaccaaaaatatacaattataaataaatatgatgagtatgggtaagttgtacagattatggagttgtcaagaggcattatattttagtggtcaacttacattcttattacatgttttgttgtcattctgctctcatttattccctaaaacagtgttcctcagactctctcttttgcttaggccctttcctgtaactggaagattgttttctatttttaatcgttaggttagggtgggtctggacaatagatattatttagtaaagcattcagctgcctcttcaccccttgagagtaatttataagttggtaatttttctgataactgtctcacaaagcttacttttagggttttgacccatagttgcttccatgagagctagcttttatttgatagctaacattttttcattttcttttgagaatttgagagaaattttctctacagagaaatggatcaatgaaacattattttaagctagatgttactctttatgttcaaatgggtttttatccaggtgtaaatcacttggaaaacatttagagcaatcagccagttagaacctaataaacatattcaactttatactttcaattataaggagtgtctcctgctgtgaaactaactattctagtgttattgtattttaaggttattttgaaggagaatagagagtttaactttggggtggttctttttctgctgtgcttcatttttatttcttgaagtatttagaaaatttttatactgactataaacttatccgtagcaattaatggtttaaaaaatattattagattgtcatgtaaaatgcacattttatgggacattatgaactgaataattttgcgatagatgtattttttttgcatataaacctatactactttatgtttggaattaataggaattaaagtggattttgtgtacttgatttttaacactttgttttaaaaggactaagactgctttgtcatgtagccaatgtgttgtattaagattcctcagtgagaattatttgattttattttgcaatgatattcaaatatatttttcaagtcaaatggaatttttatgtggcaactaatttaaatattaaactaaatatctaacatatgtgtgtacattcattgcttcattgtaagaggataatatatattttatttcaaaaattcttctgagggctgggtatggtggctcacgcctgtaatcccagcacattgggaggccgaggttaggcagatcacctgaggtcaggagtttgagatcagcctggccaacatggtgaaaacccgtctctatttaaaataaaaaaattaattgagaatggtggcgggcatctataatgccaggtactccggaagctgaggcaggagaatcacttgaacccaggaggtggaggttgcagtcagctgagattgttccactgcactccagcttgggtgacagagtgagactctgccttaaaataaataaataaattcttctgagatgtacttttgcaaatattatacatagtttatatcatttttttgtggaaattatacatgtttaggctttaaaaattgcttccatgcccaagattgaaatgaattttacattggggaaagtgttataaaggtataatcaaatttatggtttatatattcaataatatattgtgaattgatataataactgagtaatataactgtttcacattttgaaactgatttcagctttttccttttgaaatttagaagttatgatgaaatttcttaatttgaacctattactaaagtttccattttaatttttctaattaatgatctcttgttaaagcaatgaatcagagtttttgaatgatgtgtgcagaattcttgcttgtttatgagagactgaattattagttcactagttgatgaactggttttcttttggtaggtaattaagaatcctctgctttttctttctttttttttttttcttggtcctcttgttttttttttttatttttttatttttttatttatttattttttattatactttaagttttagggtacatgtgcacattgtgcaggttagttacatatgtatacatgtgccatgctggtgcgctgcacccactaactagtcatctagcattaggtatatctcccaatgctatccctccccccctccccccaccccaccacagtccccagagtgtgatattccccttcctgtgtccatgtgatctcattgttcagtccccacctatgagtgagaatatgccgtgattggttttttgttcttgtgatagtttactgagaatgatgatttccagtttcatccatgtccctacaaaggacacgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcacgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctgtttctccacatcctctccagcacctgttgtttcctgactttttaatgattgccattctaactggtgtgagatggtatctcattgtggttttgatttgcatttctctgatggccagtgatgatgagcattttttcatgtgtttcttggctgcataaatgtcttcttttgagaagtgtctgttcatgtcctttgcccactttttgatggggttgtttgtttttttcttgtaaatttgtttgagttcattgtagattctggatattagccctttgtcagatgagtagcttgcgaaaattttctcccattttgtaggttgcctgttcactctgatggtagtttcttttgctgtgcagaagctcttgagtttaatgagatcccatttgtcaattttggcttttgttgccattgcttttggtgttttggacatgaagtccttgcccatgcctatgtcctgaatggtaaatgcctaggttttcttctagggtttttatggttttagctctaatgtttaaatctttaatccatcttgaattgttttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggtgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaggaaagtcattggtagcttgatggggatggcattgaatctgtaaattaccttgggcagtacggccatttttatgatactgattcttcctacccatgagcatggaatgttcttccatttgtttgtatcctcttttatttccttgagcagtggtttgtagttctccttgaagaggtccttcacatcccttgtaagttggattcctaggtattttcttctctttgaagcaattgtgaatgggagttcactcatgatttggctctccgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttgtttccttctcctgcctaattgccctggccagcacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaatttattgagagtttttagcatgaagggttgttgaattttgtcaaaggctttttctgcatctcttgagataatcatgtggtttttgtctttggctctgtttatatgctggattacatttattgatttgcgtatattgaaccagccttgtgtcccagggatgaagcccacttgatcatggtggataagctttttgaagtgctgctggattcgttttgccagtattttattgaggatttttgcatcaatgttcatcaaggatattggtctaaaattctctttttttgttgtgtctctgcctggctttggtatcagaatgatgctggccctcataaaatgagttagggaggattccctctttttctattgattggaatagtttcagaaggaatggtaccagttcctccttgtacctctggtagaattcagctgtgaatccatctggtcctggactctttttggctggtaagctattgattattgccacaatttcagctcctgttattggtctattcagagattcaacttcttcctggtttagtcttgggagagtgtatgtgttgaggaatttatccatttcttctagattttctagtttatttgcgtagaggtgtttgtagtattctctgatattagtttgtatttctgtgggattggtggtgatatcccctttatcattttttattgtgtctatttgattcttctctctttttttctttattagtcttgctagtggtctatcaattttgttgatcctttcaaaaaaccagctcctggattcattgattttttgaagggttttttgtgtctctatttccttcagttctgctctgattttagttatttcttgccttctgctatcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcattttgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccacttggtgcagagctgagttcaattcctgggtatccttgttgactttctgtctcgttgatttgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagtctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcatgatgatgttagctggtgattttgctcgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcattccctgtatttccttaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccatcgctgataccctctcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctgagagtaatttgatcgtctgaagccttcttctctcagctcgtcaaagtcattctccatccagctttgttccgttgctggtgaggaactgcgttcctttggaggaggagaggcgctctgcattttagagtttccagtttttcagttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgcagtgtgaggtgtcagtgtgcccctgctgcggggtgcctcccagttaggctgcttgggggtcaggggtcagggacccacttgaggaggcagtctgcccgttctcagatctccagctgcgtgctgggagaaccactgctctcttcaaagctgtcagacagggacccttaagtctgcagaggttactgctgtctttttgtttgtctgtgccctgcccccagaggtggagcctacagaggcaggcaggcctccttgagctgtggtgggctccacccagttggagcttcccgtttacctaatcaagcctgggcaatggcgggcgcccctcccccagcctcgctgccgccttgcagtttgatctcagactgctgtgctagcagtcagcgagattccgtgggcgtaggaccctctgagccaggtgtgggatataatcttgtggtgcgccgctttttaagccggtctgaaaagcgcaatattcgggtggcagtgacccgattttccaggtgcgtctgtcacccctttctttgactcggaaagggaactccctgaccccttgcgcttcccaagtgaggcaatgcctcgccctgcttcggctcgcgcatggtgcgcgcacccactggcctgcgcccactgtctggcactccctagtgagagaaacctggtacctcagatggaaatgcagaaatcacccgtcttctgggtcgctcacgctgggagctgtagaccggagctgttcctgttcagccatcttcctctgctttttctgtgaaggtgtaaacagtgaggtacttgaaggatgagacttaaaccaatcttttatgaatttgttttttactgttattggaaatggaagatacgtaccttcatgctataatgaaggacattttgaccactttgaatatcaacacttaataagtttctaaaaatttatgtttatattttaaatggcagttaaaaattaaagctcaaagagactaaacattaaaggtcctataaataacattgtgaaagttgatcatacaaattgggtcaatcttggcacacccagctaaaacagagtcaagaggctagggggataaagcactggtcacatgacattgctctgagaatgtaattctctgcaagcctgctgctgaaactgcctggtgtaacctgaaaccagttttatctaatagctgctggaacaacctgcctcaactcgaagattagtcttaatcagttacagtcactcaccacctccccagaactttactagagccagtgacctttctttaaatatgatatgtaacacttctcctttttagaagacctacaaccttctctttgttcttcagacatactgaagaccactcagtctgtatatacctcaaattgcaattcttgcttcccaaatcaaatcttacatttagagatctgtctgtacatttttattttgatttcaacaacatgtaaagatacatgtagctaggtgaccatgaagttgatcaatatgactggaatacaaatgagaatgaaaggagaggctagtaaaaattaccccatggcaataagaataaactagaactgttctaaacaaatctaatgcaaacagggtgagattttatgtcgtcaaaatgaaattaaatagtatactttagaaatctttttaaagccatgtaagacattaaacatttaatatttgatcacagtgattatagaattcagaattatgttcaattcttttttggtttaagttcatagtcattttgtaataaaatgcggaactaataaaactcactttagatttgaaagctagagctagcgcagagaagattgacggtgatggtaaaagtgaaaatcctgctacatgaggattactggaagtaatttgccaagtttagcttggaaaatgaaaaataataggcttattattgttccctttgaattataaaaatgtgttctatggttaaggctttttctttgtagctccagagagcaaaactagatcccgtggatggtaaatatatgcattcaatgtaagaaagaagaattttgaaatatcattgttttgaagtgcaattggctgcttagtgggatagcaggatagcaagctaatttgtactggaagtgttcacctttagtgctcagctgtcaagactgtacatgccatattttgtgggaggtttaattaaatttaattaaaatggattttttttcttaagcaagtattggaagagtacattaaaagaagtataagccatttatgtatatcctaaaaccagaaaaaaaccacaaacccttattttattagagatctttcttaaaatgaggatgtagtttttggaaggaaaaatcaggaaaggaaataagaggagtagcaccttagtaagcagatgtgctgaattaaatctcatgatagatagtgtcagttgtttgtcctctgtattgcaggggcagtattttgtgagaatatgttgtttaaacaggtacttaaaggcagtgtaatcaaacacagcagcttaactgttttaatatttctgtgggaatttgaaatatttagatgtttaattgatgttaaacttgttaaagatttccttaagattcttaattgtcaacgtcataaaagtatttttatggttaatttgagtaattagagaaccaatgtgttggcgtgtagttagttataaaattatcagtctcagcacaacattgacttaaaggcagggtgatccagaaggataggggtgtttgttttgttgtttcttcccccgcttttttgtattataaaagcgagaaaagattctgcttacatgtaggaattgtcttacaattctcttatctgttttgattaatttggtcattgatcatgcattaaatgagtgctagcactcttacatgttcaggggaatctaaaggtaaagaaagtacatccttttcagagactctttagtgagggagacaggaaaactaacaagagcaatataagtgctatgatagagccactttatgagctaataagaagtctgtatctctgaatggtaagaaatggtaaaggcttcctaggtaattgagtcaatacagttttgacaaatgaggaagagtgtgacatgatggaggctgcccgttggatctggaatatgtgtgtatgggtgggggtggtgaaggaggagggtgaatggaaaatcccaggtagtgagaacaggattcattgacacaggcaatctgaaagtatagtgagtttagggaatttcaaatagtgggatcttttatatgtacagggttctattgggatttatgaagtgagtctggaaagatataattggaggtaaagctttgagagatctgaaatactatttggagtgtttgtagtttatattgtaggagacataaagacattgaacgatgatatacagatatatattacatatctgcttattaaaaagataacctttacattagtgtagaaggaattttgtgttagaaatactctaaaataagattcttgaaatcatggttatgaaagtattacatcggaagagatgatgaaaggctactgctactatgttagaaatgaagagaaggggatagagtaaaaaattcatcagttgcctaactggcgttaggaatagagtggcattaggaatacagatgtgggagctatatagggggacagagttcacttttagatccatggcatttgaagtccttggcaatttcattcaataaaggttcaagagagaggtacagatttgagatggataatgttacagtctcaccaatgcaccacaatgtagcagtttcttattctgaggtatcacctggagttctttttctcatgacctagagaagtaagaaacgtggacacaaagggtgaggttggagcgaaagtttaataagcgaaagataaaaagctgtctgctgtgaagaggggacctgggagagggttgtgtttttttacagttgaatgcaaaggcttttataggaaactgatgagggctgggcatctcatttgcataaagcgtgaatttcttgtagctccaccctgtcttcctaatgtgcctgtgggcccttagcctagaatcaatcactccctattggtttgttccccttactgtggatgttttaggggatggaattttccattgtgggactatctgggcaagtcacctgtgtagccttttttacctgttcgactgtcggaatgtcttagtcaagcccctcagtgtctgtgcctgcagactgttcttttgtttgaaaagattcaacggaggacccaccctaactgcctgcgtgagcgtgaccgggtttttttgtttctcctctctcaataatagctgccataatgtgtaagtagagagttaaagccatgaaagtagatgggatcacccatagaattcctacggaataaagagagaagatggctgaaggaaatggaattctgaagaaaatcagtgaagaaggttgaggagtagtcagggagttatgaggggaactaggagagtatggtatgtcagaaaccaggaaaaatattttaaagatggaatgattaacagtgctaaataattatgttcatataaggtcaagtcagagaagtatccatatatttgcctgttaaaaggtcatttttagttggccagaaacaatttaagtcagtagtgactgtgaaggactgaatgttgtgagttaagaagtgaattcaaggtgaaaacaaacagcttacctttgagagaagcttgtataagtcattagtggggaaaaacaccgttgtagtggggtggggaacaacaccgttaacttgaagtaaatgcatattcaaaagaggagttggttcttgggtggggtgggatggagagaccactttgcttttataggaaaacagcagaaggagtcagtaaagtaagataggagagtgggatagaagagggctaaatgattgatcaaggtctgggaataattggtttcctggaacacaagtaaagagggtcgcattacctcaggcccagccaggacacacacttctatctagatcaggagcgctagaggtaaatactgtgaatgcaaatcatttggagtgagaaactgaggagattaatgcaacatggttttaattttctctatgaagtaggagtcaggagaactgaatgctattgaaatagctgtcactcatagctgagcatacctattgtgtggagccagggttgataccgacaagcatttggggagcaggatcagtaggtgtttaagggataacagcattagtttaatccagtagttttcattgtagttcttagaccaccacctttggcgttattgggaacttcctggaattaaaattcttgggccccactgacctcctgattttgaaattcttaattttgtaaaaataagccatcctagtgattctgatgaatgctaaagtttgagaactgctggttgggggattacactttgaaaaccactgcttttcttaatatgttaatagccagtttttcttactcccttcgacatgcctaacattttttcttctattaaggaagctctgttttattttgtcctgaaacaaattatttaatagtaatttcataattaacttgctgtgctattggattatactacttataacttggatttcttctaaatatggcacagaactgaaactaatgaaattgttagtggaccttattccttacactgctctccctgtatccatcctgatcttgagtttatttttttaaaaaacttctttctggatttgttagcattccagaaatgtaccttttgcacttaaggcagcattataacattatgttttgttactgcttctgtcttttacattaaaaaagcatccactgtcttttcactccattcatatttttaaatcttttagttgacatgtaataactgtatatatttatggagtacggagtgatatttccatgtatgtatccaatgtgcaatgatcaaatcagggtaattagcatatccagcaccccaaatatttatcatgtctttgtattgggagcatccagaatcctctcttctaggtctttgaacatatacagtaatttattgttaactgtatttaccttacagtgctatagaacactagaacttattcctcctatctggctgtaattttgtatgtattaaccaacctcaccctatcctctccttccccctacatttcacagcctctaataaccataattctactctctactagtatgaactcatttttttccacatatgattgagaacatatatgatttatctttctgtgcttgagtttttaaaatttaagataatattctctgggctcatccatattgcttctaatgacaggatttcatctttaatagctaaataatattctattatatatatatgctacattttctttatccgtttatctgttggtagacatttagattggtatcttggcaattgtgaatagcattgcagtaaacatggggctgcaggtatctttttaatatactgacttcctttcctttggataaatactcagtagtgggattgattgctggatcatttggtagttctgtttttagttttttgagggacctccatgctgttaaccataatgggggtaataatttacatttccaccagcagtgtataagagttctgttttctccacatcctcatcagtatttcttattttttgtcatttgatacttgtcattctgggattagatgttatctcacagtggttttgatttgcttttccctgatgatcagtgatgttgcacattttttcagatacttgttggccatttgtgtatcttctttttcgaaatgtctattcagatcttttgctcattttagtactagattatttgtttatttgctcttgaggtgttcgagttcttgtatattctggatattcgttccttgttggatgaatagtttgcaagtattttctcccattctatgggctgtctcttcactctgttgtttcctttgctgttcagaagctttttagttttatgtagtccaatttgtctatttttgtttttgttgtctgtgcttttgaagtcttatcaacaaaatctttgctcagaacaaagtcctgaaacattttctcagtgttttcttctagtagttttatagttttgggtcttacacttaagtcattatattttgagttaatttttgtatatggtgagagacagggtccagttcactttctgcatatggatggatagtcagttttccccgcactatttattgaagagggtgtcctttcccccagtgtttgtttttggcagttttgttgcatatcagttggctgtgaatatgtggatttatttctggattgtctattctgttccattggcctttgtgtctgtgtttgtactagcaccatgctgttttggttattgtagccttattgcattgtttgaagttgggtaatgtgatgcttccagctttgttctttttgcttaggattgttttggttattcggagtgcagtttatcattatgcaacgactttctttgtctcttcttattttcttactaaatttaaagtctgtttgtcagatacaaatatagctactcctacacccttttggtttccatttacgtgggatatatttttgcatacctttactttgagcctatatgtgtctttacaggtgacacaagttttttgtaggcagcatacgtccagatcttgtgtttttaatccatttatccagtctgtaacttttaattggggaatttaaaactatttacattttgattcagactctgcatcttaacaagatcctgaaatgatccatacgcatgttaaagttggagaagcactgttgtagacaatagcataggttaagattagcatgtggagcaattttggtaaattgatcaattcgaaacataaagatggaagttttaggaaggaaaagtatagtataaagaggggtttaacatgaggttaatagtagctaattacaatttaaattttaaattaatgttaaatttgccttgagatagacaattagcttgctgccacattggaatttataagtaatgtactagatctttaagctaatgctattataacctatattaattaggttcttaaagtttttaaaacatctttacagtataaagaaaaaaatgcatgtctgattattttgttttttgtacatcatttataaccattatcatcttacaaataagcatacagccttagacaacttaagtaatatagtcagtgtcctaccaaaagtgagttaatggttgagccaagccatgaacaaaattctgattctagaacttcttttggaaaagttcgaaataagtataaattctcactatccctagtgaggatagagtaggaaagaacggatcaacttcagcttaacttaatgtagacttgatctttttggtaggcgtagatttcactttataatgtttgtctgtaatttcataatgcttctctgaaaattccatttaaatttggagttaggccccactctattaatattctgttaaaagcatctgacttagtatttaggaggtcacaaattgtattgtaacagaggtgatagatgacatttatggatattttaaaattatcttagataattccaatgtacagcctgctaatgctttacacaggagtttctgattggacttttcactctgctctggtttcaggcctttatgtctttaagtctttaattttgcagatgaggaattccagagtatctccagagaagttttatagccagttaatggcaaagacagtttatggcaaagtcaaacccaggcttcttcttatacaaaacccaagctttaggccatcatgcctagtgagagacgtcatgagtgaacattagcttttgttttctttctcctccggcttctaactttcttctctctcccagcatctaagaaaataaattctttcttgccaattcccccattaacatttaatttttgttttgaattttatttactatttttagaggttctagaatagaaggaatttccctgaacaccactctgccatgttgctctatgtgggggattcttcaaagtatttataaatatttatttttatttatttatttattattattattggtttttgtttgtttgttgcttttctgagacagggttttgctctgttgcccaggctggagtgctgtggtgcaatcttggctcattgttgcctctacctcctgggctcaggcagtcctctcaccacagccacccaagtagctggcacaacaggtgcacaccactgtgcctggctaatttttttgtattttttgaggagacggagttttgctatgttgcccaggctggtgtcaaactcctggactcaagcagtctgtgtgccttggcctcccagagtgcttgaattataggcttgaggcactgcaaccagcctataatttgttttgccagatctgatataaagaagtaggagaaatctttgccatgctgagttctttaaagtacttttaagaaagtgtgatgcttggcatataggaggtggtgaacaaatggtagttgtttttatttttggcatcattaggtcctttttttggttatttcagaaaaaatatttgaagatttaaaagttgccaaaaatgaacagatcattcctgggtgtttttcagcttaatcatttggggttttaattaaattagttatttaaataactttttattaaaatagtttttcaatttttaaaggtttggataaattgagggtttattatgtctacatttatgtatttaaaaagttatcctcacttaggctttctcctataaaacatgtcatatagaataggtttttggacaaagtttaatctattcatttattaatttctgtaccaaaatatctgttgggtagttactatgcaacaggcaatgtacaaaactctggagaaatattatgagcaagatgtgaatatttcttgtcaatggtaattctagtagaagacagaagtatcaagcgagtaagcatacagttaaatgtataaatattatttgtcataaagtgctgttaaaggaaaataatagattgttgtgagggagtgattgggaaaagctttatttttgacttgtggagtccacatttcagtgcagatctgacttttaagtaagaatcttctagacacaaaagttctgtgtaggggaggaatattctagttataatgcagagtgagccaaggggaaagtggttataataagattggagtggtaggcagaggccagaacattgtagcgccttcttagtaatgttaagaagtttactttttattttaagtgccaagagtagatggtcaaaagtttaaatcaaggaggtgacatgatctcttttacattttaaagtaattactcttccactaatgcagaggaagaatgggagaaaacaagtggaaatggggaaagccttcaggaggcagctatagtagtctaggtaagagatattgatggcttgactaggcagctaatagtgtagactggaagaagagaaggaaagttattcattggacttggagatgtagaagatgaggaaggaaggtaatggcagatacttcctagattcttgacttgaatagttgttttccacttagtaaaatgcgaaaaagtggaggaagaataggttttgaaaagaagtcagaaattcagtttggatctgtaaattttcctattcatttaacagtgtagctctcaaggcagacaattgcatactataatagcagtaacatctaatgcttattaagctttttctgtgtgaatagcacttgatacggtttggatatttgtccgctccaaatctcatgtcaaaatgtgatcccaatgttggaggtggcacctggtgggaggtgtttgggtcatggtggtggatccctcatgaatgacatagtgccctccttgtggtaataagtgagttctcattgttggttcatgtgagagctggttgtttaaaggagcctgccacctcctcctaactctcttttgctcgctctcaccatgtgatacattggctccccctttgtcttctatcatgattgtgagcttcctgaggcctcatcagaagccaagcggatgctgacaccatgcttgtacagcttgcagaactgctagccaaataaacatattttctttataaattatcaaattttagatattcctttatagcaatgcaaaatggaccaaaacagtactgttctgagttcttgtaaatgtagtaactcaagccttacaacaaacatgtgatacaggtacccttaatcctcattttaaagatgaggaaaacgaggcaggatgaattattttacttaagctagccagccagtagtgttgtcatcaggactcaaactcaggcgttttggttcttgagcccatgcacttcaaaccacttagctatagtgcttatgaattttgagtgtgaggaaaggtcaggtttgggggtatgaacatttttggattcattagcctatagataatatttaacataaactctttattatatattaatgtgctttttaaaaaaaaatttttttttgagacggagtctcactctgttgcccagggtggagtgcagtggtgtgatcttggctcactgcagcctccgccttctgggttcaagcgattcttctgcctcagcctcctgagtagctgggattattggctcgtgccaccacacctggctaatttttgtagttttagtagagacagggtttcaccatgtttaccaggttggtctcgaactcctgacctcaggtgatccgcccgcttcggcctcccaaagtgctgggattacaggcctgagccaccacacccggtcagtatattagtgtgcttttaaacaatgtttatcacttactaaaataatatggcctgtgttttcaccatgattagagcattattatatacttccactgagatatccaagtgagccattaataattatgtatacatcatctacattctgagttcattgttattttttaaactttgtttaaagttgaaaccatttgagttatttgccatgtattgtcacaaagattaatttaataatacaattgtaatccgcatagccataatttttccctcataagtctgttatctgtgccttcatttcttgtagtctttcctcatttctaccattatattgaaattattttgctaattttcagtttttccctttctacatccaagatccttttctttgattctttatgctctgtgcactgttgtttaccatcgtccagtccctcctttcatattctcttccttgcattttaactgctgccatctcctttttttcttcttcaccaatcagaatgttaattgtgaggatctgctataagcattaatctactctataaagttttccctgatcattaaaatcactctatgtccctgtcactctttctgcataactaactttggcatgtactaacgatactatattatgagatattttatgtatcctttctccccaacttgtatactacttgtataccctttctcccagacttgtatattactgtaattacacatttaataggccacttaaagttgtcccatagttcgctgcaattttaaatttgtcttttttattttagattctttttttggaatggcttcagtttaatcttttcatctgctgttaattccttctgctgtattttttatttcacgtgttgtagttttcatctttagaagtttggctcttttttatatctgtatacttaatgtcttgagcatgtagattacagcttaatgtgcttgtctggtaattttaacatcagtgtcagttctgggttggttttgatcgattgattttttttcctatcatggaatgtattttcctgcttttttgcatgcctcaaaatgtttaattggatcataggcattgtgcattttgttggatactggataattttgtcttcctgtgactatcattgaggtttgttctggctgtgatgcaagcaagtattttgatcctttaagttcttgattataagatttgttaggcaggattggagcaacattcagtgtagggataattattccctactattgccagagcatctgaatactctacataatgtcttatgagatttttcaatttggctggtgggaacaggcactattactggtcctctgtgagtgctggatactactcttatgaatcaggttcgctgcacactagttatcaacttgagtttggtgagatggaatgtctttttatgcaacaagttacataagacagattcatgacttacaggcaggcagcaaaggaccacagaagcctaggattcattgctggttgcccacggctcacggaaacttcatgggacagatggagttttgactggatgcgcgtcatcttcactgcaattgagggaccctggaaagttgtctaccctaggttttatacttcggggcaatatgatactctgggctaaagctctgaaggacatcctgtttctaagggggactggaacagaacttgggctattcccaccagtccctccctttctcagaatattgcattcccatcactttgttattctcaaactgcaagtgagaaaaatacggaaagctgggctcttaaggccgtttggagaactgtcctgtagttctcattatactttcagatagatacttttcccagcctctggtaatttctttacacataggatttgatcagcactcagctgaatattcaaggggaatctctagatttccaggcttctctttgtgtaaatctttcctctttagtactctgccctgtgattctaggtgccttggttacctggactttccgctctgtttccatagctcaggagtcagctggtctctgcctgtactctccctctctgtgctgtaggcttgaatctctcaagggagtagggtggaacagacatagggctcactttgttccctgtctcttaggcatcagcgtcttttatatcctgatgaccagcgtcctgaaaactgttacatatgttttgtttccttttgtttgtttgtttgtttcaggcgggtgggcaaatcagtcgcttttgctgtatcttggccagaaatggaaggagtatatttgctgttgctatttcaaaagcatccagagattgataagagaaatgggaggaagtcatttttaagcctagtgtaatacaatgtagcacttattttagctttctacttctgtaagattttctcaaaaattcaagaagtaaaattctactatgtgtgtggaaataaaaatagacttaagataattttttgtcttacaagttgtacttctgctatctttactgtaagatttaaagtgacagtcttcataaggtccaggtatgccataggaacttagtgatttgaccaattgaatagtaatggtcccaaaggtatatctttaacatatttcttcaggacttcagaattaaggttgtgggtaaaataggtccaaggttatagccagtattcttacatgtagtttgaaagttttctagtctctcatctaaagtgatgtaacatttattttctcagaatgagtttacaagaggcgttaacaaatttaagtattctttcctattttatagtcgcaagttctaattgggaacatatatccatctataataatgatatgacgtttttgaaatggttgtctttttaaaagtttactttatttgaataattgctcagagaaagaaaaatatgccatgtttttaggggtgttttagtaaaaaattatttggaacttcagttaacatgccgtgtaagagtagtacagtacatgggtttgaactgcacacatccacttttacacagaatttttctcaaccgaatgcagctaaagaccctgtgttcctggatgcaaaacctttgcatacagagtgccaacttttcttatatgcatgttccgcaagaccaactgcagggcttgagtatatgcggattttggcgtgtggggtgtcctagaaccaataccctgtgcatactgaggaatgactataattttcagatactgtggggcacactgtaagttgtaaccttaatttttaacactattattatgttaatgtcttcgtatattaattacagttatatttttctttaattgattttatttaattgatttataaagaggtgttgagagtgggagatgtggtgtgggtattcagagaatttatgttgctgaactgattggatataatgttttggttggggttgaatatagtgttactgataactctttttctcccttccctaaatgttttatgaaatataaatgttctaattgtacttaattattatttcaaataatagacgatctttcttaatttaacatagttgactgcaggctgtgatagatactgtgtagcaggtgacaaggttaatagtccaatttaaaccttggttaggtagcaccagttgaaagttaataattagttgtggaaggctaaagaaaagctgggtcagttcagcagaagtcagacttgttgtctgagaatgtcagcaggggtggtacagtaggaagaggtcagagatacagtgataaatagaatatggagatgaggtagcaccttgtccaaggtcagaatcatgacagtagaaagagaggctaacttgatgatagagatttgctgcagattttaatggaggtgatttaaatttctctcagtccaactcaggatctgtctacactgattttgaagcctgtggcccttagatcttaagagatctaaaccagtatcatttggtttatcagagtgtaatctgggacagttttcctcaaggtaaatttgatattcttcttgagccagttggacactgcattcttaaatattagttgctagtatatgtatgtctttcggttatgctttgctaatttattgagaacattgatgtattttttctttgtctttctttaaattattgcctttggcacagtgagctttaagttaaataaaattctttgcaaatcattttttaagagaatcaagcctataaaatatgaataacatctaaaatactaacaacatctaaaatactagttgtataagctttgagcattggatatgtatagtaagctaaatacacattgatattagattgacagtagttaggaaaacaaaaccttcatgagtttgttctttgaaaatgaccagatatctgacactggaattaagacatatacttgaaagcatatggctaagtcttaatttcttgacctctaatgattccgtactttatcattggtcagaaatgagtatggcctacatttttaaggcatttggaattctaagttggtaatggggaaaaacattagttaatattgtcctttaattttagataatagtatatagtaaatgtttattgatcagcatttatatctgtatatttacacgcatgcacacacaacacttattctgtgtcctagcgttgatattttcaaattgcttttcacgtaaatttgttgtttctagattcaacgtaaataaatgctttgagaatcaagttatttctttaagagtttccagttgagtaaatctggttgaaagcagagtttgcagagcataataccagttggggttttatgtgatctttgtcattatctagaaccttatctcttccctgtccttgcactccatccaaatgtttatcaattagtacattgaaagtttttcttctggcttttttcttgttctagacgtattttgcatgatactttaccattaaaaataaaatacctttttgtttgcagtagatttagattcacagcaaagttgagaggaaagtacagagttttttaatatatctcttgcctccacacatgcgtcatctccatcattatcagtattcctaccaatgtggtacatttgttaaaattcatgaacctacatagatacatcataattacccaaagtctgtactttgtattagggttcattcttggtgttgtatattctgtgggttagggtaaatgtttaatgaaatgtatccatcattataatggataatgccctaaaactcgtcatacttcctccttctccagtctccaccctctggcaaccactgatctttttactgtcttcatagttttgcctttttcagaatgtcataaagttggaatcatacagtatatagccttttcagattggcctctttcacttagtaatgtacatttaagttttctctatgttttttcatggtttgatagctcatttttttttatagcactgaataatctattgtctggatgtaccagtttatttacccattcacttaccagaggatgtcttggttgcttctgagttttggtaattatgaataaaggtgttatcaacacctctttacaggtttttgtgtggacctaagtgttcaattccttttgagtagatcccaaggaatgcatttgctggatcaagtggttaaaattatggtaattttataagaaactgccaaaccatcttgcaaagtgcctgtaccattttgtattcctaccagcaatgaatgagaattcctgctgctacacatcctctctagcagttgatgttgtcagtgctctggattttggtcattctaataggtttataattgtcttaatttgcatttcccgatgacatgtaatgtggaggatctttttatgtgctagtttgctatttgtatatcttctttggtgagatgtctcttaaggtctttggcccattttaaaattgggttgttttgttcttattgatgagttttaagaggtctttgtatatttttgtaacagttctttatcagatgtctctttggcaaatattttctcccagtttgtgagtcgtcttcttatttcgttcaccatttcttttggagagcagaagttttaaattttagtgaattttaatgaagtctagcttattatttctctcatggatcctgcctttggtatatctaaaaagtcatcgccatacccagttacctaggttttcttttatgctctcttatagtagttttatagttttgcatttcacattaggtctgattcatacagagttaacttttgtgaggggtgtaaagtctagattcatttttttgcatgtagatatctagctgttctagcatcatttgttgagattctctttgctccgttatattgcttgtggtttttttttttttttgtcaaagatcagttgattatgtcagtctgtttcttagccctctattctgtactattgatctgttattttgccagtaccccactgtctttattattgtaactttgtagtgtatgttgaggttggaggttgggaagtatcctccaagtctgttctccttaaatgttggttggctataatggctcttttacttctccaaataaactttgtctatcatcacttattagttccaataggtttcttgtcgattcttttgaattttctgcaagacagtcaacgccatctgcaaacaaagacagttttatttcttctttagtaatctgtgtaccttttatttcattttcttgtcttactgcattaggcgggacttctagtatgatgttgaaaacaagtggtagaggggacatggacaatgctttttaaaacaaaacaattattttataagcatttgtttgtcctataaaattctaattcattttccaaatatgttttctattagaaaactgtagtctgtggaagaccatttgacagtagggagaattatggcctttgtaatgacagcaagataaaataatgttgtggtagtaatggcaattaagaaaaatgttgaatactgaattagaataaaaaatagagatgcttcatctaaggacaaacaggtttgattaggatgtcagtaggcttagagaatatgaacataatcctaacccacttaaaggaaaattagaattgggtagtgattcttagtttattttgtatgtaaatttctcttccttggtacatttttatcattattgtgaccgttaaatttgttaggcaaatagaagatgctgttttattcttgtttgctttgtcttagtgggttacagattaaaataaattggatgggagataggggagagggataaacatacacgaacatttgaggaggtaactcagtaatggttataagatacaaagtatgaggtactgttttgccatgtaagttaagaattaaaatcactttctcttcttgcaccctctcaacaactagttaagctactagctgtagattctaaactttttaatgtttattttgttagcattattgatcttgcttataaaggaattttattctttgtagattggttaaatgtgctatcagtgtaaaattgcttaataacgatagaaatggtgaacccaaattgcataataataattgtacatatggagagccaatgtgttcagatactgtgctaaatactttgtatttagttaaaataatattttttttctcagaagaaatacacaggttcactgaaatcaagagtacaagtaattcagagtgcaagctataacactagagaactgtaaaatatgaattaactttgttaaaggtcagcagatttgttacagtatccataggtagcaagcttaaggttagtctgttacctaaatgattctagtaggaggagttttaaactcatttccaaagagtattattttgacaggcagtatttgaatttacttattatcatggctgggtaatttatgtttgaatttgtcagtctataaaatgcattgtttcccccccgttgcctataaaaaaccatttcctcaaactgttctgtgaccagtatgcacctgtagtagaaatggaaggcccaagtgtctaaagcaacgggtttatagtttgaatggatctagggagagatccaggcacactgaacaagaaataatttattagtgactcccttctagtggcaaaggctggcaacccaaaacatgacagcaaaactgagatgctttctttggagaatttttggttgttttagaagttaataagctggaggccacacagctgatcaggggtagaaactgggttacttccataattatttatatttaaatttgttacctttttcttaagtttattacctatttataaaatctattctgtagcaatagggccattggtttattattaggttcaaggcaaatcttaggaggctgggaaggaagtaaagaaatgtacagtggtattatgtatagtaacaatggttctaatgtaatgaatggtattaagagctttcctgagtttctgaagtaattatgggttttgagattttgtggcttgctttctaccagttttttatggatatatttgtatcgtgtgtacatattatataagaatatattcatataatattgtggttatttatgtatttttttttagtttccagaattaactgacacgcagaactagcatttatttgtacattataatttgtatcaattgagcatccctgatctaaaaatacgatgtctacctgaaatctgaccctaaacccaaaactttgtgagcactgacatgatgctcaaaggaaatgctaactgaagcattttggatttcagatgttaagaataaggatgctcagtcagtagccatcctgaaaacattccaaagtctgaaaaaagtctgaagtccaaaatgcttctcttcccgagcattttggatgagggatactcagcctatatataggccttcctttttgaataaatctattttcttattgcctgttgttcatgcagaactatttagcttttgtggattctagcgcagaatacatgattaaagtttgatttgtctggacaaacttccatcatgaattttaatacagttatgaggaaaaatactaaataagttttatttccccacagtttatcaaatgggttgtactttttacatcttacattttacatcaacttgtaaaaagtattgtgtttatttagaggtgatttctcttggtggaaggaggaagtaatgcagagctgtgaggtaagtaacatggggtttgcagtcagacaggcacaagtacctgtctttgtgatactgtgcaaattgcctaatcttgttgaatggagttgtaataggtgctctctctttggggttgtgaagattaaaatatttatatgtgtgtgtgtgtgtgtgtgtgtgtgtgtgtatatatgtgtatgtatacgtgtgtatacatatgtacacaaaatatgggttgtatggaacctaatatgtagtatgagtttaacttagattagcgatttttattatcacatgttattaattgtattccttttatacaaagaaaaaaggaactgaaagtgatccatggaaaagtaaaagtagattattaccttgtaacataaataaaaaataaaaacctaagtattaataacactttaatgttagtagatattttacgatatcaaggtagggaaggtcttttgaaataagactgagagaagtacaagttataaataaatggattcaattggaccacagtaaaaaaagaaaagtctgtgtgacaaaggagaccataagtaaattgatatgtcaagtcctagacagaagatatcatagttgccacacatgtagttaattactaatacatgactagttaattaccactaaagaactactacaaattaataagaaaagagaacccaattgaaaaatagataatctgatcagagtttatcactggaacctgagttgttaataaacaatatatgtataatgtcattaaacatcatggatatgaaaattagaggaatattgagatgctatttgttacttttcatcctggcaacagaatgcaaaaagtctgacagtgttagtgttgataagtatgtgggaaaatgggaacccacatgttgctggtaggagttagtttggaaaaacagtttggcaatatcttgtaattggttagtaagtttttgtattctgtgggcgtatttgacagtctggtgaatgaagcctgtgtacttctttgcagaaaaattttttaagtacaatatataggattataaaagatagtcatattgaaatatcattattacaatataaaaatatgatatggtaatatttttatgaagaaattttataacaagaatttagtgacaggtctgatagccattacaagttcaaaatgatgatgaacatgaactgtgtcttgagatatcagcaatgaatggaatggaataggaaagtacctgcgattcctatggtttaccaagtcacagggactgctaattctattttttttttgcctccacttataactgaaatgttaaattttacagacttatgtaaatgaagatgtttttcccctttttcaagtttatcacctccttgagttagaatcatagaacttacagatgccagtttaagaacccttttagagtgacttttactcatgaataatgataatgattctattattgcttattagaaaaatgagaaagcctatgtgaccattattaagagaaatggaaaaatgtaatatattaatatgatggggtgccctacagcaatgcagataaatgacttacctataagcgtcaatatgcagaggtttctaaaacaaaagtttgaattaaaagtttcagtatgatattgagatagagtattatgcaaattaaagacatatgtaacattttattgtatggtttttgattttatgtacctgtttatgggtgcgtctttatacacataaagatagatttgagaaaaacagtgtttttagtttagtggaaaagagggggaaagtaagatgggataaaggaattcagaggtacctgtagtattttaattatttatgttaggaaataaaccaaatagattgcaaactaacagaccttattcgatgataattgtcattgatgagtacgtgggtttttgttttattattatttgtgcttttctgcattaaaatagttccccaaattctcaaaatagtagttattaacaagaaaatattttcttataattattgtaaatattttaataaaaatacaagtggcaccaagatagattatcagttgcaaaggggattaacttttgtcatttgcttcaggtacatatgggttactgaataattaccgaattaattgttttctagttaatgccaagtgtttcttgccttttggttttctatttagaatgtcaaagtaagcctttgaacagtcattgatatttatggtagcagaatgttaactctctgaatatggttaggactgtggtattctgcagtaacttaatagccctacattttttctatatttggcatttttattaccagagaatctccaaactttatcttacaagacccaggaaaatggttttatttgttgggcttatattggtttcttgtatctgtttttctctaatggttcactaaattagttttgaaatatctgggattgctttcttcagttttttggtaaagagatacataaaactctggttattgtagagaagttctgatactccaggccatttttactgaaatgaactaaggtgttagtcagtaaagatgaatgtagtagtgactgtggaagttagaatataatgaaacatcctcattttctcaaatagcagcctgaccccaagcgtgaagtgagcatcgcttccaaaagagtagaatcaatcaatagatgggaagattagtataggaacagcaaagaagcacagagtaactcatgccgctacctggctttgtttcatatcttttcctagaggaatcaaaattacttgtcttttagtcactctttttttgcatgtctcttaaactgtctctaactggcaataactgttgttttattgtttataaagcaccacaggtaaaaatttcaaatcacatgattcataaagtaaaaataaacataaccatttatcttctcctgtagaaggaagccattattgatttgctacacagttgacccttgaacaacatgggtatgaattgcgtgggtctatttatacatagatttttttcaaatcaatatattggaaaatttttttaagatatgtgacaatttgaaagcattctaagatggactgcattgccttacaaataccaaaaaaaatggagaaaaaagtctgtcaagagggcataaaatgtatatacatactagtctattttcatcgtttagtaccataagatatacacaaatctattataaaaaggtcaaaacttgttaaaacttagacacacagttacaaatcacacatgacaccacttgcagttgagggaaatgtaaacaaacataaggttgccatattaaatcacaactgcataaaattaactgtagtacgttataggctactgtcataacttcgtagctgcattccgttgctattagggtgagcttaagtgttgcagtagccacttaaaatgccttatgacactgatcatctccatgtgagcccttcatctctccagtgagttgcatattgcagtaaacagtgatcacccgaggttctcctgtatttttcattctgtttaatgtaatagtgtaaaccttgaataacaccatgggacgcaaacaaaatgccactagggatgctggaggtgctcccaagaagcagacaagccatgacattacaagaaaaagttgagttgcttgatagataccatagattgagatctgtacctgtggttgctcccattttaaacagatgattcatcttgtaaacaggtgacagaaacttatagtatgagtaaatacaatacagtactataaatgtattttgtcctatgatttctaaataacattttctttagctcactttattgtaagaatattgcatataatacatgtacaaaatctgtgttaattgactatgttattggtaaggcttctggtcagcagtaagcttttagtagtcaatttttggggagtgaacacttaacacgtgatttttgactgtgtgggtgcccctaaccttcccattgttctatattatttcaaatatttagcatgtatgtaaaaaagttaatgagtgaataggcacacacaaattgtggatattcttgtaggtaagtctgtttcatcttgttaaataactataatactgtcttgtttcataccatgttatgatgtaatcagattcctctctgtaggcataaatattatatccaaatacttggaattatgaacagtgcttcagtgaatatccttttatatttacgtgtgtactttgtctgattatttctttaggataaattcctagaaatggcattgatgaactaaaggaaacacacatttaaagcttcgtatgtattataaatgtgacttcttgaaagatgttaccaatgcatagccatattgtatcccttggtacagttttaacttacgttttccagtggtatttttaataaaacattgtgtgtgtgtgtgtgtgtatgtgtatatgtgtatatatatacttataaaacaaagtacaatgttttataatattttaatccagttaatattagcattcaacatggatggtatcttatgtacagactacccgcaagtttcagtagtaagcttttaccctgtgctgttctctctgatcataatcccaaatgttttaaaaagggcatttctcctgccacaaatggttgggggagagcgtctgaaccaaggaaacgtgtggaccagaaaagagctgtgttaattctatttctgtattttcagtacatttttttcattacttaattagttacacaaatatttatttaatgaggcaggcaccggcctggtcactgggcatacagtgatggtagagacagttctaggctctcaagaatttataatttagtgatagaaacttttaagtggctcaaaacagtcaactcctttacaaactacagttataatacatttgtaaagtgtgtgtatagtttacatacatttgtaaaataatttagtgtaacaaagcaaaatagaaataaagatgagaaaaaattttattgaaacatgtcaccacctacaaacaattgtcattaagtaaaatttacttctcctctaacatttcattatgaacttctaaaacataaaggtaagctgagagaatttacactgaatacccagatatcgactacctagattccacaattaacaattgactgtgcttgctttatcgcaactccatcttatgtatcagcaatcattctgtctttttaaatgcattttagagtaagctggagaaaagtgtccttccttcaatatgcataacatgaactattgttttaagcagcactgtgtttcagttaaatctgtattgattgactatatgctattaaaaatgtagaaattttgtacttttacatttcctccctaattctcttccctgtcagcaaatatttgataaattactttgtctagttatggaacgtaatgaagtgtcatatcttgaatgcccatataatttacctgaactggaatatttttgataagcatgcagtgatacagcaagtgcagtttggggtttccttagcaaaccagaatggtgagaatgtctataacaataaatgccagagtagtttattcttggttttacatttaaatgtatttgcatttaattagcactatattcacatttggcttttaccatagcttatttcctgagttcttgattttgattcacctcttggctgaattttatccatagcttctcttttcctgagttccttattttgattgagttcttggttatattttatcctcaagaggttcctctcttttccatgagtgtttaatgtgtactgaattccttagtttttttttgcttgctttgttactttatattggtgctttttgtaaacaataaattccaatataaaatagttgtttgtcttatagggataaattgaacaatagtagggacatcctagggctaggggtgagcctagaatcttatctctaatattactcagtcttccacatgaagtgtgatgtaagaagtttcttcggagatttttacctttgtatattgatatggtttggctctgtgtccccatccaaatctcatcttcatttgtaattcccatgtgtcacgggaggaacctgatgggaggtgattggattatgggggtggtttcccccatgttgttcttgtgatagtgcgtgagtctcgtgagatccgatggttttaaaagtggcagtttttcctttgctttcacttcacttctcttgcctgccaccatgtaagatgtgccagcttccccttccaccatgattgtaagtttcctgaggctctccagccatgcgtaactgtcagtcaattaaacctctttcctttataaattacccagtcttggatatttctttatagcagtgcaaaaactgactaatacatatacctttgtacaaaataaccaaaagaaatctttgattctactcccaaaaaacttgacttgctcttgccatttggaagaaacttggtagaattaaacactgtttaagttgatgaaaaacaagcgttggaaattttttaaagtacatttaaaactttgctcttggctgattttctgttggattctattgaatttttctttgttttgacgatgtaagcgttacatattttagtgactgatttgtgtgaatcaagaataaagtcactgaaaaaattaactcaattttacaatttatgagtatagttacggttttgttttgccacattctgttagtaaaagtttttttcagctgtgacacataatatgtggccattaatagtgaagagttacacacaatgacttctaaagcagtgcaagataattttatgatataatgtattactacaatagagtacctgctatactcatttacactggtaatagtcatcttgtctggatctgtattcccaagagaggcaggccagatggctgtgtacagctggaagtagattttcttctaagcttttaacagctgctctcatttcttatatctggtacttgttttaaaatgagatatttatttataaatgaatgtccaacagaaggatatgaaagagttcaagaaaaatggtgacagaagctaatgcagtggtggaaaaaaaaatgggaagctcatttgacccatttgatgactgtccctgattaaaatgacttcatattttgagtcttcagagaaagtatcatgattcccattataatgatactgtctcttgatagtagggtattgtacttaagcaattttttagtgaaaaattgtcaggaggacaacaaacatttaaaaaaaaacatgttttcactgtacattaaaaataaaacagagtaactcccaaaaccaaaaaaaggccattttcaactatttacatgactttatgacctatctttatcaataaacatacacttttgtgatactaatatattactatgaatatattaccttctatctttccacttactgttatgatataattttcttactagtcaccacatttcattttagtctctggtattttattgtattattatgctctttatttcctagctgtttttatttttgttgctgttgatcacataactatgtttatatggtttaactatttttcttttggaaatttttaaggtatattaagaaaggtatgatgaataaattataatcagtttaatgtattttgtatcgttgtttttatgaggggctttgcgttttaggcactggatttatttcatagcatactttgaaatccataaaattccatacattcattgatccgattttgttattaccacaagtatcaaatgcaaaatatttcagtatactgcatgatgttttcgctgataaaattaaggtatagcaacatctaacattagaattcttaaaattattgctgcaagggagtagttaagtttctcatggagaaacatttctggtattttcaatgtagaatttaatgttgatgtgtttctgtgaattcactgcttcctttattaatttttatgaataaggaaatactagcaaacttgatttattttaaatctttggaatattaatttaacatctggcaacagcaattcttaagttcttattgttatactgattttatatataagtgagatacatatgcaagtttcggaaacagttgttacttcgaaatattcttttttgcctttgaaccagagaataaatagagcaaagagactggcaaattgaagtaaacccctttaaaaaagtgacatttgaatagggctactgtgttagcaattcctatattagagcgtaaaagttttacaaattttccattcattcagtagaggtatagggagggcttgagggcctctcaggagccaccagtgttcaggatgctctccggggtacaaagatggtcaaaatgtggatctctcctcagggaaaatttctgaggagagttcaggttgatagacacataactaaaagagtgttactggacttatttttaatatgtctctagaaaaagttcacttaattgaatattgtagtaccgtccactgaaagcttctttttcaaaaaaagtgtgatattagaataacttaatttctctatttctcattagataactttacacaaacaaaaggtctttaggatcttcccagaggtggaattggtttgggattttacagtatttctttctttaatttttatagtgttctgtatcaaatatttcaaagaacttttttgttgttgctgttgttgtttttttgagacagagtcttgccctgtctcccagtctggagggcaatggcgtgatctcggctcactgcaaatcccgcctcccaggttgaaacgattctcctgcctcagcctcccaagtagctgagattacaggcacctgccacacatccagctaatttttgtatttttagtagagatgaggaggtttcaccatgttggctagggtggtctcaaactcctgacctcgtgatctgcccgcaccggcctcccaaagtgctgggattacaggcgtgagccatcgtacctggctacctttttgcttttgaatgtaatgataattgttttctgatggattgctgattacattatctctagagagaccatgatttgctgagttcttaactgattaacctcttggaatttttgctttctttatggcgtgtgtgctgtatgcattttatatttctgataaaaatggtgtatttgtttaatttactgtatagctcattgtggtcttctgagtgcctttaaaggtagtggtggtctttactgaactatcagtttgtaatgtagatgaggtggtatagtgcttaatctctgattttttggttcctagaagcattaattgccctttatatatttttaaatctgttaagtatgacataatattaagaaatatgaatacagatttttaagatcgaatttccaacatggaagataacttttctactaaatgcaaaacgatatgcatctggctgctcatgtttggtttatcgttgggttttcattgaactccttaaatattagagtcttgaaaagtaaaggcttcttgttctcttagagactcctttaaaaatataagaagaacagaaggggtcatgatattgtttctgtgggttagcagttgataccttcaacatgtacgtcttgttctcattccagatctgcatgctgtgaattactataagcaagttttattatggctattttgatgagtacctgctattcagatagcaggtacctgaataagtactgtatatgtgactggtaaacaaacacgtgaatagctgcccccctggcagaggcatcttggttaaagacatgagaccacatatctttttgccttggtacatctggtcatgttcctagggataaaatgttgaaacaaacaaacaaacaagaaagagtaaaaaatatgagattagtgagctcttattctatttaagcttcactttggaatgaaccattgtattacgtattgtttaatgcaatgtactatttcttgtatttttggttataaattggttattgtagtaaaatgtgaattgagaaaaaatggagtggtgtcataatttggagactggtatatagattatgccagcttgtttattatactgagttgctataaagttaagccttcataaaatgttaagataaaaatacaagaaggaaaaaatataagaaagaggaatgggcatctgaacgtattatgactgattctattaacttcattcatagatgtgaccttctaacctttgttttttataaagtaacaaggatggggcttttttgttttgttttgtttttgaagattctaagttacagatttctttttccttttctgatgtgacagatttatggcatcttggactgtatgtcccatcttgtatcagtaagagacaaagccaaccgatcacccactcttcactgatcggaccagtctagacttcagaatcttctgcagtgaatttaaaggagccacaatatcagttaatgttcacagaaacaatatattctttaccatcccttcctgagttggcactaagccgtttacttaagagcagagctacagccatcgcatatcaatataagccatattatatatatgatatatatatatatatcatatatatgtattttatatgtgtttgtgtgtgtgtacacatggacactttttagtgctagagtttatttgccttaagggcttgagagtaggatctgtcttatttgtgccaaatttggggacaatgggattcatgtaacatgtcttacagtgctttttttttttaagtaaatttagcacagtgcttttcttgtaatactcagaaacattaggtaactctgagattgaaggtattaatgagatttaaaaaattcccactgcagataattcttttagcaatgtgatctgtgttgttgttagatcatgacctgaagaaaaggaaaagaaatttgagtgtcttagcatttgtaagatgcagtgctaagagttttccatgcattggcccatgcagttttacaaacatcaagtctcatgagatgtgatggttttatgaaggggaagttccctgtacatgctgtctcttgcctgctgccatgttaagatgtccctttgctgttcttcgtcttctgccatgattgtgaggcctccccagccatgtggaactgtgagtccattgaacctctttcctttataaattacccagtctcgggtatgtctttattagcagtgtgaaaacagactaatacaaatacatatagcattatctcaggttttgtaagagttgtattatattccatcttatagatatttctgttctcctttaactttaacattccctttaagcatggacttttttgacccaactttcattcttcactgggaatagggagctgagattcatgagcataattttcttcagaagaccaaaagggacacccaaacagagaagtttgaattaggcctttgagatctaatttagagattcactcattttccctgtgttatctcccatgtgtacaggaagtatacatttgtgaagcttctggtgttttgttatttttttttttttttcggtgggggtctgagttaagaactccatgaaggatagaagagaaaattatttttttctcccctaaagacttgagaattctcagattatttagtaccaaaattgtgtttctgagagaactaagtattttctctgcattagccataacacatattattttaattaaggtttctgtttttttaatcacctcatggaaacactgagtctaggctgagatgggggtctttagtattggatgaggctcacttatgcccactagcctttatgtaggtatgttttacatttcttaacatgcactcatttaagtgtatgattaaatgactttcagtaactttagtgagtggtacaaccatcactagaaatcagttttagaacattttatctcttcagtaagatatttgtgactgtttacagttaatccctgttcttaccttgaggcccagacaactgcttatctacttcttgtctttataaatttgcctttctagactttttatataaatgggagaataaaatgtgtggtctgttatgtctggcttctttcagtgaatataatgttcctgaggcttatccatgtcgtggcagttacaagttggcttctttttatttcctagcagtattccattgtgtggacctaccatattttgtctatccattcaacagttgatgaaaatttaagttttcatgacatttaaatttaaagtcatgcttgtacaaatttgtaaattgccttggacatagtaatctgtgaaatgccggattattattcttttttgctaaggatatagttacataataatttatatatgaaacagactccttgggttagaattgaaatttccaatttactttttatatatagtgaaagtatacaagtacagctattcaggctgttattaaaaagaccaaaaaaaaaaaaaaaaaccaccccaaaattcggaaaaggacgcgtagtaaagggaactcttgtacactcatcgtgggaatgtgaattagtacagccattatggaaaacagtatagagatttctttaaaaaccagaaatacaacaaccataatattcagcaatctcaatgatggttatttatccaaaggaaaggaaatcagtgtatcaaagagatacctgtcctctcatgtttattgaagcattattcacaatacccctgatgtggaatcaacctaagtgtccatcaatagatgaatggataacaaaagtgttgtatatacacaatggaatgttattcagctgtaagaagaaatgaaatcttgccattcacagcaacatggatgagtccagaggacattgtgttaaatgaagtaagtcaggcacaaaaagacaaacatcacatgttctcactcatatgggagttaaaaagaaaccaaaaaccagattgagctcatagaagtagagagtagaattacaattattagaggatgggaaaagtaggcaggaggggaggataggaagaggttatttagccacaaaattacagataagagtaataagttctaatgttctataagcagtgtagggtgaatatagtttacactaatatactatatattttccaaatctagaagagaggatttcagatgttcacagcacaaggaaatgataaatgtttgaggtgatacatattctaattaccctgatttaaatcattacatattgtatagtatgtagaaatatccctctctaccataaatatgtataattattgcctgtcaactgaaaaggaaaaaagaaaatacaggacgtttatacactaaaatactacaaaaatgagttaaacccataagtactgaaatgaaaaaatgaagagaggctggttaaaggatataaacatgtagttagatagaaggaataagttccacagttccgtggcttgaacttgtggactcaagtgatcctctggactcagcctcttgagtagctaggaccacgtgaacacaccatgaagactggctcatttaaaaaaaaattttgtggagttggggcctcactgtgctgcagtccaggctggtgtaggaataagttctaatggtcgataacagagtaggaaggtataataaaagtagataatttagtgtggtataggaataggttcagaaatgaagactcttaaagaataaaagtagagatcttgatttttttgctttttttcaatagggactaatttctgttttagaagtttatagtgacatgtatttttatacaaaatttactcctagaaatttgcatattatatatgtgtttcagaatatcaggccaggtgtggtggctcacgccagtaatcccagcactttgggaggccatggcgggtggatcacctgaggtcaggagttggagaccagcctggccaacatggcaaaactccgtttttactaaaaatacaaaaattagcccgtcgtggtggctcacgcctgtaatcagtctactcgggaagctgaggctggagaatcgtttgaacctgggaggtggaggttgtaatttgcggagatagcaccactgccctccagcctgtgtgacagagtgagagttcatcttaaaataaaattaatctgttttattgattttaaaataaattcaaatatgttaaaactatcaagctcaattggaaatatttttcattcattctggctgtgctgtgggtggcaggaaggagagagcgctacaacagtccttgggggctctgacctcgagactccctgagcaagagccctaacaccccttggtgctctgccgttgctggcatctctgagtttttgggtgccgctgcgttcccctcatccagatgtcgatttccaagtcagaagcaggtcgccgcatgcctggcccagccacaggccaagcatagaactgcagttggcacagaatctgggccagtagcatgagaccagcatggccgagtgggcagaatgagcccagcaaagcctgatcagaggcgctgcttgctggccacagagatttccggctagcgaagtggctttgaaagaatcctgtgtaatcagcagacagagggaggaaatagatgtacactaatccactcactcatacaagtctatatttgtttctgtatctatctgtaaaatgtgtgtgtgtgtatatatttttttttttttttttttgagacagagtcttgctctgtcgcccaggttgcagtgcagtggtgtgatctccgctcactgcaagctccgcctcccaggttcaagtgattctcctgcttcagcctcctgagtagctgggactgcaggttcgtgccaccacgcctggcttatttttgtatttttagtagagacagggtttcaccatattggccggggtggtctcgaactcctgacctcttgatctgcccgcctaggcttcccaaagtgctaggattacaggcgtgagccaccgcgcctggcctgtattcctgtttaaaaagccacacattaatatggatgcctccaactcctgtccaacgtcacaatatgcattctggccctccccctttccttatttgtgagttcttctctgacagtgatacaaagccagatgtatatttacttacttgttcaactatggtgtactcattaagtacagaagtggtaatacatacctctgtgagaaacaaaaataacttgagtatgttatttgtgtacagcttctttttctctttggctttaagaatatccagtcaaatactgttttccaaagttatgtttacgttagtaatgcagtcaagttcagttgttaaagtttggtttttattttgaaaccatcctcccaaccctggctgatcatttaaaaatatgtaaggcagaaaccatttttgtgttgtctactgttgtgttatttaaagacaaaagtatgctcaccgaaacctagatggtatagtctactacacacccaggctgtgtggtatagctcctagggtacaaagctgtacacaatagtactctactaaatattgtaggcagtcgtaacacaataagaagtatttatgtatctaaccacgtctaaatttagaaatggtacagcaaagatatggtataaaaggtaaaaaaaatggtccacctgtctaggacactctccatgaatggagctttcaggcctggaggttgctctgggtgaataagtcagtagcggtgagtgagtgtgaaggcctgggacgttactgtacactactgtagactctataaacactgcacgcttaggctttatcgaaagatttttctttgataataaattaactttaccctactagaactttttttaaaagtttttaattttttttaactttttgactcttgtaataacagttagcttaaaatacaaacacattttacagctgtacaaaaatattttctttatatccttattctgtaagcttttttctgattttttaagaagtttttatactttattgttgaaaactaagacacacatacattagcctaggcctgcacatggtcaggattatcaatatcactatcttccacctccacatcttgtcccactggggggtcttcaggtgcaataacagttatggaactgtcatctcctaggataacattctcttctggacacctcgtaaaggacctgcctgaggctgttgtacagttaactttagaaaacaaataagcagaaggagtacagtctaaagataaaaagtatagtaaatacataaaaccagtaacaaagttgtttatcgttatcaagtattatatactatacgtaattgcatgtgctgtgttttcatatgtctggcagccagtagctttgtttacaccagcatcaccacaagcacaggagtaaaacggtgtgctgcagtgttaccacggctgcccttcagtattaggcggtaagaatttttcagccccattataatcttatgggaccgtctttgtgtatggagtctgttgttaagtgattaacatcactgcgacacatgactgtatttctgtgggttttggcaaatgcagtcatggctctaccactagtcacaagtcggaacacttccattaccttatatgctgtgttttggaagaaattattaaaagtagtttgatacttaaaattcaaagaaaaatcgttttgtggattttactggtattttagcctagtttaagtgagaaatgtgtttctcccttaaggcagttgggatactaagaataggcgagatttcagttcttattttcactatgatttgatatttattgttattccagaacatggatttgtgtttccagcttttaaataattgatatttttcatataatagattgagacttttaaaagaaaaataattcacaaaatgtaatcaaatataatacatgcttttaaagtgctacttttctcatttataattgctctctgctcttcctcgtttaccctataagcagaaagaaaacaatttagaagtgacaaaattttatcctagttttaacattgattagtctggaaagagttttattccatatatttttttttttttccagtcgaagtctgtctctgtcgcccaggctggagtgcagtggcacgatctcggcttactgcaagctccacttcctgggttcacgccattctcctgcctcagcctctggagtagctgggattacaggtgcccgccaccacgcctggctaattttttgtatttttttgtttgtttgtttgttttagtagagatggggttccactgtgttagccaggatggtctccatctcctgaccttgtgagctgcctgcctcggcctcccaaagtgctgggattacaggcgtgagccaccgtgcccggcctattccatatactttttaatctcttgtataggacagattatatttatgaatagatcaaggataatggacatgagttttaattagtaagaaagagagagcattcagaattgtgaaaaaatgactcaattttgccagaaataacagtgcaaggctgaggcatgagaatcccttgaaccctggaggtggaggttgcgatttgctgagattgcaccattgcactccagcctgggtaacagagggagactgtgtcagaaacaaacaaacaaactgcaaattaaaataagataccattgtcgattaacttggaagtgtgtgtgcatatgtgtacaccataaagagatagaagatgaataagaatgaatactctaatctgttgagggtatagtgaatctcacactctaatatattaatacattgcagatagcgttagactttcacactgatatagtgtttgtaaggaagtgtagtcatggtaatgaaaaataccagtttgtcaagattgatgcaaaatgatgggactaacaggcattttgtttaaaagattttttccagaatatttgtaatgggaaaattacatatagttagaattctacatttttcaagatgtgattgtgtagaaattatattttacattgattttttttagtattaaacatgactgtgtaccctgaaatctgtagcacagtggttctcaatatttagaaaaatgacgtatatatatttgcctaattctgaaggaatatagtaattgtatgataactagaagtgtactacaaaaaggaattcagttaaaccaagttaagagtatgcattcttgtgttttgcttggtttttgaaggcacttgtaacttacctagtcctttgttacttaaataagaactattcctctgtgaggaattttcgtttgtgatcaggctattaaatgagtttcgtattaccttgaagatgggaagcatgggaaataggagtaccagactcaggagtctcattcctttcagcatccgtgaaactggggctggcttctttgattatttaaaagtaaagtgaaatctttgaccttttacagttacttactgttttcatagatacatatttggtataaatgggatttttaaatgagaaaaacagtaagattattgtagaaattcaaagagtattaaaagattgtgtgtggtgtgtgtctgtgtgtgagtgtgtgttgtgcatgtgtgtaatgagaaaagcataaaatactgaggtaactcatacgtaagtaactttcttagaccagttctcttctgccctcattagtggattaccctgcttgatttccactctttccatagagggtcacagtctctaaatacttaaaaaataaatatttatatagtttttatcttattattttaaaatgttttcaaggctcaaaagaatttatatagtaagttggttcattgtgtgtattggtaaatactggagactttaaaacttattaaatatataacagttttctgtaaggcaaaaactattaaatggtgcttaacatggaaaataacctcacttcgcttctcaaaattgaaactaagaacaattaggagaagtccttctatgtcactttctactgttctgggtatattgatgaggcagagagataagttatcattttcagtttaataaggttattttactttggaaatatatatctataaaatacacataaatatatgtaaaatatatatatatatataaagtatatttccaaagttatatatatatatttaactcagactgcaaatatatatatggatttatatatataaattatacataaatattatatatagataaatctatatagataaatctatagctatatatttttatatataaatctatatatgtaaatctaactaaatgcaagtaatttgtttgttttgaggttaagatcaatttcagttgatgccctttggttgtggcaaaattgggtcttttaaaaaaaaaacacagccgagtcattagctgtgatttttctttttcatacagttagcatgcatgcatgtctgaatgttctctctctgcaggttactatgctctttggccagcttactttccttcccttcctcccttccatttctttccatttatcttttttcctgttcaagtgggtgcaaagcactgcaacaagtcttttaccttaactcaggataagatgtctgccttcccttctctcttcttgatgtatatgcacccagtctctgtgagccacttttcctttttcacctgagaggagaggggaaagagattacttttctctctgatttctagagtagagcttggttaaatggcacatttcaagcctccctctcctgaccgcttatacttgcttggttttaaaatggcaggcagtttctttgtcttgtaggaatacagtgttgtagagttgttaacttctcaggcttgttcaagtaagatgaatgttctaaagataagagcctttttttttccttcctttctttctttttttttagagacagtgtcttactgtgttgcctaagcttatcttgaactccttgggctcaagtgatcctcccaccttggtctcccaaagtgctaggattacaggtgtgagccaccattcccagcctataagagccttctatacagaagctacagtgctgtctcctcccaaacctccctaggaacagaatattactaatagcccagttccacctgtgctgtctaccagtcactgtgcctcccagactagccaccataatgacttttagcacagtacatcagtttttcctatttttgactttaagtagaatcatacaacactcttttgtgtatagttgcagctttgtgtttgtgggggtggttgtgaggttgtagtttttgttgttgttttgttttccttttgctgtgatgtttggctagactagagtagagcagttattatttttactgggcttcccctttctttgtcctttggatagcaagagcttacttttcttgagccttctttttttttatgtcaacccccattggcattcttggattgctgacttctctagcaagtggtctgggatatataaggccaagagaaaacccaacattataaaaatatatgtcctttctatctttctaggagcagaaatatggtcttttatcttttctataaacttggatatcattaggaaaaagaaaataaaacattttatgcatttatatgaaattcaaacaaaaggactttgactctttgtaaatgttaatttctgtgtttaattgcagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggtaatttatgtaattaaaaaatattaaaaactattattcttggtttacatatatatttttatgttcattttaagataaatatatgtaagataaacagttgtttaatagtcaaatataactgtgcatttaaaaataagctgaaaaatcagtgtattttagaaatataggctaatattcttttattgggggcatgtaaaatattcattgaccagttgcacatataatcataaaaccgttttatcatcttgatatcctgcagattgccttgtaggtcactcagttatagctatggttaatgaagtagcccccttaaatataatcaatttttaatttttaatagagaggactcacttttatctagtgtagcccatttaatttttgataccgccaatgattagaaatttctgtgctgtagaagtaaacagttttaaatgaatgaaatgtttgtctggaggaataaattaaagaaaactttggacaagtataaatacttgtccaaaagtatacaacaaacacttttttaaattgaaatttttattttgaaataattgtaggtacacatcttttacccagtttcctccagtggtaacctgttgtaaaactatagtacaaattcacaagtagggtactggcatcgatacagacaaatgcggaacagctctattactgcagggacacttcttgccctttaaagtcacccgcactctccattgtacttcttacctgtcgaacttgacctctgacctctggcaatcactagtctgttctccatttctataattttgtcatttcaagaatcttaggtaaatggaattgtatggtacgtgaccttttgggtttggcttttaaaaatcagccgtaattccctaaaaaaatacgtccaagttgttatatttatcaataattatttttttaaattactgaataatgttccattatatggatgtactgctgtttatttaaccatttatttgttaaaggaatcggggtcgtttctaggttttggctattgcaaataaatgtggtatgagcatttttctgcaggtttttatgtgaacttaccgtttttctgggaagaatgccacagagtgtggtggttaggttgtgtggtagtttctatttagttatataagaaacagccaaaatgttttctagaatggctgtatcatttcacattccagccatcagtgtgtttagttgctgcttatccttaccagcatttgctgttgtgactattttattttagccattctgatagatactgtagtaatacctcattgtgatttaattttgcatttccctatgactaattgtgttgaacatcttttcatgtgcttattcgtcatctatgtatcatctttaatgaagtatctgttcatagtcttctgcccctttctaattggattctttaaatgagttttgagggttcttcatatatttagatactagtccttcgtcagatacttggttttcaaatattttctcccagtttgtgacttgtattttcctcctcattacaggtcttttgcaggttttaattttgatgaagttcagtttattagcttatccatttaaaattatttcttttgttgtcaaattaaagaactctttccttagccctagatcccaaagatcttctcctgtttttttttctgaaaattttctagtttgatgttttacagtttgatctgctctttgaaagaaagcactcaatctgtcatcaagtatgatattagctgtaggttttttataggtggtatttatcaagttgaggaagttgctctatattcctagtttgctgacagtttttatcatgaatgaggtgctgcattaaaaaaattttttttgttgtcactttatgtagtttttcttgcctatggatataatcagttacattgattgattttcaaatgttgaactggtcttgcatacaggaatggatactatttaattgtgtcatattattttattatgtgttgctggattcagtttgctaatttttttttgaagaagtttgatctaagttaatgatagacactggtctgtagtttttattgtttatagtgtctttgtttagttttggtatcagggtaatattgtactcataaaatgagttggggaatgttacctattttaatttttgggaaatattgtataaaattagtgttaactcttctttaagtgtttggtagcattttccagtaaaatcatctgggtctggagatatcttccagaaacttataaattacataatccatttcctcgatggttaagcacagcacagtttgtttatatcttcttggctgaacacatgttcaagagcaaacacattttgtactataactgcatgtgccagcattgtccatgttgtatattcattgtagacttggtttaggcttctaaatcattttgagctgtagtggagactgaagttattagtaacttgggtcaatgtaaaaaatcagttttactcaggttaggtggtagaaagggaatgagagtgttctaaaatttctaagaagcatcttatcacaacctaataatgagtgtatgttggggcatggttaaaagtgagtagagaacatggtgagcaaaatattttgaaaaacagcacgttaggtgattttgaattctattactatcaaatttgaggaccagtacttgagagtgtataaacactattgtcagaattgggctagcacataaggatagagtatatataccttaacgatggcagcagcgggccatccgaagaggccactgctatagttccagctgtggcgagggaggctgggtggtagtggtgggagtggttgcaggagcagcagtggcagtggggagacccgtgtgcaccgtgccccctgtgccctgtgtccccaaggtagctgactgtgccacccccaccctcctgagcctaggcaggacccactcccaggcctggagcctctgccactccagaccctgtccctggtcactgctgtcacctgccacttctacggggaatagggagaagccagacagtccctgaagctatgggggccactgcagtggggccaggccaagtcacctgctggtgggagagcagggcagtcaggtatggaggggtgggcagagaggggaccccaaggcggaactgggtctggggcagtgctgtgctccatagagccagtgggagcggggagcagacagtagccctaccctgccgagcatggttgtagccttccaagtcatggctgtggaccagtatatccgtgtgctctttggggcaggaagcaggcagcaaccttgccctcctgggcgcagctgcaactgtccacctgcgactgcggactcaggcatctctctgcactctcagtggcccaggaaggccccccttacccctgcaggcttggagatgtctgcttccactgcctggtctctccctgctcttggtggctgctccagtcttggagcaaggattgggcactgttggagcttggccaggtgtgtgcatgctcagggtagagctgacatgccagccccctgctgcctcagtcccctctggactttcggcataaacgagcatgggagagtggctgaggggggccctgagggaagtctggttttggcctgcaggtgccccttggcaagaacaacctgggcaccatgaatggctgcaggaggcagacaggctccagggtggaagggtcctgatgaaaccccaccttcaagcttgggagggcctgaagcctggggggctgggctgccggtcccgttgaacagagtgggaaagtgtggtactttttcctactctcacccatgcaccagtcagcgcacactatatctggcccataaaaacctcagactcagccagacttgagaagaggatggagagatgatgagacaaagagatggctagctgcagagagaagctgcccaccccagggtctcctctctgctgagagctgaggagacaatggtaggaccagatgcagagaggtgctgctctttctgctgagagctgaagagactataggacagcctgcctggcagaaaggaggtaccctccctactgagagctgaagacttgtcaggacatcctggctatggagaggagctgcccactgcaggttccctctgagctgttcttttgctcactaaagctcctctttgtcttactcaccctccggttgtttgtgtgcttctttcttcctggatgctggacaagaacttgggacctgccaaatggcaaggctaaaagagctgtaatacaaagagggctggaacatgcccctcgcttgccatgttgtggatgaagagaagaagagaatagctgtggccctttggggagcccagacctgggagcttcctgagccagggctgtgactccctttttggggccctgtggtttctggtgtctccaagcttccggtgccactgcattccccagtgctggccggggaagctgcttgcagtccacctgcagcctcacagggagctggtgtctcttccagttcctggagctgcacgccctgctctagccagcatgcctggctgtgtgcagtggccagaccccatgctcactcacacacttcttgttgctctgttcctggtgtaccgttggcaggcatgggatcctggccggtagcgggagctgagtggagactgccagtctgagtggacaaaacgaatccagtgggccagagtgaacctcaggcaaaggtgccactggccacagaggtttccatctggcgaagcgacaccccaaggatcccgtaacattaagggatgctataaagccctactcagacaaaataccttagttgccattttggtatatcagttcgttttcccctaaaaataaaacatttcaggcatttaaaaaatactgtaaatattttaagaaaatctttttttgttcctaaaaactgaatgtattgatttcctaaaatcactagtatagtgaagaaatatttaatcattatatttttataacaatctagaaatattttattatctaagtatttatttcactgttacatataattatatgtactgtaataacataaaccataacatactgttaaatggtgcattctttggatagtattttacttaatgcattttggtgttaaatcatttgttaaatacagacccttaattttttaatgacatctagcctataacaacttttttcatttatttgctttttatttgttcattatagcctattttaagaaacttagcattttaaaagagttttggatttataagagaaagagattgaagttcttggaaaatttaatgggtcagtgtcggggtaggatagttagagaagaaagaacaggttaaagttaaaatctattgtgcaaagcagtatagagaaagggaaggtgaggagcaggttcatgacttgtagcttttgtattttattcactgagaagcaatggaaatggaaaggcttaactaattggataaccatgtagcattgagataccgtttttgaaactagaatacctaccttcttagtgaagagtctgtagaattaaatgatgttctttcctagtactgagcaatttagtagcaagaaccatgctcctttggaatggtcctgttttcttcatggtgtgaagtggattaggagaatgagtagaaagtgcgggtgagagaatatgggaaatatgtagctatggttgcaaagttggatgagggtcagaggaagctagggaaagttgacaaactggttgtgatacagttaagctagatttccacaagggtgaagaacaggttttgtgtagaagtaggatagggttgaaaattagcaagttgtcataaagggtttatttaataagtaacttgctgaagtgtgatatacatgattttcgatggtataaagaagcttgaactgtgagactgtggtaatatctagattataaaattagatgttgatattaggatggtatggtaactgaagaggaaaaaagtgagattatagagggatgccttggagtttgtagatgaggatgaaaatttatattataggatgatatgaatttcaaaggggcgtctgttaagtaattgtggtagagaagtggtcttgaggtctattgttattgagccaggagagctctgtaatccatatgatagtgggcagagtggaccaaagagatttcaaggtgacaactaagatgaaaaggtgaagaggagtttctacaaatatttttcaagaaaaattattcaaattatatttctgagtaataaatgaagcatcagagggagttgtagatgcactgagaaagggaccctgtcatttgcggccatcttgtttttttttttttttttcacgtgaattactcctcctgggtccttctgtgtcagtgtacttttggaccacttctgtaacactgccgtaatctttataattgtttaggatctttgaaaagttcatagttagaatttaaaaatcgtagtactttcctttgtgagacttgccttttttcttttctttaaaaaaaaaaaaagcgaaattttcttctagagttaacttgcatttagattcttcagttgattttccttgcttaaaggctggtgaatgagcttttggcttccttgtaagcccttttagcagataattctgctcttccttcacacagtcagtttattcacaaattttggaattcaattctcacctccctcagtgctaacatcaaactcctcggccaaataaagttgttaattaagactactctatataattctcacctcccttaagtgttagctccaaactttttttttaaatcaaattatactgtggggaatattcttcataattgctaactcttttagatgtattctcctacaaagttactcatctcttccagggtttattacaaaatctaagtacgaaatatcctcatggaaggatgttactatggatcagtagatttaagaagaaaattcagttgaagggaaataaagaacttatgtagaatcaagcaggttgcctgtataaccaaagttttggtgatgtgttggagattaatatataattggactccggttaaatgaagaattgataaattacaaaatactttgagaagaataaataacattacattgatacattacatattaactaacatttattctctcccaacaaaataaaatttttgtttattatgtgtaaactattggggacgctatgttaagtcctttatatatacagtatatatattatgtcatgtgattctcattattgtgaaagttagatatgaacaaaactcgttttataaatgagaatattaaagctgagaggttataattttttcaaagtcacacagctagtaactgttcagggttgcgatttgtgactccagagctattagaatttaatgctttccttaagtgcacatattcattattgtctctattctgtaaactgtaattgtgtcttgcttttgtgttcctaaccaagattattagtgtcttagggcagtgatctctccgccagcatatcctaaacttgtatgatcatgaaaagcttttattcaggaatgtgtctcataatggggactggtgaattgaatacagctggctaaaatcacgtggaaaagagcctatcacccttttgtttccttacagagaggtcacacctctcatgggtttagagtgtgaaattaacaaataaggtaaacttgggtcccttgtacatcacttaaagcacttgtaagtatattacttttttggggtttggtactacaacccttatcatttcctcttacctttgataatatttcttcatagcccttaatttttaagtttccttaaatttcttggctacctgaacaaggtatttcacctctttgcaagactggggaagtgtcatgccttttacatgttctttttctggtttggctaacgtgagacatttttcaggcttgagtgaatccatgaccagtttggtataaatgatgccctcaagttactgctgagctatgtagtttaattttcttattttttacattgaaggcatatgacgtaactttagtgtgttaactttcttcctaggtgtctcttcctcagataggataatcccaccatttttactgtttacagcaaacgttcattatatatgtgacattgtagcattccttgaattcttttctatattctataatttttcctttaaagtccagctatagtctcttcatctttttaatttcaagcttacagaaaattgaaactagtacagtggacacctgtgctaccctttaccaaaattcactaattagtaatgttttgccactttgcattttgctctcttttaagtataggtaaaagaaatcagtcaaatattagcaaaaaactacctatgagttacatacatcatgaatattgtccctaaatacttcagtaatacatctcttgagtttaaggctgttgtgtgtgtgtgtgtgtgtgtgtgtgtgtgtgtgtgtgtgttttgttttgtttttaagacacagtcttgctgtgtcacccaggctggagtgcagtggcgcgatcatggctcactacaacctctgcctcacgggttcaagcgattctcctgcctcagcctctcaggtatctgggactacaggcacctgccgccatgcctggctaaatttttttgtatttttagtagagatggggtttcagcgtgttggccaggctggtcttgaactcctgacctcctgatccgcctgccttggcctcccaaagtgctgggattacaggtgtgagccaccgtacccggccaaggctattcttatataattagaacaccattataacttttaagtaaattaatattagttcagtgatataatcttactatataattcatatttaaattttgcatttgtctccaaaatgtcttttatttcactcccgcacccccatgccatgtgagatccatttgaggttcatctgttacatttgttacacctctttcttttaatctataacgtttccacacttaaacaagaaagtatttgttttaatgatggtgactttttttttccctgaggaatccaagcaacttgccttttatagtgtcccatgctctggatttgtctgattgtttcttcctgattatattcaagggaagagtactatagcagttagttggaatacttcttattgtatattatcaggaggcccataatattagcttgttcatataccagtgctgagattaatcacttgattagggtgatggttgtcagatctctccattgtacagggaaattttttttgcttttattaagtatttggggagataagtggcttgggaggaaggaaacagggagatcaattgaatatcctgtttctcagtaattttttacccagcacttgtagtattaatttataatgtttgtctgaacttgatattacattagtgattgtgaaatggagattttcaaattaagtgatttcttctacattaattagttgtcattcttctgtaaaggcaaggtttgccaacctcacttaccttttgttttgagtattccaactcaaagattcttttcattccctaatccattactaggattattcttcttcatgttcagattgtcctaaatttgacctgtgggaaccaactcctatatcatagtgtatctcctttagtctactttctggtacaagatattctaagcttacgttgtatgttctctgccgtggaactgtaatcagcacttttttcaaggagccctggttcctcttcgtaggaaatgatatttagaaagcaaaaacttagctaggtgtacgctttactgctgaggtagtattattgctttgaggcctttttagtagagctaagggatatggttctgtggggatgtgtgtgtgtatatagatgtgtatacgtattttaaaattatgacttcagttagatacgtattattgtagcagagcattacgtgttttcttctctctttccctcattccatacttttatctctttggcctgagacattaatacaggtatagcaggatctgtcttggtccacaaagaagtcgtctagggtagttctctcatccatagcaactcagtgagttgaagctgatgtgaatgcctcagtgagttgaggctgaagtggtattattgatcacttcggtgaaagttagtgataaatttcttacctcctgttatatgtggaattgtttctttccaaaaaggtattctgcattcttaacccccaggtagcccagactgtggcctcatttggaaataggatagttgtagatgtaattagttaagatgaggtgatactcaggcagggcaggcctttaatccaatatgaccgatgccatatcagcaaaagagggcaatttttttactaaattctattttattgcattgttacagacacacagggagattgccttttgatggcagaggtggggaaatggaataatttagctggaagccagggaatgtcaggtattgacagccatcatcagaagctaggaagaggcaaggaaagattctccccttcagttttaagagggagcatggccctactcataccttgattttagacttctagcctccagaactatgaggttttttttgttttgtttaagccatccagtttgtgatactttgttatggccacccagagaaactgatacaccaccttttacctactggatgattctcaccataaacaaaacatcccacaagggatgcataaacacaagtcaaatatccctctgggtcagctcccccaggtatctgaaggctagcctcatttcagagagatctctactgtgatccgagggctgtatacttccataaacacttgaaggtctcttacaacccattcctggtatagttcatcatacctaatgtggtattggagcaaagacaagatggtattaaacttttgcatgagaagtccagccctggggagtgtatgtagtgcccctgtgaagttttgcttacaattattgaggtcttccaaatgggaccttcatcattaagaaacccaggttggcagtgccttcagtgtagcctcttggctggctggtagactttggttcctccaactcagtttgatgaatacattgtgtccacgattctagacagacccgcagggagtagttagttactccaatctgttttattgactatgccactagcaggccatcccttgttctctcctaagaaagactgagctatggccacaggagtggggctgagagaaacatgagagaaagggcaattgatattttgcatgaaagctggggtcttccattaacacttccataaattccgtcttaagattaagaagaatgacaaagtttgttcagaccccactggttgaagatggcagatccagcagttgatggtttcagagagctgcaccagtgtgttttttcatgtgaggaagtcttcaaaggtggttctcaaagacaaaagattttactgtctctccctctctacctcctaggatctgtattttcatcttcacatactagaatttttgcttaccctcataaaatcattgtctccatctgagtatctgtaacttcaccttttctccagttatcccgtactaacacccagattatcagatgttcgtctggagagttttagtatgagagatataagggcatttcaatgaaatttatagagactgattacatccttcactttggcctccgtaggccactgcaggagggcttagtgtgaagtacactcagccaagtggtcattatccttattaactaagaccatgtcagtaaaacaagagaactcagtgactgaacccagattaaatctgaatttcctaagccttttttttttccccccaaaggtaggctgccacccaggggatatattggttgagtttcctcaaggtaactgtcaaggaaggaaaggaagcattatgcccgggaatggtcaggacagaatcttaaatttttcaaaatagatctgaataatgcccacatctcttgtattgatcatttcttaggaagcagccaagaagagatgaactctttcttgggatagatgtgtttagtcaccaaactgccgtgtgaaggtgtgtggacaaaaagaggagaggaagtcgagtcacacatattttcatgttaatttttgaggtggctcaaatgcatgtcacaatgctggatgctagcagatgttagggcacatggaatgactgctgaatgccttacctattggcttatgttttggtggcttttgtggcaaaaggcacagtattattagactgtaatatagtccagagagccagaaataatgacatattttaatttaaaaattcacaatggaatggctacagttaactagcacaatgtactctaacacactgtactctcacagtgagagtcgtaatagtagtaaggtgccagtggtagccccgacaaaagaacaaaggctcattaaagtcagtttgctaagaacagatgcgtatgatgccttgactagcatggctgctgccctgcaaggtaaacaggccaatgtttgataagagtctcaagtctagtattcattgtagcttctgcatgaacttacagtaatggagccaggtagcaatggtggtgatctggtaagtgtaggtttaattagcagcttgattccagatggtttgtcagattatgggtcctcactgtgggcgactacgttaagtgacctcttggtgactagttcgcatgtgtgatttgttgttcaaaagatagatgtttcaaagagcggtgtctttatctcttagtctgtagtcttccaagtggcagatgatatggttaggccagtggcaacagtcagtacaaatgtgggaagatttgtcaaagtgggtcttggtcaggactatgaggactgccttgagttctgcccactgagcagaacaaccacgcctgtttttggtattacacagctgtttctgaggggaagcagccacagcagcccgttaagcacaatcggatttcaacttagcagaatcatcagttactcaggcctgggcatttagggaacctctgtgaattgagggctccactgggccattaactttgagttgggtggcagagttagggataaagtttgctacaagagatagctgctgtttttttaatgtaaaactgatgggtggccagggtcagctgcactcttaaatataccatttccacaaggaaagcctggtggacgcttaataccttagtcatcagatccaagtagaccaaccccagaatagagatattaggcatttgtttgtacttggtggtcttgtgaggcagttgccatccagaaatcaaactggcgttggtacatggaagacaactcatgttgccgtaggcattagtcagcagaattctcagtcatggagactgtagttggaagcagtcattaggtttgtgtgtccccaaagatacggggtgtggtttgctgaacatttgcagtgcagcctgttgcattgtttccttttcagaggacactggtttgtgggctagtctatataaatgatgaagacgaatgttccagtgggagattaacttatttcagtgcctaaagagttcattaaggtgttgggcctcctttttggggtcaagtctgaagagatagcagtttttctttcactgctggggaaattgagtgtttgtagtctgttcacatagtcccaagaaattttatttggtgctggtgagatactgatgccgatccagttttcttactttgaatgtgatttgtttttttgccttgtgggccaaagtatattttaaattttttcactgaagtctgataattctgctatactatgtcttacagttgactattctaggttgcctttttcaggcacacaaagaactcttcaatatgtatatagggactttatttttagaaatgttattatatcgtagtttaaaataccagttctatttcattgttttgtttttctacttcagggactctaattctccatatgtttaatattttaaaatccaccccattccctcttaaacttttattttgtttttgttctcttacctgcttttaatcctattcttaatgtcctttatttattttcagtcaactccatttttctttgaagactttgtaatacagacttcatttctgcgtggattctgtctgttttgcttttttgaaacatactggtttcctgagtcttactaactgtgatatatcgtcttttgttttttatttctatttctagttgtttaatttctgatttgagattttctgtcttcaactgcttgtttaatgatatttactttaggttggagtattttgtttcagttttctcttcatgattttgtttttagggaaattttttatcagttgaagaatttttattctttctgatttatttttgtagtagccttgtacagatgctgttgatcatttgctgcttcttaaaactttttttttacccctttcctataccagaccagaaaccatagtttatatgtggggtggggatggctagacttttgagtggcctactgatttcttaattcaagtaccctttctgctcataacgtgaaataggtcgagttcagcaagcttatttttctcccccgctcacttcttcctccctcctatttcttcctctctcctccttcttgcagtggcatattctgattctgaaataatttatgtttccacaggtcccttaattttcatgacctgcttctctgtttcactctatcaccaacccactaatgcatgtctgcttcttctaagttgtttcccactccccacaaagtggtgcattcttaagactgccatgtttgttcctgtgtacttccaagcccctttctttatgttccacagtagccactgttcttgcccaccatgttatagacctgttctcagtgttttcaaattcagctgagattctgtctttcttggggtgattcccacccccgccgccccccgtatttcgcctctgctaggatccctcgtacccctttttccctgtacagtctccaccttcctgttcttgcatggattactgaagttataaatgttaatttcctcacttccatttacatttatattctgtaggattctttttatcccagttactgtactggcattagtagttttgattatgctttttggagaactacatggtttttggagttctttgttggttatcattatcctacaggaactcagtaattgtcgcgtatagttttaatctttgtaggagaaattggaatctgaccacacagaaggaagttctttgaagacaaactttttttttctttttttcttttttttttttttttttttttttggagacaagagtctcactctgttgcccatgctggagtgcagtggcatgatctctgctcactgcaacctctccgcctcctgggttcaagtgattcccctgctgcagcctccttagtagctgggattacagacatgtggtaccacgcctggctaatttttgtatttttaatagagacagggtttcaccatgttggccaggctggtctcaacctcccaacctcaagtgatccacctgccttggcctcccaaagtgctgggattacaggcttgagccactgtacctggctgaggacaaatactagcattacactgatgattatgatcatgtgttgatgctagatcacgtgatgttcagggcttcagtgatgatgatcatgtgttgatgctagatcacgtgatgttcagagcttcagtgatgatgatcatgtgtcgatgctagatcacgtgatgttcaaggcttcagtgatgatgatcatgtgtcgatgctagatcacgtgatgttcagggctccagtgatgatcatgtgctgatgctcgatcacgtgatgttcagggcttcagtgatgatgatcatgtgtcgatgctagatcacgtgatgttcagggcttcagtgatgatcatgtgtcgatgctagatcacgtgatgttcagggcttcagtgatgatgatcatgtgttgatgctagatcacgtgatgttcagcgcttcagtgatgatcatgtgtcgatgctagatcacatgatgttcagagcttcagtgatgatgatcatgtgttgatgctagatcacgtgatgttcagggctttggactttctgtgtgcttagtgggattttattgaatgaaatgaatgagaattttttcatattgatgaaaaactcattgaaaagtttcttgatagacagctacaggagtaaagatcatacaaaacggtgctttatttctctaaaaatgctttatttatataggttataactgaaataaatgaaaaaatgacttttaaaactctaatcttgatagctgcttttaagcatttaaagataaaactttctgcatttttatatctaaagctgcaactattatataaagtcataaattacaattcatctttgtattatttttaagcatttattcttggtttcaatgattttagtttatgttagtcatttaacatattaaatgagatttactaattttcatggtctcagaccttagtcctcaaataatttctcttagatgcataagagtcgttttttttttttttggacccatgaggatgacttagtacagtcagtcaatatgagtaaaaccacttcagatatagtcctttcttgtgataggttgttgtctttgtcaccataatacagtgaacaaaataatattctttttatttatcagaagacagtgattatcatgtgcccatgcagaagagagttaacatagcaggcctgagattgttatcgttagaaaggggagctcccaagtgtggcccttgcttgccatatgggaacttggattttgggaatttttccaccattacttagctgagaagggtggttcactgtccctgaactgtttacaaacaatgtggttaatgctgaacacctgctttttttgtgtaagtttggaattttgccacctaccatgcagagggcatctacatgaccaaccttcttgggcactgaatctgtaatgaacctccctggtagaaacactttacacgtgtcacaacggaattgatcctgtgtgacctgacagggagtcactgttggaaacttatctggttcacttcagactgcaccgtgtgccttttccctctgctgattttgctttgtgtcctttctctgtagtaaatctcaaccatgaatgtgaccatgtgctgattcctctgagtcttcttagtgaatcaccaaacgtggtgatggtactggggacgcccaacacacaaccttttaataattctgaaatgttttctcctggtcttggcaagaagttatatatttaatattcattttagtttttatttagtttttcagatctgtagaataagcctcccctgcccctaaagaatcttaaatagaactagggacaaaaagaaacctcattttataaatttgtggctttttgtcgtggaactggatactagtatggtgctattatattgatactggcatatatttttgaaccaatttttattgaatggtcactgtgtataaattctctcctggatccaaggggagatgatggtgaacaaactgacctggctgctgctctcattatctcagagtctagttcgtaaatgtcatgaaggaaaagcacagagatttatgagaggatcctggtttttcctgttaatctgtgtgttcaaaaaggtttatttaagggagtgataaattgcagtgttaagttatacacgaagactaggaattcatgaggcatgtttatctgctcccatgtactagacatacctctttgccatgtatactgagtgtgttatatgtattgtgtgccatgtgtgctctgtagctatagaaaagctaggttgaggccgggcgcggtggctcacacctgtaatcccagcactttgggaggccgaggtgggcagatcattaggtcaagagatcgagaccatcctggccaacatggtgaaacccctgtctctaccagaaatagagaaaattagctgggcgcggtggcactcgcctgtagtcccacctactcgggaggctgaggcaggagaatcacttgaaccagggaggtggaggttgcagtgagccaagattgtgccactgcactccggcctggcgacagagagagagactccgtctcaaaaaaaaaaaaaaaaaagaaaagttgcattgagaagaaggaaggaatttcacagaaatcctatatcaagagtaagcctagtttatcaaaggaaattaaaatttgggtctggtgcagagagtgagaggggaagacactagaagtaaggtctgaaaatgcaaatagtcaatgaattttaagctagatggtgggtaccccaaggtttgcatactcctttgccatttactagagacttcgttatgcctcatgtttttaacctcatgacaactgttgagagagaaattactagtattgtcatgctaaaaaggggaaaataaagtatttgtggctttctcaagtttatacattacaaagttgaaagccagtccacaagtacagattttcaaaattcatgtgttacctatgttctttctacttggccacatcataataataggtgtagtgttacattgtttggaagtcatgataaaagtattatggttattttatatgtatctaaaggccttgccaaaaatgaaaaccagacaaaaagagacgcaaggaaacttttggaagtgatggaaatgtttattaacttgactgtggtggtggtaacatgaatgtgtacatatgtctacactcaccaaattgtacccattatatacattaatcgtgtgggctttttaatataccagttatacctcattgaagctgggggaaaagaatagtccaagaacatttcttcagtgtttagcataagatattcctatggtagtctgccagttcattaacaaaattagagatgtttggaacaatattactgggtagaatagttgcttgtcatggaattttgtagtatcacaagatagatctctctctatacaatatataatgcatatactcagatagttaactggttaatcagtagttcaagaattatttaagaatagtatgtgaatctctatgctttttattcaattttgttgagaatctaaaactcctctaaaaatagtctattaaaaataagtttgatgagaaaagttaaaaaaatgaagataaatatgaataaatatacgaaagggttcctggcatacactaaatctccatgaatgtttcttgtgacggcaatactatcagttgactagaaaagacataatctccatctcttgggacacagtttctgtaatcttgtgtctacctttttgattcattacaataaaggtctttaaagtctgcgtatattctgttctttaccacatgaagctgaagaatagacttactgggaaatcctgcaggatttaagatgtgagttaacgctttcctcattttgacttctcaggttttgcaatatatatatatgaatttacttaacagatattttttgagtatcatgatagttcctgggcatgttatcataaacaaggtttacattgctttgttgttttgtttttattatttaagattataagtgttataatggattgaagtatcttgaggcagtggcctgtatgtcttacctcttccaaacattgaattaattcacccatttattcatttatttgctaattctttattattagttgcacaaatattaaatacatattataatcatatgtagtaggtaaatgatacggcttgactgtgtccccacacaaatgtcactttgaattgttcccataatccctatgtgttttgggagggacccatgttgttctgatgatagtgagtgagtcctcacatgacctgatggctttataaggggcttttccgcctttgcttggcactccttcttcctgccgccttgtgaagaaggtgccttgcttcccttttgccttccgccatgatcatgtttactgaggcctccccagctgtgctgaactgtgagtcagttaaacctctttctttgtaaattacgctgtcttgggtatgtctttattagcagcatgagaatggactaatacagtaagaaaacttgttaaacgaacaatgcgttaaatgatttccttactacattgtgtgacattcttcttggcataccacatttaagcattaatatgttactgttagttgtttttttttttttaaggagaaccaaaatttctttgactttcaaaaactgagtgctaactctgcgtattgtatacacttcaacatattttatgttcatatacagttttgctttaaaatatgtatttggatcacatatgttagaattgttttccaaggaaagatctacttaggtctgatgaagaaaatggatgcacagggaacagctttaagaaacacaacctctttatcttacatctagtgaattattcagtcaattacaatatggtagtgaactgttgatttctcagctcttcagaggccttaggtctacttaatatatttcagtgaattcagctgggccctgatatgtatagcgcaaccagaggagcaactgtgttagaagtctttgtgcagggtgttgtttatcagttgtttttttcttctcgaggaccagaaccttaagtaataggtgagtgtgctcgctccagatctttgtgtatcactgtctatagaatttttttatttggggttttattatggcataagtacaattcattttacgtatataactgtaaagacatacaatggtattttcatacgaatctgctataagaagtttgattaacattaaaaagagaagctatacttcttaaaacatctctttaaaaattatattcatcatgggaaataaatatgtagaactgtagatgatataattctttttagttttacataaccttttaaaaagcattataacataaaagattgtagcatttagattaagtgatttttttccccataataaaatatggagaagatttactataacacatttaacagaacagtgccctgcagttattgcctaagccttcctggatccttttgacgcagcgtgactgccctcttcaggctgcataagtatatattagaatttatggcgttcactacattcatgaagttaggcctttactattactatgaactactacaacaaaatatttttcagttaatagtgttggaaatgtagtcattttagttaagtgcttggagtatttgtggattttaacttgccatttcagatggtagtgaggtcagaagtgtgctaataagctttcgtaatgtctcattttgctcatcagtccaagctgacagaaacatattcaaggatcctctgaatttctttatctgtcattagttaggttttctctgtcccctattaaacgttaagaagttgggatatggagggcgcataagggataatgggggtaagtatgcatagggtctttgttattggggcacattttttttttctaatgaatcttttgtactctgaagagatatcattaatattaaaatacgtattcctcgggctcatttatttatttttaatgatatacagatctgtttactgaccctgtttctactgaattacactcagcagaaaaaagcccccatttgccttgtcattattaaattttccccaagtattgtatttgagtcaagaaaatgtgatttgctttagcttctgtggaattctttattctagccagagctatccctaagtatattgtctacaaaattttgctggatgttatggcttgccaggttgcaatggagaatttatgtgaaataggtcacatcttcatttacataatattttaatagtctcatatgttttcccagccagaccattagagtaacattgaaagtgggttccaaaccttcattttcttctcctccaatatatcatgcatattgttgtgagatacagcattctcaaatagtattttgcataatctacttacttcagaaacacttgtttactatttacacaataaaagctgggtcctatttatgtttctaccacttccagagtttattttctaccctgaagcttacattctattacttgaacacagaatacacattccagacagggtagtctttgtttatactgtttctattaccttacttttctctccctgtccttgcttgttgtaagtgcagtccttccagacataccaccattattttccaatttttttttacattcatactttgtcgaactgttccagctcactattatctcatcctctgtatgctgtatagcacctacagtctacattcctctttaaaatatgtataccttatttatgtactagagtgcttatctattctttaacctcttaaaagtggagactgtgaggtatacttctttattattgcagtacatatgaaaatgttgagtataaatttcactgatgattaagatctggattcaacatttgttatgaaattgtcattactaataggatatcacatgatgatttagtcattgtaacctttgagtcatgaacactattcctttgacaaacagcatatgtttgtgatagtacacagatgtaaaatttcattttttcttcccctcaacaccataactaaagtaaaggaaatctgccttaaaagagacattatccagtgacataaatctgactaaatgagttgtagactctctagaattcagaaattctaatgtggtaaacttagcttaagggtatttatgatatagtggctggctatgaaactatattattcatcatcagtatcattatacctttattaaatgccacttctgtactagatcctagccattggacaatcaatatgtaataagaacagctatgcataaaatcagtagtgctacacagtcgctgagaatttctgtttcagacatttccatcagcaagcattgtaagtatagtgatttgaagtgacttcctaaagagaggcagtttttgagcaagcttctgaaagaagggaggacattctaagtgaagtatttcatgcacgtggttaagaatggacatagtatgttcgtgaaacacagactatttgagtgtggtatttttataaagacatagattatgtaagttgtggccaagttatggaggtttttgacttttattcttcccattatcttcattatgtacgtagtggggaacatttttggactttagaatagaggctagaatctacaaattggttattgggacattaaatctgaaaaagtagagtaatatggaatacagagtttgaaggcaaattgaattcatgctctttgactccccattactttatcactttttattttttaatttttttaaattacattttagtattcaatacttgtattatgttaaaagtttttagattatagtactgttcatatttaaccctcttaaaacataatattttaatcaaaacaatgttatgtgcttcttgtttataaaaaagaactgcagaagaggcccttgcactcatctgatttgcacacaggtaggctaggccagagatgatcctaccagagaatgtttctgctttgtaatttttttcttctgttgtttttaaaaaatagctgtaaatgttattcttgtaacaacattttatacagtaaacttatctttacattcttgttatgataggtatagatttaactcatctcacctttcattgctttttgtttattcttttgtttatcactgtaacactaaataacatctttgtgttttttgttcattacctatggctgatgttttttgattcccgcattgtgatatgaagatgagcagacatcttcttccccatcacctcttcttcttctcttttacataccaaattctgttggctatcgttctatattgtcatagttcataatatgtacattccatactgtaaccataattattacatttgagttctgtttataggttgatttagaaagttaaaagggaataaacagcatttacattattatttctgcataagtagcatcaatggcaaagtagtaggttatcattatgattccttttctacagtgccattgttgataacccctgacccgctcaaaagaatatatttaaataatctttctaatcaccagttcatcaaaattatgatacattttaataagctgcatatttgaaccttgtctcttatgttcatttttttgtttttatttttcctgttggaataaatacggttttcttactatagatttaatatgttctagctgtttctgattttaatgattacttagaatctattcttttcatctcgaagtctaaaattcctgttctagtttgtattggttgcatcatagcttcacagactacagcttctttacgtcttctctccgtgctacctcactcactgcatttctagttgccttttttcctctcttacagtgctctatcatagtcttaagttttcttagtttttcattcacactaccttttctatcagttatattttaaggtaattttctgagaatttggggtctaatttcagattccttacatttccatgaacatgtttatttcaaacttgattatttgtctcaacgtgcaattttaaatagaaaataatattctgaaggaattcttctatttgtcggtatctagtgttgctaatgatcagtccattcccaatctcattgattgcacttgtttaggaaacttttttctctgagaacttttaggatcttctttttatccatagtgttttgatatatcccagtatctctccaggttgttcttttctcattcctcttattcagaactgggaaatgattttaatttgaagacttaatctcctttaattgtattgtttacagaaataccattttctctgtttcacctctcctctatttctgtgatgcctgtttgaaaaaggacttactggactctaggtccttctcattctgtcatacattccacctatgttgtttttgttctgtgaattttattcgactctgtcttctaacattggtgttttatttgggcagtcatattcgaaatctatataagtgctctctcttttactatctttattccttttttatatgatattgtttttgttttttccttccgtgaatacccatgaacaaagcagtctgcatgttctcactgggtatgtcgagaatacaaaggcctgactagacgcgggcagactctgagggttgtatgtgcagtgacaagccttaaagaataagacgttggctgggcgcagtggctcacgcctgtaatcccagcactttgagaggctgaggcgggcggatcacgaggtcaggagatcgagaccatcctggctaagacggtgaaaccctgtttctactaaaaatacaaaaaattatctgggcgaggtggcacacgcctgtagtcccagctactcgggaggctgaggcaggagaatggcgtcaacccaggaggcggagcttgcagtgagccgagatcgcgccgttgcactccagcctgggtgacagagcaagactctgtgtcaaaaaaaaaaaaaaaaaaaaaaaaaaaaaaagacatctcctgttgaacaaagcatcatcttgttatcacgtaccataaaaacaataattcctttaaacccggtgtttctctcctgtaacagtcacctgtatgtgcaggagtccatgaagagccctttgtgttaccgtgtgagacttgggggatagagaactaatgaaaatgaaaatgaactaataaagtcccttttctctgacccaggagtctcatgtcttctgccagcatccatgaaacagtaacaggctaggtcgttagcttgcattatatatgtggtaaaatctcagatcctgcacagttcttgataaatacaatatcttttctgacagaatttttataagtatgttagttacagttacacttccattttcatgttttctgatcgttcttttagagtctgtttgttttgggaagtttttaagaaatcacataaggttttcctcaaatacatgttttttttcgttgcggtggggatgaaggctaacattgggactggttcgggagggtgcagaagtttggtctactattgagtattaagaagtttagccgggcgcggtggctcacgcctgtaatcccagcactttgggaggccgaggcgggcagatcacgaggtcaggagatcgagaccatcctggctaacacggtgaaaccccgtctctactaaaaatagaaaaaattagccgggcttggtggcgggcgcctgtagtcccagctgcttgggaggctgaggcaggagaatggcatgatcctgggaggcggagcttgcagtgagccgagatcgcgccactgcactccagcctgggcgacagagcaagactccgtctcaaaagaaaaaaaaaaaaaaaagtttaattatgacatctgtttttagcttcatgttttttttaaatctccagcctctgctgcttctgaatctaatgtttttctagcttcttattgcactgcaatctcctttgagagtctaacttcctctcaaaacttttcaccagctttctgtttttcagatatttgtggaactctttctgctgctgactctgctccaagtccttttgttattgttaggttgtacctttttatttctttattttcattttggggagaggggggagataaactctagagaacagtcaaccatactgaagaagcaattttattttttaaaaatgttttagcaataacttgttgcttcttatttctattactgcatttacatcctcctataaatgccatttttctgtttcttctctgttcctacataaagttttatcatctggaaaattagcaaaatatctaataaaaatgtgttcaaagtagaaacaaatatcatcttagagaaggaatgtttgtggcatctggtttagctacaaagagaaatctttgcttactgttggtttgaatgtaaatgcattttgagataaatggaatgaataaggtggagtataagtatttaaaattttaaaactattaattttgtttttctgttaaactaagttgcaaatattcttaaaaattggtctttgcattttactaaacattattggaatatttaatttatgtgtatagggaatgctgcaaaatgtttttattccctagagtaagagttggcaaaatttttatttaaagggctaggctttgtgatacatgtagttgctgtcttgttgttacaactttgcccttatagcacataagcaatatgtaaatgaataaatgtggctgtgtcgcaataaaactgtagttatgaacatcagaatttgaattttatgtaattttcatgtcagagaatcctttttttaaaaaaaaatattttaaaaactatgcttttcttacagtctgtacaaaaactggccagtgcttgtcctagggttgtctgttttaataactgctttgtagatgcttcagtactgatgtgtttctactatggcccattattcttatcaggcaagctaatgaagaatatcaaatactggcgaactcctggcgctattcatctgctttttgtaacaagctcttcttcagtatggtggactatgatgaggggacagacgtttttcagcaggtaaagagttatatcgtattcatatatttaacatagttgtttgtggtcgatacatttttgtttgtcacataaaaatacaattcattcatcgtctgaacctgggaggcggaggttgcagtgagccgagattgtgccactgcattccaggtggaggacagagcaagacttttacacacacacacacacacacacacacacacacacacacaaatacaattcattcaataggttagtaaatacaataagtagttataatacattttgtgatgtgattaacataattatggctaaacttatttttatcattgtacaggtttttgccattatgataaattcattttaacttttgcaacatagaggaaatgtgttttttcagcatgcagtcgcagtttacatgcattggtcttattctggcatttaattataggtggtagtgtattatagatagtattttgcacagatttgtgacattttatataaaatttattgcaagttttacttaactgttattttttccaatgtggcagatagtattttacatatagaggattaaatatttattgacaagtattttctctctgtttatggactgaattgtatttccccaaattcataagttgaagccatagcttctggcgtgactgtatttgaagatagggccttgaaggaagtaattaaggttaaatgaggccataaaggtggaaccctagtccaaagggactgatgtccatataagacgaggaatcgggagcaggagtgcatgtgcagagagaaaaggggcatgttagaacacagcgagaagatggtcacaggccaggaagaggagcctcacccgaaaccaactctgccggcaccttcctcttggactttgagtcttcagaactgtgaaaaataaatttctgttggttaggtcacctactctggaattttctgttctagcaactcaagcaaactaataagcttatttacccagtattctctatagagcaaggtattagacttgcgattggaacactcattatcatcgatgttgtcatggttgtatcatcatcattgttgacatcgagagcttatgtccaggcactgttcaacttatgtattatttcatctagcttcacagtgagagaaatgttgttactggctccatttcataggtgaggaaataaggaatgcagaaattgttgcttgtccaaggtcacaaagttagtgtaatgtgtaactagaatttgaactcaactgtgtggctcccagagccctagccttaatcatgctgttaccctgcagttcattattattttttaaaatgtttttactatgtgatcaatctatttaaaatgcaaaacttagtgcagttccggggttgatcttttcgggtatcttggtctatctcacatgtgatactctttggtataatgcttaccaggtcatggaaaagcatgcagttctgtaaagaatctagcctactaattgtatatcaccattagtgaacatttttacttatttgcatccagattatttcttcttgccagtttctagttaaataaattctctctttttgccttcaacattctttttctgttagtgttcttcacttatttcctccaaatttattttgcctttttaggatatttctttatattcatctattcagcaaatagttttgctcctatggtacctattctataggagcaataaatttggcaagaaaaacatacatagttctcctctataagcagcttacagattagggagctaatgataatagtaataatagtatcataataaaacatataaatatgtaatttcaaataacctaataaaggaaaattagagtactgtaagaaccaaatattatttcatataagtaatagatctctatagaatctcaggataattggccttagagatcatcagatagaagtgctattcaatgtatacttgaatcctctctatcatattggcaaacagtcttctagatccaacaagactgctagagcacagtcttgaggcccaaatatcttacatgactagacttgtggactaaatgaagacagggagttgggttagtttagtttcattgtatctttgttatgctgtttttgttgataatacattatctgttttgttacgatacctgatgtactaagtacatacttagtgtattaaacatcttatttacttttacaaatatgccttctcctatttttattaaaacaatgcctttcttggtatgtctttttaaaaatccttaacagaaacactcatttttcactttttcaaaatacttttatttctttactactgtaagaaacaaaattgccagaacaccatgcatctgatccttggtgtcattgttgaggaagcagtatggtgtgggtggggactacagcagattggagagaggatttgcttgacctcagtgggagaggcgcagctcagcatcagctctgtagaagaaatgtaggccacatgtagctagatctctctcaagaaaagacctaaataaaaatttttatatgaaatttctctctttaaaatgttggcagttaattcatatttttttttaaaatcttctgtgatattattatctttgtgttgagtactgaatgtaggctgctggtatataatcatataaataaatggttacatataatcattaaattcttttgtatgctttagacataattattctaaagtttggcgtataagagttgaagtcagttgtttttaattgaaacattttctcaggttaattttgattcagcaggaatcctggtgtagaactgccttgtctttcccaaaatctagtccttggcttagcaacaagagttttcattttaaaatgcagaaatgtgtaaaagttatagcagttaatgagttttatgaggaattttaatctacagaagtggagaagtatatgttttgcttcacttgagaaacactaaaaggtttttaatgcttattttttaactgactattaaatcatattttgctgaagtactgtctctgaattgatgttttaaagcactgttagcagtaatgtggtgtctgaagataatattaataacaagtgcagaaacttggtaatttctagcttgttggggactcactggggaagtaacttcaattatatgtgattcccataggaatggctgaggctaggtatctgatgataggctagtgggttaatgaatatggtgtgttagaaggagctctcatccaggaaacaggtctatgttgtgctctgctgtgggtagccctggggaattgggcattttaattaagaaaaaagactgaattctatgagtttttaagaacctctaaagttttagaacattaggtcttagtatggattttcctatagttttcatgtggggagtgaggaagatggggactttcagctttataattttgtatttacatggttgctatagacgtctctcatatatccatgagagaaacaaacatgaacaaagtatggaatgggagaagcacagggaagaaaggaactggtaactgtgtgctttgttcagtttaaggaacgttgctaaatgtccattacatggaagcccactgctgggagaatggaataagatagactcctgatgtacagggccatatcacacttattagatacattagagatatattttttatatatgttatatatacatgttgtatgttataatctgtatgatgtttacactgcattgcaggagcttgtgtttacaaatcagtcttctaatgaacttattaaaaaaggtttatgaaaataatattgttaaagccctgcaaacgtggtgaaacccccatctctactaaaaatacaaaaattagccaggtgtgatggcacatgtctgtaatcccagctactggggaggctgaggcaggagaattgcttgaacccaggatattgaggttgcagtgagccgagatcgtgccattgccctccagcctgggtgacacagcaagactccatctcaaaaaaaataataataaataaaatagttttcattaaatggagatagagttcagaaggtattatgatatcctggtaatgaagtgtctagagtcagaaaacctgagttcatcttccatctttacttcttcattgctgtgtgacctttggtaaatcactttatttttatatgcctctactcatctgtaagagagggaaaataatagtacctttctcataaaactgttgggaagattaaaataagatgttagctttagagtaggtagctatgcagacatgagcagggcaggagagggtccctcaccccaggatgtcaggtgaccatcatgtgatgatcaggtggttgttaaactgtcttgctaaaataataattggttgcagctggctgctaggaaaggcagtctcccagtaaatagaaaacacctgaagatggtgattagcagcttcctgctaagatcttaggacttaagtgagtaggctcaagcatgcgcaccaagagacaaaatggcggtgtttaactgtaatatgaccttcctcgcggaacactccactagtaagggaaaaatgcctcaaatgagcatgtgcacaacttcagtaaacacactgtgcatacggcccctcccaagtgctggcaagccactgtgcaggcacatagcccacccaaagggaaaaatcaagggggaagagacaaaccctggggtcatgccagtgtatgaaactccaagtcaaagtccgaacagtgcactttgatgtctcgaagttgcccacctggccttcctccaagtgcacttccttctattcctgctccaaaacttttaaataaacgtcactcctgctctaaaacttgcctcagtctctaactctgctttataaccctcagatgaattctttcctttgaggagccaagaatcaagttgctgcagacctccagggattcaccactgctaacactaatatatgtagctgtttagctctattcctgatggataaatatatgctaaatagttcttattactattacataacattagcagtaatactggtgtgtagccttccttcttccccaaaccaccttatttttgcataagttggttaaatctaaattctgtagaaataattaaaagttgtggtaaaggaatgaagagaaaggaaagaaacgatgaaaagattacctaggaatccctttggaagggctaactgcttaaccattgtcttagttcattttgttctgctacaacagaatacctgagactggctaatttattcaacaggagtttgtggggtgggcagaggcagaatatgatggtttgaatattttgcattcaaacaatgagtaaaaaacattcaaaccatcatattctgcccctaaccctaccaaactcatgtctttctcacactcagaatacattcattttgtcccaatactgccaaaagtctgaactcattctagtaccaactcaaaattccaaagtccaaagtcttaacaaaatcagatatagatgagactcaggacatgattcatcctgaggcaaattcccctccagctgtgtatctgaaatcaaacaaattaactacttctaaaataaaatggtagaacaggcattgaatagacattcccttccaaaagggagaaataggcaagaaaagaaaaaggggtaactggctccaagtaagtccaaaaactgactgggaaaacagtattacatctgaaagctggagattattttttttcattccacgtcccatcatctgggcacactggggcaaaggttgaaccctcaaggccttgggcagccccacccacctctatagctttgccaggcccaagcccacgcaacagctctcccaggcccaagcccacgcaacagctctcccaggctggtgttgcatgctgttggctctgtagtttgggatttcagcagaggccctgctgctgtagatccactaagggggattctttacaatggctctgcctctgcaacaagtctttatcaggactcttgggctctccacaaagtcatttgaaatttaggtgaaggaagacatacctcctcagctcttacattctgggcacgtgcagagctagtgcccagaatgctgccaaggctcatggcttgcaccctccagagtagtgggttgagcaacacttgagcctacttgatccttggtgagggcagctgaggagcactacagcagtatgcagggagtggacaccccaagtggctctgaacagtgagctttgacgtcccatagataccccaggttttcccccaaagagctctgaaatgccttcagggtctttctcccattttcttgatgagtaatacctggcttcctttccatctctgctaatctccttataaatagtccttaggccacattcttcatattctctcctgaacatgttttttattgtttacatagccaggctgagagttttccaaatctttatgttttgcttcccttttaattataaattgtgtctttaaatcattttttgtcttctattttattatatgcatttaaagtaagccatactgcatccagaatgttttgctgcttagatatctcttctgccagatatcctcgttgattgcttttaagttctgcattctataaagtcctaggacacagacacacttcagctaagttctttgcagtttgtaagaaggatggtctttttttccagatttcaatacctgtttctcatttccgtctgagacctcatcagaatggcttttactgtccatatttcttaccagcattctgatcataaccacttaaataagaagttgtagactttccttgcacctcccctcttcttctgagccctctctagaatcaccctcagtgctccgtttatggcaatctaggctttttctagtatgctcttccagattctttcagtctctacccattatctggttccaaaaccatttcacctttccaggtatttgttgtagcagcacccagtgcctctgagaccagtgtttgtcttagtccattttgggctgctgtaacggaatacctgagactggataagtataatgaacagatatttgtttcccatagtgctagaggctgaaagtccaatatttaaatatttacctgccggcgtcttgccaggcacttcttgctgcatcatcacatggcatgaggggacagtgtgagagagaatcaagagcaggctcaacttgcacttttataatagcactcatcccacccatgagagtggagccctcatagcctaatcacctcctaaagcttccacgtcttaatattgctacagtggcaattagattttcaacatgagttttggcggggacaaacattcaaaccatagcaaacatggaccaactcttaatctttagcagtagtgtttgaagagcactaatgtagataacatggaggtaaataatggaaatttgattgcatttgcagtactaaaaatgagaaatttttgatatagagccatttcttttgggtattcagcttgtttgtgctaagttgtgtgaagctctgtaaaatgatttggagctgtcttgtaaataatgactgctgtagtcagagttcatttgtagggcaagacctgttttggtcttgactgtacttggttattaaactttgttgttatgggcagctaagcttttactgttgtatcgtttgcttgatatcaactgtgatctaatgtatatttatatattgatttttgttttcattattagaaaatactgaactgtactgcaagtcaagggctgaaaaatctcttggcctttcattttaaaacttttttttataattcctgggcaacagaaatttaattcgtgtatatatacacatatatatacacacacacacacacacacaaatacaatatatatacacatacaatatatatacacatacaatatatatacacatatatacaaatatatatatttgtagtttattgcttactgcaaattaacctaatatatgtttttagatattgttaaataagcaccgtttatacgagggtagtgttctgtttagtatacttttcaaatggaaattacctgtagaaaatatttctgaaatataatcaatttaacacagttgagttaatagagcagttgagcagaaaaagtgttatttgaggatttcttcttcattctctggtaaatttaacttgttaagagcagaaatgttggtttctctttcatagtcttcatcattacaaaaaagtaaagtctttacatttgtaatagggaattcaatctacttataacttgttggaaattaattccataatatgcttattttttaaaaacaaattccagtactttttaaaaataactgcttaagaagtaaaataattcatgtactgccaaactgctatatttctactttgcactttcagtcacttttttttaccctaattatagaattcaagaaagaaaaagaacgaaatgacttacaaaatatacagaacataatgcataatttgaatgatgtatgttaaatgtgaagattcagataacttagtcagatttacatgttctttttcatccagtagtgaattaagacaaataaaaacagaaatttacctctggaaaaccacttggattttcataataaatgctgttttccccgaatttctacagaaaaagtgtaaaatattggattaatgataagatgatcctatatttagtatttttttctcatgttttacagctcaacatgaactctgctcctacattcatgcattttcctccaaaaggcagacctaagagagctgatacttttgacctccaaagaattggatttgcagctgagcaactagcaaagtggattgctgacagaacggatgttcatgtatgtttttattcctcacagttttaataataggctggttagtttgtttttatggagcattttaataaggccacagtaatactttttaatttctctatggttgtttctccttgcatagagaaaactgttcgattactgcaaatgataagttggactattagctgaattcagatgctttttaaaatagtggttcactgatattttaaaagccattaaaaatacaggagttaagcacaaggtaatttcagaggctaaaaaacgtttaaaacgtttcagtggtagtaatcaaggaaattctaattaaaaagcaagatatataatttttaatctatcttttggtcaaacagaaaaggttaatacccaccttaaagctacgtggaaaaatgtctactcagatttactgcttttgggactataaattggtgtaaccatactaatagcatgtgtcatgtctgtatgtaatttaacttaacaattccgcttctaggaatttaacctaaggatgcaatcaaggatgatttaaatttttatccatagaaattttgaaaataatattcattttattgggaaaaattgaatataaatcaaatgtctaaaaataagaaaaagtaaatatactatggcatagccaaaaaatgatttacaagaatattttacctagaatgaagctcaagatgtaaaacatttcaaagtaggttagaaaaatagtattaattaatagtatgatctattagttttttataaagtacaaatatgagtatagattgacatagacaatttattatggaaggaaatgaacctaaatggtgatggtagttcatacttacttggagattttatgaccattttttctctattctcacaactacttttgacagtaaacaattggagccagttattttaaaagtacgttcgtgcaggcagtaatacagaagcattaatttttactataagatataaacacatttgttctgagtcaaggtggtaattgcccacatggtaccactgtcattgtaaaattatatcattggttttaatgacattttggtgactaaacttatttcctaattcttatcattttttaatgttttggcaaatattttgttatgcaatgtatcatttagttggtgcaagacattaagagtaatattgaaagggtactattgtttccttataagaaatactaaattttaatcagaacttattctaacctgtctccctagcagactttacgcatttagtcgataaacttttgttaaaaaaaaaaaaaaaaacccataaaactatatgtggaaacaatttctaaaatgttttagaaatgaaaacagtacaaataatgccaatgtataccctttatttaggttcacctattgttaacattttattccatctgctttgtgattatcattctccctgctacccccatgtctctttacctctctccacacatgcagacacatatgcacaattttttctttctgaaaaaaattagggtgaattgcattttgaaagaaataagcaaagcagttatcaacttcataggtttacatttacataatacttttatttgagctaccactacccatattacaattttgtcaagtaacctaataccctttacattgtccaccttcagtacaagatttggtctagagttagatatttcatttaattgtcatgtcttgtaagcttcttttaatccggaatatttctgtagcctgtcttttctctttaaaaacattgacactttgaagaatatagtcctttgctactttttaaatagagtgatcctcatttgatctgcctcatctttgttcatgattgacttctgctcatgcatccttgagtataatattacataggtcctgttttgttttaatcacctctataggcacgtaatgtccatctgtccttcactggtgatacgaatttcaaatatctgatcaagatgtttcccattttttcatggtataattactgatttttggtcctcctttgtaattaataagctgtctatgtggatatagtaagtagtaaaagctatactatactacagtcttcgtgttttaaaggataccgtcaaaaaagtagcacacagaatgggggaaaatatttgcaaataatttttctataagatacttacagctagtttgtctatatatatatatatacatgagtcttacaacttaaaaagagaaaacccaattcaaaatgggcaaaggatctgaatgggcatttcttcatggaaaatataaaaatagctgataagcacatgaaaagatgctcagcattgttagtcatcagggaagtgcaaagtcgttttacatagccattatgtcttaaggcatatatcttatggcagaatgaaagtagtgctagtgtcacgtatgaaaagttgggtggcatgtttctgagttctttgcgttgaaaattatgaggactagaatatgatcaaaagaaaaattttatttttctttcatttttgaaatttctattgcatttttgcagattcgggttttcagaccacccaactactctggtaccattgctttggccctgttagtgtcgcttgttggaggtttgctttatttgagaaggaacaacttggagttcatctataacaagactggttgggccatggtgtctctggtatgttaatacattgtgctttttttatttcctgttctttgtgtaataatataagttgtataatattaacaaaatgagccagatataactataatagaacttaagtctgaatgagaagtaactttttagaacttggataatttagtttgagttttctgtcaatcaaaactgtgctatcttccttcaacttttcactgcatgtactgtccctctgtacttggcacaagtgctagataaatacatgttgaatacatctagaaatatggtaagacttgatcagaattaatagctcagaataatttgcaaatggtttggaaattcagctatttctgaatttctcattcagctatttcttttctgacaactgtttcttgtgtatcttctatgtgactgatatatgttagatactggcgatataaagttaagaaatacactctgcctgtgagaaatgcattgtggggatacagagtaatcaacaaatggagtgtaaggttatgtgtgctatgacggcagtaagtaacagagtattacaggaatgcacaggagagaaacctaacctagagtaaagggaatcatgacaagcttcccagattgtgacatgagctgaattctgtagaagaaaatgaaattctaaagtcgttaaggccaagtattcaacataagtgaagcctgggatattcagagaactacagttgtgtggggctacagcagtgatggcaaggtaggaggggaaagagatgacagtagagttcagcagttcccagctcacagccaatagccgaaactcattaggattttatacacaaaacaattcagttataattgaaaataaaatctctttcacaataggaagggaaaatataaggtacttaaaaataaatctaacagaaaatgtatgaaatatttataaatagaatgttgaaattgagactagatacatatacatatatctagataaatacattatatatctgtatatcttatagataagtattgtctgtaatataataaaaatgttattatattaaagatataactacatacaatgtattatatctgtaaaacataacagattgtttacagctaattgtcagtttgtttcttttgctttcttgcagtagcccttcatccttcccattttatttttaccaaaaaattaggggtcttgatgactaagttggaagtgataggacagactgagaagcagcccaggcaagagtcaccttgaagcaatttcattttctgcagtaatacctagagcttagaaattcagacagaacctctgtggctttctagtacatagtcaaaatacaaattagatgtttggccttttaagagcaaggaagataagatttttttaaagaaagtttcttaatattgttttctcacttttgatgaatgagttaaaatggattaattaattgtactgtatttaaagttattggacactatggatgatcttaattaccttagtcattaagttcaaaagtgttttggcttttttccatgctagttttcaagttgcttaattcagtaaagctacccaggtttcctggtaaaaatgcagtactttcactgtgttgttgcaaaatcaaaacttctttggtatttaagagttaatgtcatatcaaatcttgtcactattttagtctaccaaaaattgatgtagtctcatctctgaattacattcaaataacattaacatccttacattattcttattcctcaagaagagcccagaattattgcattgtaagctagtaatagttggcattactctttactgatctcttttttctttggggtatgcttcataactgtgcaaaggaatttatattgtcctcatttataaacaaggaaacaaagattcagtaatctcaacttgtagaagcttacaaagctagaatgtgattgaactgagatttgatctcattgatctgattgcaagttctgtattgtttacacaaagctgggcttctttaaatctggacatgtgtcttatatgttggtgattcaacccagtagatacagtgagcccttatgactacaaataaattcatagaagaactttatatgatgtatagatgttaaatacttcagttgatcagttttcttgaaaacctctgctatgttatacagatttattattattattattattattattattattattattattattttgctcttttactgtgaatcttggaaagcgaattaacttggcatggcagaagataaattctaagataccttggcaggtatgcctgctccccaatcacagccttttagaagtcaataaaaggctgcagagaacagacatgttttcaaacagtgagtttgaaaacactacactgataatataatgttaaattcaacaacgtttgtaatacttttctgcatctcttgcagtttttctcattaatacagagatacttatgtttgatggcctttggcaactccttaaatcatttaaaaaatgagattaaatatataatatataatttacattatatgttttatgtaaataatttgtatatataatttatgttacacatatgtatatataaatatataaattgggtcttctttatcatttctgcctgataccaccaccattaccatcaccaccaaacttgattgttgcttataaattgaaaaactgaatttgttcatatgtaatttttcgtatcctacttttgagatttccttagaaagttaagagactgtccaaaatgctgacctattcattcagattctcaaacatttgtctgtttaaaataactaatatctcatttttccttggaagtaaggaaaaaaatgtatatttttaaatttgccaaaatattgtcatctgacttacacaaactctgatgaaagcctttgactggacagtaaaaggaaagctcttaaaataaaacagtaatgaaccttgtaagagtagacaacttccatagaacaaaaaaatgtatacaaagggaggaaaatgaatgagagaaatgtctggtacagaatctctggccccatgctgactttttagtaaaggacaagtctaggtacaattagcagttgtgtctttttatcactgaacctatacaaaagtacttccaaggagaattatttagtgttgtgaacacttagtcctgggtagactgtattttaaggctcatattttttttgtcttttttttactgtgttattttattgtatatgacttaaaggtagggtaagagaagtgtatgctgagggagtggaagttatatgttttagggtgtaggatggagatagaaaggttgcaatttcctgacataggaaattagtatatgtaaatattaatatgtggaagtaatatatgcaaatatattactttgcaatatatttaaacagtgagattaaatttgcagtatattgcaatatattgcaaagtaatatatgtaaatattaaaacatacatatacgttagaatttcctggttcttagttttaaaaaagagctaaagatattcataagtaaatcttcctggtctcatgctttctaagggggaaaaatttttgttaactactatttatagatactgatgattgttcatggaatagaatatgtatcattgattggttctggttctggtttcactcccttctgtcttccctcaccccctaaacacggaggatggtggacaataagcatatacattacttgctttatgatgaatttaaagtagaatgatggagtaaaatattgaaatacactagtacataatttcaaaaagtgtagcatagatacgtagtttatggtcttgagaaaacaatattgacttggaaccaaaatgagttaaaattgtatgttttgtagcacataatgaagatcttcatggcaacctaaaggtcctcataggtgactgtcatttcaagccagaaaatattagtaggataagcaataacattcatttcaaatacaggaaaatatcctaaggatatgcacttaaaagcatgaaagataaagcatcattaaaataatgtaataacccaaccttattatcacagtaaatcaccgtaggatagaagctgttttctgccttttaatactgtgtattgtaggatgattcatacaccttcatgtttcttttgccccaaataaattatgtcattttaattaaattttttgaaaatcttcaacattggagattagtatatgtcattatacagtatttacattcatgaaaggtactttggcatgtacacattgtgatttatcagtagaaatttatttcttgtgaccattcaaagttacagatggctttgagttcaaatgggggtagaaaagggtcttttttcatccacatttatttgaataaaattatataacttttagtatatacatataatctttatttttttctctttaaaaatgagaagcaagtaatttctgataatatttttttcaatgaaataatgttgtttttggatggccccagacagttctgctcatcaggcaactatgtcatttggccatttggagttagttatggtttttgcaaacaggtatttctatgtatagccatttgtgtaaagagttaggaaaacagaaaataaaatgaattcgtatatttttaggatatacttaatatatctaattcttaattttctgtagtaggagtaagcagtggcctcaaaaactcaaagtacattttaaaactactcatatatggatagattttagcatttgaatgttcttggctgagtttttgcttatcttattataaagtcacaattgaataagactcactgtgaagttccatacatggatctactacacttcatgcacggctcatctccttaatccaactcaatagtggttataaatacttgttgaaattgttatcctcaatgcataatttcctttccatggaattaaagacttagtcttaagctttttgttgttgctgttgctgaaatgactgtaaagatacgtcttacctttccttttttttgtaactaaagcagtatatagattgagtataaatgaaagaaataatgatagtatttctgtataacactgaaaccaagttttaaaaaatgaacaataaataattcacttgtgaatagtagaaatgcagtgtataaattcactgatatgcatgtctgctgttactctgctgatttataccacctgtttattaagtaatgtcattaaattacttataacttgaaaacatttttatattttaaaaacatggaatatacaaaggattgtataaaatgtgtatagaatattacatattttctgcatagttagcattaaaattttcactttcactagcagcttattttcatattcagctgattaagataccttcaaattaactcgtggtcttaattaaattttgttttcaaagctgtatcaactgcatagtggaaatctatgaaataattatgaacccaaagtgttgaaagcatgtaatagttatttttctttttttaaatacaatgtgaaatgttttccccaaaccaaatcgcttatgaaagttcgttgtatagaatagttaaaagcaaagttgctgtagttacagtgggcgtgaacatcttgaccctttggaaaactataggatctgagcagtttgttttgaaaaacaaggaaaatagacggttaaaggaggatgccttgagccaatggtgttctcagctcaccacagggctatggcaacctctagatgtgagaaagataacatgtggttatgttcagttgtgtttattgaatgcttgcctgctatataaatgctgaaagtaagtgttctcccactgcagtgaggtggaaggattggtatctgttttgtacatgtagccacagcatttagaattgtgcctggcatgtagaaagtgtttagtaaatatttgttgagtgagtgaaagttacatgaataaataggtttaaggacattttaagacatggttgttttttttcactgttacttatagcattgtaggtcatggctgggactagtacattttttttctagaaatcttaacttacatattcacatattgatcagtcttagaatagtgattctttgtttcagtgcatttaccttttctatgtttgttcatgtttattcatttgttgaccattcaacaagagtttgaaagctacgtgtatcaaaatctatgaagaaccatgtggagatacaaagataagacaagtgaaaaagactagcacgtgagccctgcccacagggaccttacatgtgtagtgaggaaggtaaatcagatatgtatatcagtaacatacaaatgctttgatgaacatatgtccaaaatcttggtgtcccaagatggtattatttgtgactctcaaagaaaacacaaatgtccaaaacaaaatacttccaaaaggactagctttgagggtgttctttgaattaactgcaacaaatatctgagtagctgttttattcttactcttttcaggattattgtctagtgtcacttttgtcctgaagccagagttcaaaaagaaccatttatgatgctgtatgaaactttagatacctgagtgtctggttctctggagaaacaaaaaaataagcagagtttttggttagaaacttcacaagtctcgagtctcgggatgtatgctggtggtaaatggataagtttcccaagtggaaagcttctaaaaagcagagtagagtattttgcaatcttgtgaattagaagttacaatttgggacccactggactcttattggaaaaccttcagtggttgagatcaaatgtagacagagctttgccagggccatatccagccatggctcagtacattccccaattagattagggtgataacacatcactattaaggttgacaatatcaaggaagttgaacaactttaaaccagcaaacaaaaccaacacaagaagaatgagaaagtcttcatactccagtatggattgaatccattgctgaaacaattgaatccaacattgctaaaactttcattccatgatgactaactcttctaaacaattgagacggaataatactcaccttaggtaaacttttctgtgaataaaaaaagaggaagtgcctctattgtctgaagcaagactaactttgattctaaaatctgacggggacatttaaaaatagaaaactgataggccagtctttctcatggatatagatgcatttattctaaacaaaaaaattacagacagtaataaataaaaatggtaatacattgtcaagttatttcactaatacaagaatggtttaccatgtgaaaattatcagtgtaattctctgtgctaataaacaaaaaaatatgatcatctttgatacatgcatatcagcacttaataggttcagtgtttatgtgggaataagagaaaaaacaaaatagaagggaatttccttaatctgattaaaaaacatacagtaaacatcatatttggcaacttcctaaaattcctgagataaggaataatacaagatgcctgctcttgagtattttactgggaccctgagcattgcattaagaccaaaacaaaaaacccacacacatcccggtaaaaataaaattgccctccttagcagatgatttgattttgtacatagaaaaaaaaattagacctaattcgtaaattgggtaaggttaatgaatacatagtaaataatgatgattcatgtcataatgcatcataaaaaaaggaagttttaaaaaaatctattgtcatagcatcacaaaaagttttgaatcaatctaataaaagatatgcacactgaaaactgaaaaatctattcaaataaattttttaaaaacttaaatggcaggtaaacctgataatggattggtagactcaacgttgtaaagatactcgtcttgatcttgagtagaatttgtgcagatttttttctgtggaaattgacaatgagattttagcagagggtaatgaatagaatagttgagacaatatgaaggaagaataatgctggagaacttacacttacagatatcaacatttattatagatctttaatatttattcatttcacataaagccatctggaacagaatctatagtccagaaacatactcacacttataaaatcacttgatttgtaacgaaagtggccttgcagtgcagtgagtaagtatggcatttttgataaatattgccgagccaactggatatccatatgggaaaaagatgaatttcaacttttacctcccaccatacacaagaggaatcgtgaatctaaaagtaaaatgcgaacattagcacttttagaagaaagcatggatatgtatctccataattggtgggtgggcaaagatttcttaaaacagaacataagaagtggtaaccataatagaagaaataattgataaactgaactacattaaaattaagaacttctgtttgtcaaaaacaccattaataaaatgaaaagaaagacaagcctcatgtttggtgaggactatttgccatgtgtatatttaacaaagaactggtacccagaaatataaagaatcttgacaaaacaagaataagacagtgaaattttaaaagaggtaaatgacttgctgggtacttcacaaaaatgtccaaatttcaattaatatatgaaaaggtattcaaccttattaatcagggaaatgcaaataaaatgacagtgtgacactatcatacctctgccagaagatccagaatgaacacacagaggctcacagctaataccaataattggtaaagatggatatcaagtggatctctcgtgtactgttatttggaatataaattttgttcaacctcctgagaaatgtgtttggttttatctgctaaagctgagtatttacatactctgtgatacagaattttcaagaaaatgtttcttaccttgggcaggttatgtagattatgattaggaagagacacaagagagctcctgtctttctgttagtgtgttttgtgaaaattaatctagctgtaactatgaatcatgcccttttttgtatgaatatagttaaataaaaatattttagtcaaattgattgcaaaattaaaacttccagattgctgaaagtaatgaaatggtgacatatcagttgttaacaaccaaaaaaggatgcatcagttatgagaattttgataaactgaaacctaggctattttgcattttagaagtgcatgttactcagtgttttgttgtttcttatgaaaagtgccagcgctatgtgagtaaatacatttgccactacttcagatgattctgtgtattattccaggtttgaacctggttttgttttattaaaccatttcctggaatcttgattaattatgtattaagatgattttttaaactggtgacataccgtaaatagtattgttgctgctattgcctcttttcctccatgtagaatgtaagcttcctaatgacagttttctgtctcatgtttttgttcatcgctttatcctcagcttctaaattagttcttaaatatatagtaagctcttggtgaataaaccttgtatgaataaatgatacttttttttatgtcaggggacatgtcacttattcaggatttctagctgaggatggcaagcctctttatcttattcattcttacatctctagagtccagtaacatacctgttatacaatagtgcctccagtaagtaattgtcaaatgagtaaaataaactggaaaggttccatggagaaccatttatgggccatgagttaaccctgttttagagattgactgggttgacatagcatgaacaagatgtggatgcaggcattaccatcatggatgcagggggaagcaagaagagtggcctgaatggagcatgcagtgccagttaaggagcggtaggacatggagctatttaaggagtatgggagcaaattgtggggggatttggaataataatatttattgagcttgtgtattgtgtgcaatttttaaatgctctacatggattaacctacttaaaacccctgcggtttagaaagattgataccaatattatcctcatgctatagacaggaaactgaggcccaaagcaatggacttgctcaatgtttaaatgctctacatggattaacctacttaaaacccttgcagtttagaaagattgctaccaatattatcctcatgctatagataggaaactgaggcccaaagcaatggacttgctcaaggttgcacaggtgctgaagatacatctgcaactcgagtattataatttataagcctccattcccaagtattatgataaaattctaggcaaggtactttaaacataccagtggtaggtcttaagagcacagaaggttcttgggtagatactcctgtttgtgaatatcttagttggttacatatttttatagccaaaaaaagtgagacttcttagattctctctaatttctgggtttagatatcgttttttatttgccccatcttcttcccttttgtatccttgttttctcctttaaaaaattgtgcaaactagaatatttagactcccagtcgtgcattgctcgttcttgtctttggtgtttttggtgtttttattgttatttttggtacaaatgcctatcagagccaggaagctgaagtaaggagtgattgggcaagttataggatagcaggaagtacaggtactgttttaacctagagaacacatttagtctaaaggagtcccagttcattaactttaaaatattttgtgatttaaacaaaacatgctgacacctcagttatactgattgaactgtgacttctggtttatgcattctctccccaccctctctgcaataccttggatcttcaatattagttttccaactacagctttgtctgatatattcagcaggtatataatctttgcgagttattcctggctatgtctttttgtgatttcttccatctctaaacatcttctgaatttactgtgtcgtaaactttgctgaaagtatttaggtacttacggagatttaagtaccgtaatccaagaatgtagggttttggttatccaaactaatagaagaatgatgtttagaggatatagaagatgattatcatgtcctttaaaatatcactagaacatcaagtgtctcatctgtgcttctgactggctcaggtgagcacatagtatcagattgcctgtcaccaggccagatgctttacatatgttatccgatgtaattattaacatatttctttaacagagctggcataccaattttatagatacggaatctgagatgcagggagaataagtaacttactcaaagtcccatagttaataagtgaaattttttaaaatgtgtgagctgatacatgatttttaaaagatactttcatgatgaccattgtcttttagaaatgcattattctggtattctctggtttacatattgaaacactgcaccctgtttttcagtgtatagtctttgctatgacttctggccagatgtggaaccatatccgtggacctccatatgctcataagaacccacacaatggacaagtggtaagtgtaatttataagcatgaatattctgaagtttaatccagcttaatttaggaataagaaattatgtttagtatttagtaggaaaagattctgtttgtcagtcaaaatatatattctttctcatttactacctgtgtcacctatatacacatgtgcatacacacacacacacaatattacttttgttaggatgagggctgctttagtgttgatttaaaaaattaatatctaccatatcaaatatacatgcattcactattttttcaagtttatctgctgctatggcgataacatgtaaccccactagaggaaatcggaatagtttatagccaatgtccctcccatccatggtaaatttaattttcttcagaagggattaagacattattaagaacccgggtggtcattgtattagaatgttaggaactctttgccacagaattaaaagtgaaattgatatgttgttacattagtagcagagtttacgttagtaactgccaccgaattcacataactgagtttgttgccttctctttacgtttggtgaataggaaatactgtgataaatcaacatagaaacatactgtctttgagacagtattaggatagtgaagatgaacagtttttcgttttttctctaaccttttctgctttttcttttggaaaagatacgtattttgagaataatataatggcatggcttcttgtacccatcactagactttttcagctctcatctcataactattcttgtttcatctttctttctgtccacctgctaataataaaataattattattactatataataatcaatttgggcccatatttttgggaacattttcagatttctgtagtggaagacaaggatatggagttaaagctagcctctttgaataattggttgccataataagttagacatagtttttgctatatttatatgtttttaaaatctggcattatttagaagagtaatttcagaaagtcttcaatattcaaaattcagttatacaaagaaaaataattggaagcaattttagagcaataaattattcccttacctttaatttttcacacaaatgctggcttcccaacaagatccttcctgacgacactatttaaagttagccctttcctctcttcctcctccctggtccctatactctgtctccctctcctgttttattttttctccacagtacttgtcaccttacagtatgctacataatttatcgaatgtgttattttgtccgtttgccttttgccatgaccctagtaatagataagcttctgaaagaatggattttatcaggttttgtcactgatacatttctgttacataaagaagggcctgatgcaaagatctgatcgctgtcgtgttaatgacacttaacgttgtaaatttaggaaatcttataaatttttgttactgccttttagtattcttctaagagtattctttaggtataaaacatattaaggcattgcttttcattattgtttatggtttgttaaagtatacgaaaagttattcaacattcttatgaaatgttttaacatattgtattctttttttttgggagggtttcagacttttttttttctttggttgttagaacttttattttaggttaggggatacctgtgcaggttagttacattggtacattgcataatactaaggattggggtatgaatgatcttgtcaccgaagtactgagtatagtaccaaataggtagtttttcagccccttcctcctctaccctctaataggctgcagtgtctgctcccatctttgtgtccatgtttatccaatgtttagctcctacttataagaacgtgcagtacttgattttctttttctgttaatttgcttaggataatggcctccagctgcatccatattgctgcaaaggacatgagttcattcttttttatggctgtatagtattccctgttgtatatgtaccacattttctttatccacactgtggatggacacctcagttgcttccatatctttggtattgagaataatgctgcaatgaacatacaagtgtatgtgtcttttttgtagaacaatttattttcctttgggtatataccagcaatggatcgctgggtcgaacggtagttctatcttaagttctttgagacatctccatgttgttttccattataattgtactaatttacattcccaccagcagtgtatgtgttccgttttctacacagccttgccagcatctattatgttttgacttttaaaaaacagccattctgactggtgtgaaatgatatctcattgtgattttaatttgcatttctctgatgattagaaattaaatgtatgtaattaaattattagaaattaaatgtatgatgtgtggagcatctttgcatatatttgttgcccgcttatctgtcttcttttcagaagtgtctgttcatgtctttgcctgctttttaatggggttatttattttctgattgttgatttaagttgcttatagattctggatattagacctttgtcaggtacatagtttgtaaatgttttctcctattctgtagggtgtctttttagtctgttgatagtttcttttgctgtgccaaagccttttagtttaattaggtcccacttgactattttttattttgtttagattgcttttgaggtcttatccataaatgctttgccaaggccagtgtccagaatggtatttcctgggttgttccaggggacattttccagcggacatttggtagtgtctggatacattttagattgtctcaactttcagggcaactaccgactactggcagttagtggtagaggccaggaatgctgctaaacacctaaaatacaaaggacagcctcctatacccaattaagaaaatcatccagctccaaatatcagagtattgaaagtgagaagcctagagaaacttagatgtaattttgacttcctgcatattttgcagctaagaaaactaatccatctagcatataaccccaaagaaggattttctttttctgcaaaaaggagaaaatttgaaaaactgaaatagctagagcttaggatcatggtgacctacatttaatgtttaggatggttgtatatattgaaagtcatcagtaaatatgattggtttgtaaatgtttatttttttaattttttaaaattttattttatagagttagggtctcactctgtcaccttggtgcagtggtacgatcatagctcaccgcagccttgaactcctggctcaagtgatcctcctgcctcagtgccctaagtacctcggacactgtgcctggcctttgtttttccccaagaaatagggtctcactgtgttgtccagggtggtcttgaactcctggactcaagcagctctcctgcattggcctccctgagttctcggattacaggcctgagccactgtgcccatctgtaaatgggttttcttttactatgcgttagtaaatatgatttaatctgtgacattttatatgcttacaaagagattttgataagagaaagtaaagactctggctcacagagacatttttatgcctttgtcctgaagtgtgcaggcaaagagaaacagaaagaaaacagagcagggttcttttccaaactctgactcttaccaggtctgtcttttttggggaagttacttattctctctgttcttcttctgtaaaatgagttgaattctgcttttcttagtttgtagtttttggtagataaaatctgataataaatacagggctgagaatggctctgtccatgcccatatcagcacaaaactggtagatagcagtgccataaggcaaagagggaaggtggtgtcagacagagccaggttctatgacacatagctaccagggccaagccagcagtaggcttagtgcaggggcaggaaaggtggggagtagtaagataggcagatgctggaggcactaagaagggtgccatgggtgggaggaacagaaagagaaagacagagacatccactggttggagaggcctcgtctgcataagcacttttaaaagttgaaaacacacgtgtcttattttgaagtcctttcagaacagatccaaagacagtgatttaagtgaaagaagttcatattggaggttaaggaaacatgggagaagagagggaaactgagtctaggaaggaaagcagtcaaaaaacatgtttatccagtcagtattgtgagccactgaaccttatttctgctatgagatctctgggagcctgtgtagggcatgtatgtcaactttcctactacagtggtaagggagctgaggtatatatacgccagatctcatcagccatttgctgagtgctgttctcttggcaaagttattacttctccagcactggtggactttgtctgtcaaagaaagccatctagtcaaagaaatgcaggtgctggtggtggaagtcaggctggaacacactaaggcattaagggcaaagaaatatgggtagtatactactcatagactgtatttactacaatttatatcagtttatttttttttagtagattccaaaggagaggaaaaaaataatgaaaaaaccacattgggtattggttttatttcgagatatgccctggaaaaaaagcaacaaataaaagtctcatcaattaaatatagttttatttttaagccaatatcatatgtcttgtaaacaatccttcagaataaagtagaaaaatgtacgcatatttaagaacatctatctctataggaaattttgtctttatttcacattttaacaagtctttttaaaaattttaaattgatggagtacatgtgcaggttgttacaagagtatattgtgtgatgctgaggactgggcattactgaggccatcacacagataggaattttttcagcttttggcctccttccctcactccctctttttggagtccgtagcatctgttgttctaatgtatatgttcgtatgcacccaaggtttagctcccacttgtgagaacataaaatatttggttttctgtttctgtgtgaatttgcacctctagctgcattcatgttgatttggaggacatgattttattgtgctgcatagtattccttggtgtatatgtaccgtattttctttatttaattcaccgtggatgagcacctaggttgatttaatgtctttgctattgtgaataacgctacagtgaacatacaagtacatgtgtctttttggtagaactgtttattttcttttatgtatatacccagtaacgagattgctaggtagaatggcagttctaattttagttccttgaaaaatctccaaagtactttccacagtggctgaactaatttacattcccagcagtggtgtataagcattcccttttctccacagccttggaagcatcttttttttttgacttttctgtaatagccgttctgacttgtgggaaatggtgtctcattgtagttttgattggcgtttctctgatgattagtgttgatgagcattttttcatgtttattgaccacttgcatgttttcttttgacacgtatcagttcatatcctttgcccactttttaatggggttattttttgcttaagttttttaagttccttatagattctggatattagtcctttatcagatacatagtttgtattttctcctgttgtgtaggttgtcaatttactcaattgatagttccttttgctgtgtagaagctcttcagtataattaggttccacttgtcaatttttgttttatttgcagttgcttttgaagacttagtcataaaatgtttgcctatgccagtgtccaaaaggatatttcttaggttttcatctagggtttttatagttttaggtatttttaagtctttaatccatcttgagttaattttgtatatatggaaagctagggatcgagtttcattcttttgcatatggctagccagttactccagcaccatttattgaataggtgtttattccccattgtttgtgtagactttgtcaaagatcaggtggttgtagatgtgtaactttacttctgggtcgtctattgtgttccattggtctgcatgtctatttttgtaccaataccatgctgttttggttactgttgctttgtagtatagtttgatgttgggtaatatccctccagctttgttatttttgcttaggattaccttggctatttgttctctgtttgggttccacatgaattttagaatagcttttttttttctagttctgtgaaaaatcatgataaattgagaggaatagtactgaacccgtagattgctttgggcagaatggcgattttaatgatagtgagccttccaatccatgagcatgggttggttttccatttatttgtgtcatctatgatttatttcagcagtgttttgtagttgtccttatagagatctttcacctctttggttacatgtgtgcctaggtaatttgtgtgtgtatgtgtgtgtgtatgtttgtggcagttgtgaataagaatgtgttcttgatttggttcttgacttgaacgttattggtgttttagaaatgctactaattttcatagattgattcctgaaactttactgaaatcgtttataaagccttttggtagagtatttagggttttctagatacagaatcatatagtctgcaaagagagatactttgacttattcttttcctatttggatgtcttctgtttctttttcttgccttgttgctctcatgaagacttccagtactatgctgaatagtagtagagagtggacatccttgtcttgttccagttctcagggagaatggttccagcttttgcctcctgttgagtatgatgttgcctgtgggtttgtcatagatgactcttactattttgaagtatattcctttgatgtgtttgaggatttttatcatgaacagatgctggacattattgaaagctttttctgtgcctattgtgatgatatggttttgtttttaattatgtttatgtggtgtattacatttattgatttgtgtatgttgaaccaacttggcatcccagaaatgaaacctccttgattatagtgaattaaacctttgaatgtgctgttggattcaatttgctataataatattttgttgaggatttttacatctatgttccttagtgatattggtgtgtaaatttttgttgttgtgtctttgccaggttttgatatcggtgctgctggctacatagaacgtgttagggaggattccttcatccttgatttttttttttttttggaatagtttcagtaaaattgatgtcagctcttctttattatccatcttgaattcatctgaggattccgtcctcctttttttttggaatagtttcagtaggattggtaccagttcttctttatatattttatggaattcatctgaatacatctggtccagggctttttttggttagtaggttttttattactgattcaatttcagaagtcagtatttgtctgttcagggtttcagtttcttcctgattcagtcttggaagagtgtatgtttccaggaattcatccatttactctagattttctagtttttgtgcaacaaggtattaatatagtgccgagtatcttttttatttctgtggcatcagttgtaatgtcacctttgtcatttccgattgtgcttatttggatcttttctctttttttttttctttattagccagtagtctttcgatcttgtttatcctttcaaagaaccaacttttggtttcattgattctttatatggatttctgggcttcaatttcattcaattatgctctgattttagttatttatttttgtctgctaccttttgggctagttttttcttgtttttctgatttctctagctttgatgttagactgttgagatttttgtcttcttgatctaggtatttaacactataaacatttctcttaatattgcttttactgtatcccaaagattttggtatgttgtatctttgctgtcatttgattcaaagaattttttgttttctgtcttaatttgctatttacccaaaaatcattcaggagcaagttgtttagttactatgtaattttgtgtttttgagatttcctcttgatattaatttctatttttattccactgtgatctgagaatatgcttggtatgattttgattgttttgaatttattaagatttactttgtgaccaaggatgtgattgatcttcgagtatgtttcatgttcagatgagaagaatgtttattctgcagttgttgtgtggagtattctgtagatgtcagttaggtccattgcattgaatttaagttcagaatttctttgttaattttctgcctcagttatctgtctaatgctgtgagtggggtctcgacattccccactattattgtgtgcctgtccaagtctttttgtaagtctagaatttttttatgaatgttttatgaatctgggtgctctaattttggattcatatatatttaagatacttaagtcttctggatgaatcgaactctttatcattatgtaattaccttctttgtccttttttaactgttgtcgttttaaagtcacttttatctcgtgtaagtacaacctctgctctgtttggtttttcatttgagtgttagatcgttttccattactttgagcctgtgagtattgttacatgtgaaatggatctattggagacggaacatattttaatgcagttttcccctgtgtgtctattaagtggagcatttagactgtttacattcaacgttaatattgatatgtgaagttttcttcctatcgtggtggtgttagctgggttaacttttattcttgattgtgtacttgctttatagagtctctgggccatgtgcttatgtgtgtttctgtggtggcagctgttgttcttttgtttccatgtctagaactttctttttttttttttgtagctgttgtaaggccagtcttgtggtaatgaattctcttagtgattgattctctgggaaaggcgttattttttcacttaccagcttagtttggcatgagatgcaattcttggttggaattttgtttcttgaagaattctaaaagcaggccccattctcttctggcttgtatgttttctgataggaagtactatgttagcctgatgaggttcccttcagaggtgatatgacccttttctctagctgcctttaagattttttcttttgcgttgaccttggaaaggctgatgactatttgccttggggatggtcaacttgggtagtttcttgcagggaatctctgcatttcttgtatttgcactttcatttctctagcgagattgggaaaatatttgtgggttatatcctcaaatatgttttccatgttttctgctttctcttaagaacgcacaatgaatcatagatttggttgttttacacaatctcttatttctcagaggctttgttcatttcttaaaattattttttctttatttttatctgactgggttgatttgaaggagtgatgttcaggctctgaaattgtttcttctgcttgatctagtctattgttaagacttccaactgtaatttgaaattcctatggtggatttctcaattccagaagtttagtttgtttctttcttactatatctttgttgtatttcaaattttggattgcttttctgacttccttggattggagttcagcttcctcttgtatctcattgagcttctttgccgtccaggttctgaatttatatctttaatttcagacatttcatcctggttaggatcgattgttagggagctagtgcaatcctttggatattacaaaacactgactttttcaattcttgtacttcctgcactgattccttctcagaaggaactggtgcttctttttctttttgaatttgctgttgttttgttggggctttttatttttatgttcttttttccttgaaggtttgactatggtatatggtgtgtatagtcagctggcttcgtttctgagtactttcatatggccaagactttgtatggtttctttggttgtaaataggttcctgtggtgggtttcacaggctctgagtgctgaagcaatgtggttttgtttggtggtgtaattcagagtgcagtccaccagctgacacttaagagataagggcctgaaaataggatcttagtcgtgctctccactttagtatttcactgcattcaccgtagtgctctggggagggaaggcgggggccatatatgactgcctctctggtttctgagatttggtggtaacccattcaactactggtgcctttccaatgtttaccttgccccaggggtgggtggggggcaggctctaatgggctgtgcttctgcctcccatagagcagtccaagagagtcacaactccttgggaacccactgttcctctgtatttgccagagtcagagtgagttgtggagtgtgttcactggtggtctggtgatgcagtagaggaagggcagaggatcctgaccagggcagtggcaccgtgtgtacaactggtatattttcagcctggcagcccaagaggcttgagttctcctgacctggtgggtctcccgccagtgtctgcaccaggagcaggcccaaccggctaagcttgtcgtaagccttctgcacctagatcactgttctaggcatttgatgccttgggactccctggggaagaagctgcagctggctgtcaggctgcgttcctcccggactggtcttatgaaaggagggatgcccagctctgatgtcagcacatgagcccatgccacagtcttctctgtgttctgagattgagggctgcttccccactcaagctaaggccacagatctgcagcttggtatccctgggtggtgtggtcaagtcctggggagttgggaccagatccaggggtttgttctctagcccctggatgtaaagcagcagctgtgctgcaggagagcagactgctcctagacctccagcaaaacactcagatggggcaatggaggctgtgctgtgggcacacttctgcaagatcgttcaggcaggcaggcttaggaggggccacggggttacatggatcagatgcaccccagtcctgtggcaatggtggccctgctctcttgcagcctagcagacagcagtagctacagccactcagtacagcatggcacacctcggggcgtgaacacctttggtcacattttgctggagctgcactgcgtagtgaaacatttgggggtgcatgcaagtttgagctgtgcttctgcctattctctgagtggcttccctgccggttcagaggtctttgggggtcttgggaaacctgtagctgggatcccagaggtatgtggtgggagtgtgctgccgaaattccttcactcaccgcttcctcaggtctggttcagtacaggaggccggtcctagtgcccagcgactctgagtggcttcctggcttcctccctctttaatcacagtgtccatctcttctctattgacttgatgctttctcacaaaatctttattcagagtgtgatggtttatttgatattttggttcctcttggtggacagttcccggctgtttctagacatcttgaagattttaaaaattcttaaacagttggatagataatttgttcccttaacagaaagtttattattgatgctctgtcaacagggcctgtgttttgaattgtatttttcaaaagtggtattcactgcagtcctctgggctatttatttctactacacattgaccttaacatcaacagtgtacacttgggggaaacactgtttagaatggcgcatagtttgtggcagtcaacagaatcaatatataacagacctatatgagctctgaaattctgattctatctttaatagcttaattttccaactgcattgagcaaattgggcctgacaagcttagtaaaagacaggagtattttgttgggtattcatttagttcttaggtttttttttttttgaaaaattagtggtatttgtaaggctagtgactctgctcatattaattgtgaaatcaaacatgtctaggaaaacctgaagatattgacaaagtgtttcttcattgagcttaaatgtaaatgaatacagagaatataaagaaaattaatagtgcaggcagtgtgatgcggtgctgctttgcaagtttatttgtttgtcactattaagatactatgtaatggcacaagtcaagtactaatggtccacttaacagcatgaaaatcaacacaaaagcagtcattattgtgtagctaaagggaaactatacaaacatatggttacataggacataaaaacaatttttgttgttaaaaaagcaataatctttaacaatatgcatttaatgaaataaagcttatgcgtaggctgtaactcccaccgtgaacaaatgcgttattttcaagatttggattttagctactgcttgaggattgctatgggtttgccagatatagtccaaaaattttcactgcattacaattcagttgtgagtaaaactaagcgttatattctgcatgcacatgcagaacattttattgcaaaatgacctgctgatttagtctaaaatttatcatcgaggcattttttttttctatttcttaggcagccataccatattgtactttatccaactttcttcactttcatgcctcagggattttgcacatgctaggtctttgagagtcattaaggatgctatcatcccattttttaaaaaacttaaaaatcatatagactgatttagattaaatataattattatattttcaacagaaatatttacaaagggcattcagtagctttattacagtcttcataccaccagcaaagagaatgttaacattatcctgaaatttttaaacaaaaaaacccagctggccgggcgtggtggctcaagcctgtaatcccagcactttaggaggccgagtttggcggatcacaaggtcaggagatcgagaccatcctggctaacacagtgaaaccccgtctctactaaaaatacaaaaaattagccgggcatggtggcaggcgcctgtagtccggtcccagctactcgggaggctgaggcaggagaatggcctgaacccgggaggcggagcttgcagtgagccgagatcgtgccactgcactgcagcctgggtgacagagcaagactccgtctcaaaaaaaacaaaaaacaaaaaaatggtaagacaagagtaattgacatacattaaggatatacagaaatcttgatgttagtatttggaattgagattcttccctcttatttatttatgcctttatttttccatctgattaacatatttgttaggtactctgtttccagtagtagtacagatacatcatgcagctcatcatctagtggggatacataatatgatatcggttagcctcaagtctcagtcttcagagcctcgcttcttattgagttacatgatatttgaggctgcaattgttttagaattttgcctcagcaccatggtcattttatggctgtgacactgcatctgatgtctttcaaactctgccttaatctttatattcctttttattttttcatatttgtgtctgtctagttagctttggtagaactccatcttcagcatctgttgttgccgctcattccttctttccacctggttttaatttttagtgtcaccatttaaactacatgcattcttgatcctaacgtctgactgaatcttgattgccagcccagactgctcttacacttcccttcaactgttgctgcctatctatgatcctgccaattaattacaacgaagaaccttgtgatttgtacccttacttcatgacaaagcacttcacacgtggcagatactaaataaatgatactgcatagataaataaatctttctttgcaaataggaactcagattgtatctttagcctttcaaaatgttaagtatatcagaaaaaaattgttttccctgctaacatttgtttgtaattaaaaccacatgcacagagggattatggaactgcataatgagaatgtgttttaatatgtcaaacttcatctaatacagttaattattctctgagtatcaagaagaaatattacatcagaggagaaaggataagaacaaaaagagaagaatcagtcctcccacagagaaagggataaactacctgttaactttttcatattctttaatttttttcctattaggaaaattgtgtagtacattggaaagagtcctgtggtcttaaaaaaaccaaagatattattttcatcgtatcaataaagttgagtacaattatattaaagatactcataattatatacattcaggattgaaaaaagcgtttctcatttataactctacaatttcagaataagatgtacatttcagtaactcagaaaaattgttttcaatgcatgtttatcaagcatcattaggttttgactccacataatgctagtctctgactttagtaagtttttcgtaaccttacataaaataaacattcaaaaactaacacttcagtattctttttttttttttttttaacttttaggttcaagggtacttgtgcagatctgttatatagttaaattgtgtgtcacaggggtttgatgtacagattatttcattgcccaggtaatcagcatagtacccgatgggtagttttatgatcctcaccctcaagtataccctagtatctgttgtttctgtctttggtcttttgtttttgtttgaaatagaaatttattctcagaataacgcacaaaagcacacgttgaggctgctgttaggagatttccctcccttccatttcctccttctcctctcctctctgtatgccagggaggacacagttgaaggaaacgtgcaatcacaaacaatgatcagctctaaacacaaaaaagtttggtccaaaagaactcagcgtaattaatccagttactttgtagaatttcactaggtaggattaagatactgcagatgtagtgtttccaggagcggtttgtcagtgcaccaggggtcgcctgcttgagggagttgaggactgagtgcatacaggagacctctttgccctgcttgctgacttggggttacagtcaaacaaccgggccacctgttaccacccagtgcagggggatgactcgtcaatgtcatttacaaaatcttctgccctgtagtttgcctttcttttctgtagctgctcgtcttgtcttgcacgccattcttctagctcatttatcgctttttctttccactctgcttcttgcttcggagaataagcagcaagggctgctaagcattccattttctcttctttgcatctgcatatattttcaggctggatgggaatcgatccacttgtgaaatagctgcataattgtctcttggaccattactttcctggtagtagtcaccatcatcactccgtcaacagcatctggactcccagctgttcaccttgtggctggggcctgggggtgacaccatccaggatgtcgaaggcgaccttgttgttcttgatacccatagtcttgctctcttgcagtgccaagaaggccgcagctgggtcttcttcactggcgccagccactccgttccccaggacaggatccccaggggtgccagcagggacaccgaagggatgttgctcagccatgtcgtgcaatttaacgacacagacaccaacccaccaacaccatgcctggcaatcgtggctgtggtagtgtctgggagatgttgttcctttctttgtgtctatatgtactcagtgtttaccacccacttgtaagtgagaacatggctctatttggttttctcttcctgtgttagtttgcttaggataatggcatccaactccattcatgtttctgcaaagcacatgatctcattcttttttatggctgcttaatagtccatggtgtgtgtgtgtgtgtgtgtgtgtgtgtgtgtgtgtgtgtgtataaatatatatatatatgcatgccacattttctatatctgttctaccattgatggacatttaggttaattccatttctttgctcctgtgaatagtgctatgatgcacatacacgtctgtgtgtctttatggtagaacaatttatattttttggggtgtatacacaataatgggatggctgggtcaaatggtaattaattctgttttaagctctttgagaaatcgccagactgccttccacattggcagaactaatttacactcctactggcagtgtataaactttcttctcttccacaatctcgccaaaatctattattttatgtctttttaataggcattctgattggtgtgaggtagcatcttgtggttttgatttgcatttctgtaatgattaacgctgttgagcatttcttcttatgctgtgggccacatgtatgtctgcttttgaaaagtgtcggttcatgtcctttgcccacttttaaagggagtttttttttttgcttatttaagtttcttacaaattctgaatattagacctttgtcaaatgtataatttgcagccactttctcctgttctgtaggttgtctgtttatgctgttgataacttcttctggtgtgcagaaactctttagtttaattatgtcccatttgccaatttttctttttcttggagttgctttgagtgtcttcatcatgaaatctttgccagatcccatctccagaatggtatttcctgtgttatcttctaggagttttatcgttttgtttttacatttaagtatttcatccatcttgagttgatttttatgtatagtgtaaggaagggatccagtttcagtcatctgcatatggctagcaagttatcccagcaccccttactgaatagggaatcctttccccattgtttgtttttgtcaggtttgtcaaagatcagagagttgtaggtgtgcagcattacttctgtgctccttattctgttccattggtctgtgtgtctatatttgtaccggtacaatggtgttgtggttactgtagcattgcagtatagtttgaagtctggtaatgccaaatgcctccagctttgcccattttgcttaggattgccttggctattcaggctattttttggttccatatgaattttaaaatagtttttttcctaattctgtgaagaatgtccttggtagtttgatagaaatatcactgaatttgtggattgctttgggcagtgtggccattttagctatagtgattcttcctaatcatgaacatgaaatgtttttccatttgtttgtatcatctctgatttctttgaacaacattttataattatgaaatatttcagaggtcttttacctccctgataacctgtattcttaagtattttattctttttgtggcagttgtgaatgggatttcattcttaatttggctttcaccttggatgtttttggtgtataggaatgctattgatttttctgcattgatttactagcctaaaactttgctgaagttgtttagcagatcaagaagcttttggacagagactatggggttttctaggtggagagttaaattgtctgcaaacatagatagtttgacttcctctctttttattttgatgccttttatttcattctcttgctggatttctctggctaggacttaacagtaccatgttgcattggagtggtaagagaaggcatctttatcttgttccagctttcaaggggaatgtttccagctttgcccattcactatgatgttggcagtgggtttttcatagagggctgttatttttttgaaatatgttccttcagtgtctagtttgttgagggtttttaacatgaaggaatattgaatttttttttgaaagcctttcctgtatgaagatgatcaggtggtttttgtttttgtttggtttttgttttgagacagtctcgctctgttgcctaggctggagtttagtggtgtaatcttggctctttgcaacctctgcctcttgggttcaaacaattctcttgcctcagcctcacccaagtaactgggattacaggtgcttgccaccatgcctggctaatttttgtatttttagtagagacagggtctcaccatgttggccaggctggtcttgaattcttggcctcaagtgatccacccaccacggcttcccaaagtgctgggatttcaatcgtgagccaccacgcctggcacatgtggtttgttttattagttctgttatgttgtgcatcacatttattgatctgtgtatgttgaaccaacattgcataccagggataaagactacttgatcatggtggattaactttttgatgtactgctggatttagtttgctagtattttgttgaggatttttggatccatgttcataaaaaaatattggcctactgttttcttgttttgttgtttctctgttagtttttggtatcaggatgatgctagcctcatagaatgagtttgggaggagacccccccccccccctttgttttttttttttttttttttttttgcaatagtttcagtgggaatggtaccagctcttctttatacatctggtagaatttggctttgaatccagctggtcctgggctttttcttgttgttaggctttttattacttattcaatttcaaaacttattattggtcagttcagggattcactttcttcctggttcagtcatgggaggttgtatgtttccaggaatttatctgtttcttctaggttttctagcttgtgtgcatagaggtatttgtagtagtttctgagggcttttttttttttctatttccatggagtcagtcgtagcaccccctttgtcatttctgattgagtttatttggatattgtctcttattttagtagtctagctagtggtcaatttactagttttccactattggactgtgtggttatgtcagtctcttcataggtctctaagaacatgtgttcctctattgggtgcatatatatttaagatagttagatcctctcgttgaattgagccctttaccactatgtaaagggcttgtctttcttgatctttgttgctttaaagaatgttttgtctgaaattggaataccaaactctgctttcttctgttttccatttgcttggtagattttcctccatctcttcacattgagcctatggatgtcactgcatgtgagatggatctgttgaagacagcttaccattggttcttgattctttatgcaacttgcttctttgtgccttttaattggggcatttagcctgtttacattcaaggttgatactgatatgtatggatttgatcctgtcatcctactgttagctggttattacgtagacttgtttgtgtggttgctttacagtgtcactggtgtatgtatttaagtatatttttatagtggccagtaacagtcttttctttccacatttagtactcccttcagaacctctattgaggtggttctggtggtcatgaattccctttcagaaaaggatgtcttacttatttgcttatgaagctgaagttggctggatataaaactcttggttggaagttcttttttttttttttttttttttttaaagaatgctgaatataggttgaatctctcctggcttgtagggtttctgctgttttaagccttattgggggtttcctttataggtgatctggcccttttctctagctgccttagcttttttttcctttcattttgaccttagagaatctcatgtgtcttgggatggtcatcttgtatagcatttcacaggggttctctgcatttcctgactctgaatgttggcctctctggcaagcttggggaaattttcacggatgatattctgaaatacactttcgaggttgcttgctttctctcccttacagggacaccagtgagtcgtagatttggttccctttacatagtcccatattttacataggttctgttcattctttattgttttttcttcatttctgaatgagttatttcaaagagccagtctttgacctctgagattccgtcctcagcttgctcatttgtgctgttgatacttgcgattgtattctgaaattctctgagtttttcagctctatcagctcagtttagttctttgttgaaatagccattttgtctttcatctcctgtatagttttattgtattccttagaatccttgcactgggtttcaactttctcttgaatcctagtgatcttcgtttttatccatattccatattgtatttctgttattgtagcctggttaagaaccatgttggccgggcacagtggctcatgcctgtaattctagcactttgggaggatgaggcgggcagatcgcctgaggtcaggagtttcataccagcctagccaacatggtgaaaccctgtctctactgaaaatacaaaattagccaagcatggtggcgtgcgccgttaatcccagccactcaggagtctgagacaggaaaatcacttgaacctgggaggctgcaataagccgagatcacgccattgcactccagcgtgagcaacaagacggaaactccatccaaaaaaaaaaaaaaaaaaaaaaaaagattgttggggaactagtgtggccatttggaggtaagaagacactctggctttttgaattgccagagttcttgcactggatgtttttatcttcgtgggctgatgtcccttcagtcttagaagttgtcatcctttggatgagttttttgttcttttatccgctttgatatccttggggccttgattatggtataaggtgggcatggttgactggctttgattctggaagattttggggggccatggcttagctcaggactcccgagctgcatgccctaactctggggggctggtttcaggccctagctttgttctctggtccctcctgattactggagggggtgagttgttcccagattgctggtcacaacactcccatgagtggtgtcagccaaaatgcttcataggaaggtggcagtgagattcgtgctggttcacttacgccagcagcagcagcagtctggcagggtgcatgctcgttgcccaagctgaggtattgggtgtgctggtgtggtggcatccaagcatgtgtttgcaccattgccggtgtcatagcaggggcagagatcttttgggcatgtgccctccattcacactgacagcagtggcagcgcagcgtttgcggagaggccactagtgtcagtgcagtggtggtgtcagtggaaagatcgggtacaggaaggcatgcagttagcaccatctgatatggtttggttgtgtccccacctaaatctcatcttgaattttaactcccacggttcccacatgtcatgggagggacccagtgggaggtaattgaatcatgggggtaggtctttatcatgcttattctcatgatagtgaataagtcttatgagatctgatggttttataaacaggagttcccctgcattaactctctcttgccaccatccatgtaaaacatgacttgttcctccttgtcttctgccatgattgtgaggccttgccagtcacatggaactgtaagtccattaaacctctttttcttcccaggcttgggtgtgtctttatcagcagtgtgaaaacggactaatacagtaaattggtactggtggagtggggcgatgctgaaaagctacccaaaaatgtggaagtgactttggaacttggtaacaggcagagtctggaaaagtttgggggctttagaagaagacaggaaaatgtgggaaagtttgtaactccctagagacttgttgaatggctttgatcaaaacgctgataatgatatgaacaatgaaatccagactaaggtggtctcagatggagatgaggaacatgttggaaactggagcaaaggcgactcttgttacgttttagcagagacaggtggcattttgcccctgccctagagatttgtggaactttgaactcaagagagatgatttagggtatgtggtggaagaaatttctcagcagcaaagcattcaagaagtgaggtgggtgctgttaaacgcattcagttttataagggaagcagagcataaaagttcagaaaatttgcagcctgacaaggagatagaagagaaaaacccattttctgaggagaaattcaagccagctgtggaaatttgcataagtaatgaggagctgaatgttaatccccaagacaatggggaaaatgtctccagggaatgttaaaggtcttcagggcagcctttcccatcacaggcccagaggcctaggaggcaaaaatagtttcgtgggctgggctcagggtcctcgtgctgtgtgcagcctagggacttggtgccttgcatccttgctgctccagctgagactagaacgggccaaggtacagctcgggatgtggattccgagggcacaagctccaagccttggcagcttccatgtggttcctgtgagtacacagcagtcaagaattgaggtttgggaacctctgtatagatttcagaggatgtatggaaacacctggatgtcaaagcagaagtttgatgcaggggtggggcactcaagaacctctgctagagcactgtggaagggaaatgtggggtcaaagcgctcacacagagtccctgctgggacaccgcctcgtagagatgtgagaagagggccaccgtcctccagaccccagaatggtagatacagtcacagcttacactgtgtgcctggatccctgcatccctggtgtgaaacccacttgatcatctgttcaggtggattatctgtttgatacgttgttgggttcagttagctagcatcttgttaaggattttagcacctatgctcatcagggatatctgtctgtagttttcttttttggttatgtcttttcctggttttggtattagggtgatactggcttcatggaatgatttagggagggttccttctttctctgtcttgtggtatagtgtcagtagaattggcaccaattcttctttgaatgtctggtagaattctgctgtgaatctagctggtcctggacttttttttgttggtaatttttaaattaccatttcattcttgctccttgttattggtctgctcagggtatcaaataagctaggagggttgcatcttgccaggaacttaaccatctctctaggttttctagtttaggcacttaaaggtgttcatagtagccttgaatgatcttttgtatttcagtggtgtcagctgtaatatgtcccttttcatttcttattgagcttgtttggattttgtctctatttttcttggttaatcttgctaatggtctatcagttttatttatattttcaaagaaccagctttttgtttcatttatcttttgtattttgtttttgtttcaatttcatttagttctgctctgatcttggttatttcctttcttctgctgagtttgggtttggtttgttcttgtttctctagttccttgagctgtgaccttagatggtctgtttatgctcattcagactttttgatgtaggcatttagggctatgaactttcctccttgcacagcctttgctgtatttcagaggttttgataggttttggctgtctttgtgagggtgccaagtgctggggggtctagttcgctatcttgctacaactttctcaaatgcaaatatcttgaccacagaatcagaattgtattcatctttataatcctctctataaggctgcacatacctgttgaatgagtgaatgaatgagccaaaggaagtgcatagaaaatgaccagacctaatgggttatgtacattttattatctgtttaggtcataatgctgcctgtgttttcctatgtatttgtaaaatgtaaaggatttcgtttttgttgtcctgtttttggagtaacctgagaaattgttttagatttgttttgatttacgtagtaactagcagacttagctatatacaatgcaaagattattatttgtgaaattatttctagccatctaacaatatcagtatttagtctagttaataaattaccttatacagattatatcagagtttaatatctttgaaaagttttggacttatccaaaatatatttaatttggtttaccccaaactgtgtgttgaaatacaaagttaatatacaccatacaaatttaaaaacaatttaaaatattgctgttctttactataacttatactcttttattttatcccttaaaatgaatcttaaaaaatactattgaagtttataatattcaaagtaagccctgttcctaaaatgaattttataatagatgtctagcaaagctgctgtgttaataatgcaaaaatgctgtaattctctcccaaagaagcaattactgtgaaaatcaacattttatttctgccaagaaaaaaaattattgtgttctacatcaaattctgcaagaatcagttaaaaactctgtaagttaggactttacaatttctttcagtaaacttatgaaaacaattatgaaataagtattaactatatattgtgtttgagacttgattttcagtttatatacttactaaatccttaagttataattttaggttcaaagtataaactcaacttcaacctcaggaatgcttttcccattatatgagactgcctcaaacctcatttatggttcagaaatgtctttattatgttaccgaggtaatctctacagcacctaaattgtttatactattacatctcagaatatttgctattaggtaattagagtatctgacaatattagatatttaggatattttttctgtgccattctctcattactaggtgaaaatgaaatgttttttacatatttgactttgatacatcttcattatgctcttttattgcttataaatagaaatcattatttttctccagtttgcttatcaataagttaacatatgaagttctgaaagcatggaccattctctttttttcattttttttttttgagacagggtcttctcctgtggcccaggctggagttcagtggcgtgatcacagcctacttttaacttcaaaatcctaggctcaagccatcctcccacctcagcctccttagtagctgggactacaggtgcatgccactgcacccaactaatttttaaaattttttgtagagacagggtcttgctatgtcatctaggctggtcttggactcctagcctcaagtgatactccagcactggcctgccaaagtaccaggattacagaggtgagccaaccatgtgcagccatcttcagcctattttaaatgaacaattttttaaaaatacactgtaaatataactagcaatcatttaactgtaacaactattcagtgaattgtaatgtatattttattactggtaattaattaattcattaataaaggcattctcattttagaaaaagtgtttttcattttctcctagcactttcattcaccatagttctcaaaacttgcaaacttttagactgcactctctcaccactgtttcttgctctgtctgtactgtttcactgatggtagtgaaacagactacttggattttagtgtccacctgtcagtattcaaaatctaacataaaacctagcattaacaatggtaatatgatctgatgtaattgatgtgacttttaaaaaatgctgtttgctccaggaaaaagattatatgcagaaacttatttccttattaaataatacttgtattttcaaatgaactttatatcctgatagcacatgacattttccctttaatatgagtttgaaagatgaggaagttgtataacaagagtgaaaagccattggaatactttgttgcttgttagatttagtgccctttacaaagagtatggactttttttaagcgttgtacaggaaaagtctaatttaatgttttataaagcacttagaggttaaatagaacttttaaaatggatttcttttgaccaagtgattatcctttcaacaagtgctatagaaggaagaattatataagcatcagcaaaagcctctatataatgtcttgctagcccattttttataaacgggacttgagtcagcagaaagggcattccaatattgcaacattagaatctttttataatctttttattatctacatttgaatagaatctattattatagagattaaataccctgtcctgtgtgtgttccttagattgaaaacaggacaagattacagtgaaggcatcagcttagggtatgaaattctgaatccaaatacatttcaactccaaataatctctgggtccagaaagccagttgcactgactcagaaaaaagtttatcatgcttttccaccagacagactcacacttcaagtcatttatttaattcaattcaatgaataactacggtatgcttttccctctgtgtagctctgggggtgtaacagtattctgggctgaattcctgtatttgtgaagttcataatttattcagggctgcaggtgattctacagttaatttctgatagaatatgagactagctataatcataatataagcaaagtgctgtgtgaacagagtaagtaggagtgaaagagccttttccttaggctggatattgtaggaaaaaaattaaatttcttcagttaatggacaagtggaaaataggacagaatgaagaaaggccatatgccttgttgagggaacagagagtaatttgatgtggttagtgcctgtgagtgttgagaaatgaggctagaaagataatttgttactagattatgagggaccttgaaagctttgtggtaatttgctcctaatcatctgagcagtaggaaatcatggaatgatttgaagaaagagtggtgttgggtacctaagaaactgtttgtttaaagagacagatgtctctttcagtgtttgtctgaaaaagaatgtttgttgtcccttttctggtcctttcactagagggaatggctggagcttttttttttttttttttgctttgcctgttggtgtttctgggttgcccacttctccagtatcatccagtccaggatatgtgaagtgaaaatcattgtgttagtccggaggtccctattctgtgtgctttcttctctctacctttcagaatcttcttatgtttgttttatatgtgatgtccagggtgtttggcagtatttaactagagggacaaacacaagtacatccatcttgtctggaattagaaatcttaaatggactttaaaaaaatgttacagaagtaaaatgtacaaatagcgtaatacacagatcttaaatgcctattttaataagtgtatatttccctgtaataatcaatgtaaaacctttttattcccccacaaaatttcctcagggcctcttgcatgtatatctgccattcctcataggaagccactgttatgatttttatcaccatagattaccttgcctatgcttgaagttcccataaaatgaatcacatagtatgtgtctggatagttttacttaacatatttttgaaattgaagatgatttgtaaaatactgtgtatgtgtgtattttttactttaaacatttttaagccatagaataatattaccagaatagtgtttcaggaaggaagttaattttgtagtcgatatagtagctgttttgggtttgggggttgtttgatggttcattatagaagtagatgcatagagatgttgaattacccacaatgtcatcaatctgttaataaaacaaagccaaatgtattagaatttaactgcagtaagaaaaactttgcagtgtttcagaaggaagaagtagaagaaggatatttatagggctttgggatctgtgctgaaatggtttaaggtgggctttttaagacaggcagcttatgtggattaggcaaattctgtgatggaacagtttaggtttgttggacactgaggcaagagtcttaaagtaagctgtttatccaagttgtatggactgttgtctctgataaattggtctgtgagaatttcttgaagcaaacagtaggttatttttttggtttacagtcttatcctttgccaggcaaagatttccttgaataaactactaagtcatgttgacacagatggtctcagttctcagagataagaggttgttgatgaatttgaggtttttaaggccactaccaaggtaatggaaatgggacgagaatggaagagccattatgtaagagaccagtcacggctgtgtggagaacgaaatcaagagagcctattttcttggcctgatggggcttccttttgtagactctttttgtttactctggcatttactcttaaaagacttttcataggtacttcagatggaagagactctaatgttaccaaagccagaatcttctgtttgagtaagaaacccttttgtaaacattggtattaaataatagttgttgagccacttcttaaacaatttagatagggaacttgctttctcatgagacagccaattttagctttagaatgctttatttgttgagaaagtgtttcatatatggagctgaaaactgtttctttgaaatgcttaatagtgctttctttcctccctctggaatctcatggtataaataccttccaaggttctcatatcagctgaacaaatatttgaggtgggtgttcacactgtactctctttctaggcaacctgtttccagctctttcagcagtcatcatgccacagattggtagtgtctccctatcctggtttctgttctctgctttgctctccagtttgtcggtgtcaccattaatacctgcagcgttcaagttgaatactattctccagatgcattctgaacagggaggagtggaagtattacctttttttctgtgtaccagacttatattacttaaaataacaaattgaaacaaacaaacaacatcaacaacaaaaaatacaactaacttctctttagcttttctaatagcttcatcagactagaaactcatggtccacttggtttcagcattgctaggcatagttgacagtgattgagagtttcagaaagatgagctgaaattgtttacgtgcatgatgccaagaagtatactgtcccagtttactaattaaacaaacaaaaaacaccacacagtcgtgcaatggaggtagtagtgaggctatcttcttattgtttgtttaacttagactctgctgtagggaaaaactgctgagattctttcatgttgattccccaaatgattacagaatctcattttagttgcatagcttgctattattagggaagaaagtatctttctaaactctttatgaattcaagaatgttatagagaaagtatcaggggacattagtataggtataaactttaaagagatatgtaacttgagcctaattaattatagattataatattatggaaatagaggtaaaacaaataacatattccagctactctatactttcaatttccttttctgaacccttctaagtgggaattttttcttcaaatttaatgtactttgggttgcagttgagttggagaatttgaagtttgtcttgtttttaacattttttaaacattcattagtgatattgaaaataacagctttgggcagccttgttgtctttggccatttgggttgttataaaggaatacctgagactaggtgatttataaagaaaagagttttatttgggtcaccattctgcaggcagtacaagaagcatggcgccagcatctgcttctggtgagtgcctcaagctgcttccactcatagccaaagttatggggagccagcatgtgtagcaatcaaatggcgagtgagaggagtgacgtaccagattctcttaaatcatggaaactaatagcgggagaactcattcattactgggagggtggcaccaagtcccccatgatccaaactcctcctctcaagccccacctccaacaaatggggatcacatttcaacatgagatttggaggggacaaacatacaaaccatagcactgtattcattagctcattcgctcagcaaaagtttacagagtgtctgctctatgctgtcttaagcagtctggcttggcgcactgcaaaataagtgacgaacaaaatagataaagcttataacctcaaaaagcttttattttagccaggggacacagacagtgaaaaagcaaatatgtcaggtggtagtaaatactttgagaaaagtaaagcagagtgatagaaggttgaggagaatgcttttttatacagggttctgagaaggcctatctgaaaagaagtcatttaagcagagacctgaaggaaatgagagagtgatttatatagtatcggaagatggaacagcaagtgcaaaggccccaaaatggaaacattcttaatggtttttttttttttttttggaatagcaaggaagccagtatgattgtagtaatgagagtgaggaagagagtggtagatatgattagagtgacacggtgctgtgctgtggggcaggggcaagagcacaagttgacatgtgttctatataagccttgtaaactctgttagggaccttgaattttaatctaagtgatgtggaagccatttgaaggatatcaagccaaggagtgagataatctgacattttaaaaatcacttatttttgagaaagatagctacataactttattggttctttgttctcgttcggtttatgacaactactaaactagactgtaacgctggttctccacagaacacataaataccaactaaaggaaactcttttttttccttttctttttctctttcctaacccactgcccctgtgtctgtctgtacatccaatcctatccctctttttcctttctgcagcagatatatgatgcttgggatgtaaaaagaatgagcattgtttgctcctatattgaccctgacgagttttggaataggaaggatcgttacttcttacgtttgattttttagataaactgggaatcaaaagggttaagtgatttgcccaaaagcacataacaagttaatcacaaaacagttagaacccatgctggcttctttgttaatcctgtattctttaaaaaaaaaaaaatagtccttattatttggaacacttgttatataacttactaggtttttctctgtggcatctcatattttatacctttattttattagggtattattatttatgtctttgtattttcatgacccatttcttcaaagataatgtaaaatgccctgggtgcatgattttttttttctcggaccttcttaacggcaggaattagagccatagttaccaaaacaattattctaaagaaagagtacagagacattgatttgatgatgaaaggaagcactgctggaatgttttcttggcttcttatgatgagtggagtttcacagtggtatatttgtttaaaataaaaaagatttactttgaacaaaaactatttaaacaagaagactgctcaaattattgttatggaaaaccactccagaatctattcatttttatgaaaccatttgtagaaatcagaatgaatatagtattctattaaattagattgatcacctaacagtaacgtgtagtgtatataaataaaaatttatataaactctgaataaaatattttcttgtatataaccaattttggtgggtaatatgtcagagctacaagacttacctttaaaatgattcttcacaaagcgctgatagcttgctctgataaaagtttctcagaaggctgaattccaacatccttgagcatggccctatgtgatagagtggaagaaagaaggtctttgtgcatctcttcatctcttcaatatttagtggtctttgtgcctctctcctgcatagtactgcttcagcccaatgatgatggcaggtgggtcatcttcagtctgtcagagtttgtaggtattacagaaatagcttctcttttggttctcatcccctccttcatgctttacaacttacatattatcagataaaactgtgccgcctttcctgctagtgtaccttgaatctctgtgctgtgacgtaacagaggcatccattttacatacttgttttcttacattttagaagtttggattttagattccagttaagtactctttaaagatactcatattatacatggttggatctctcaaattttagctgtgagtctgacaaaaacagttaccctttgtacctaattaaaccagattgtaatctagagacaggggtgttaactcctattgtctcagtacttctgatgtattataatattgcatactgtttccctaaattttcagtaaataataaattactattattgcatatatatggtatattttggtatatatttatgtgtttgctgtttattttcatttgagagtctaatagtgttaattctttgtatttatgttgtcaataagtcaattaaggaagcaaaggaaaagaaagtgttatcttttcaagagcagcattctattttgcagtgctttcctcaggaaatgaaagaaagatttctcataatctaacaagaacatccaattccatgttaaaatattggttttaagtaagccaattaagaaagaacccttcaaacttttcacatgactttgctattatcattcagacagatgtcagagtcataatatgaatacttaaaaagggtttgaagtgttaatagaagaagcttccactctgaaattctatttgcaggagtagagaaaagataacagtattatcaatttcgtgtagctcatactgaaatgtggattttaatacaagatgttaatatacgaataaatatttcataacttgaaaataaaataattacgccttctgtatgggtgaaacaaactgcattgaactcttgattgtgcaaatatgatcacgagcattttctaagcactcttccattgtacaatgacactttaataaagtacttgtagagaagcatgtatttcagctatcaactttattcttttactattttgtccttttaaatttgggaagttaagttgtagggcgcaagaagttcattcagccacccagagcaacataaaaaactgataattaggaaaatgctacttttgatcattgaatcatattataagtcatcatttgttgctataaaagtatactttatgggttttggactccatgtttttacctgactgctttttttgagttactatgtctcaaagctttatcaccatgggttagtagtttactaaaagtctgtgaaactaacctaattttatatcagatggtatatttgagagttagtcactttcataatgcctacataaagtaattgaactggtaatgtaaatgcatatacagctaaaaatgcttatgccaagctattctcagtaagctttaaaatttacatttaagaaatctgaaatgtggttatgttggacttttgtttcctgtcctgaacttctgcaataagcattgtaataagagtcacatcatatagtctgtcttttcagtgattgaatacaagagaagaatgtctaagttttgtgccctatgttttttaaacctatattttttatgttttagcaagacatttttgatcatatattgtggcaaacaccaccactaaataccagaaatcaaagcacaagtcatttttctctcttgatgttttcccaggcctgtaggggaaatgatatgtaagtagacaacagccatgcagcttggtaacaatcaaatataatgttgaatatatttctgcgagagcaaagatggaacagcagcttattgcctagatgactctataggagatgtggaatgggaaatggaaaagctcagatgtttacattgaagtgggaatttgacatgtgcatccctgggtgtgtgaattttctagggctgtcacaacaaaatgccacaaaccgggtaactttaaaacaacacaaatttgttctctcacagttcaggaggctgaagtacaaaatcaaaagattagcggggttggtttttttggaggttctaaggaaagaaccatcccatgcctctttcttaggttctagtagttgctggcaattgctagcgttccttggcttgtattaatagatgccccactccagtctttgcctccatcttcacatccccttcttctgtgcttctctttgtatccttttctgtctcttataaagttataaagatactctcattggattttgggccctcctaaatcctgaactaattaaatctgtttccaaataaggtcacagtccaagttaatttttggaggaggacatcattcaacctcactacactgggcagagtagcataagaaagtaaagaaaatacccaaaggcctagaggtatgtaaagttattggtagattcaggataataaatgtagaggaaatggaataaatggagtgtggaggaatactgagaaagttgattgggaatagattaggaaaaaccttgtgtgtcacaggaagatgtttagactctgctgtaggcatttgggtaccagaagcctgtaaacctttgaggtgcatgagcagatttgtattttagaaaagtgacacacaaaactgaaagacttaaaagactagtctgaagacagaagtaacatataatggcttcctaaatgaaagtgtggtagtgatttaaaagtgatgattattaaacttcatctgtggttcagtgagcagtgtatagagagggttgaaatgattttgagaatgctttgggaggcaagttgataacatatgccataactaagaattttggtggagaagaaagataaaacattcagtttttaaacagagaattgggttaaacagtcaatcaacgtttatttaataatgctttctgtctagcattagtctagatactttggagattataatcatggcttctatttcaagatctttacaagatacgtggagtcatgatactgataaaagtgaaacagaaaacagtccaaatccgtgtgtaaacttgatgattctgactgataaatacatcagaatttcagattaggaaaagatctgtgtggagttaggtgccataaaaagggtttcctgagtcttatgtaaagtaaattaacaacttttgatctaaattgacaaagtagtacttaatttagatttgataaattatatttgaattggttcaaaagaagatagaactccaactaatagttgatcattaagcttggaaggcagatataaaaatggtgtttttgtacaggaaagatagcctgactagaagagagaggatagccaaatgttagattatattatgtttgggaaggtatactgcatccaacataatctgtcttggaagatcaggtaggtaaatttgtattcactgcacaaataattagttactgttggaaaaaagtttttatgttagtaatattagctcaacagtaatatgtagttctgttattttttagaaaataaaaaagattggaggaatgccaatctgaaagcttttaccccaatccaagtatgagataagtcctgttagagaaattagattttgtatattttgactacacgtatttcctcgttctcctttggctgattgaactagctctagttaatccatattcttatatgtattttatgccttcttcatttttgctcctctgacttactcattattcccagccagaatttagctccagatgaagctcccattgagccatttatatactccatatctaagagcacggggaaagcttgaatgatgtgaaaatgtggatgatgaggaggaggatgatgatgatgatgataaattacctttaatgtgttaggagctgtatgtgttatctcctttagtccttatagtatccttatatgaaattgccactattatctcccaattaggtaaggaaagtatggcttagagaggttaagtagcttgatttaaatagggttccactgcaactagacctgtctaactgcgtagtccagattcctcatcactttaatatagcatactggctcacctacatcttttccttgttgcagtccattacattatggcactcaaattcagcttcctaaattgacctacagtcacatttcctttctattcaaaagtcttctgtgacttccttatacttaacaaaattcattatttctcccctattccaggatccctccaaatgtagtgacagcctcttccctcctggtggacttatctacagtctatactgttttttaccttagtgcgctcccctccctgcccttttcggagtcctacctcctttttcttctatttgctgaaatgttactttaggttttgtctggaggctagaatcatcctatgatgatctctcccaagaaactttgtctgtttctccacccttcctcttaatttaataatgctttatttgctaccacttatgctacctaattttttgcttggtttgtagtttagataatatatagttatttaaactggaatgtaaacttaaatttcttaaagtcagaaatgattgtttcctcatttttgtgtcttctagtatagggcctcgtgctatttaagcctagatgaaataaagagtgagagtggaaatgagttctgaccgaacaagggccttcattctacagtgagtaatcaatctgcagtttaaaataagcagattcattgaatgggccacaaattcctatggcaggaaaacatagctgacatgaaaaaggaaacacttgtttacctctccactgtcatttttccagttatgttccagaggttggctgagcaaacccccaggctacttattaaaatgcagattgcagaaaatgggacctagaaatgcacctttgtagcaagattcccaggttatttgagtgaaatttctacagaaacatatataggcataaaaatgcacaaatcataaatgtgcagcttagtaatttgcatgaagtgaatatatatatttataaatatatatatttgcatgaagtgaatttataaatatatatatattcacttcatgcaaattactaagctgcattatatatataatataaaatatatatatataaaaccagcaccaaatcaagaagtggaattttgcctgcattccagaatttcacttaactttgcagtcagttaactaatctgccacccaagtcacccctcaagggtttcctgagtcttatgtatagtaaattaagaacttctcatctaaattcaggcttgtctctgataatgtagacattaaaacagtagtccccaaactactacctccgttttcttcgctttcccttttttttcttgtcctctcctctcactaccagcattttccttggcaataaaaagtaatgaaacacttcttctgaaaaattcctgtaagtctctcctcgatgttgatctacttaagctgaggcagtattttaagggttctctcccttcttttgtaggattcctagaatttcttcattaggcatagaagattctgctctttttttcaaatattatttagaagattgaaaggataaacataatttcaaaggatctgtgccattgataatttagtttactttttctaaaccaaaaacttatctcagaaaagaggttaccaggttttagaaaaacaaaaaggtacgtgtgtgtgtgtgtgtgtgtgtgtgtgtgtgtatttaatatgtgtgtatatatatatatttaatatatgtatatatatttgtttaaatcgcattaatgccttaagcattaagattcttaactttggaatttgtgatagtttagcatcatctttagagaatttaccattgcactgtgtaggcatggtttgctaagcaaattaaggatataacctgttttgtctgatttgctcaagaaaataacttcttgtgaacaatagtatcttgattgtttatatccataaagataatgctataattgcaaatatattttacctgtatatttaagctttccacttgagaattttaattgacaattagaattactctatagtttcagagtatattttaaaatatatagcttcctcctccctgccacccccagtttgatcgtcacgtttttactatagtttcaggaactgaaaggaaataataaccaagacacaaactttatgaacttcatgaatattattgttgtgatttgttcagaccttgatttttaatcttttccttccaagaagaaaacatactaaattgctgtgcacagtttcgtcacataataatttttattttctaggattgaatatatcttattaatagtattttcagaaagtacaatcttattttacaagtattgtaaaatatttcaaataagtaatagcttatttgaaaaataagattagaggctcttagaggacttttaaagattatctaattcattcttcgtcttcagacatgatataaatttccttgttttaatgcttttgttcagagtactcatgctgttgattcttttagcaaactatctttgtattatcatttttctgtttaacttctgtcactacctgttcattccacttaacctgctcttttcagaactatttgaaacctcatgaaaacatgtaacagttccaaaaccaagatcttcaacttgaaattcacatcgagtttaacttcagtttctccccttctcttattcctgcttatttcgatctttattccttaaccgttttattagatctcttttatgttcctatttccatcaccccttttaaaaaggatttacgtggtctccaaaggacactaagatttccttctctagaatctcagtcctctttcttttcaaccgtctatcttcttgccaatccccaatccttttaagctttactgcctactttgctgctgcttgtaaaatactgtagaaagtcagaaataacgttttgatttaatacattccacagtgtttgctcctaaagtttctcacctgcacacctttattctagtcttcacaggtcacagtaagggtcactttagatgaccttatttcctatgtaaactaaactactacaagagttatctgtgtccattaagtttcttcatttctggttcactcctcggtacagttcagtctggctcctttatgcgtagctccattgataattacactctctaaggtcaccagttatttccatgctgttaaatcagttggatgtccacagcatttataagtaattcttatttttctagaatattgtaaacttgatggcaacagtaaatatttttgcttttctttaaagaacatgttgatcccaaataatccacaaatacgtttttgtaaaagtcgtaaaaggttgaaataatacataactatataaaagaaaacataaaagcctccctttcattattctcttccgaatttatcatactcattccaaaggtaacagtggtttacagttttatgtggtttcttctcatttattttctgtgcttttccacacatatttacacttgtaagtatatataatacatgtgtttaatttacatgcttgtaagcatttccaattaaaattacatttttaaaagtaaaatctaagcatagtgttactgtcattgttcaaaagaaagctgacaataaacataaggcattagtggcatcgattaaaagatcttaagaaaactagcagaatttttgtcagttgtaatagatatattagtttgctagggctgccataacaaagtaccactcactggatggttccaacaacagaaaatgtatttgctcaggattacgaagcctacacacatccgagacccaggagtcagcagggcgagtttgaggtctttcctcttggattgtagatggctgccttctcctccctcactcttcccatggtctttactcagtgcatgtctgtgtcttgatcttttttttataaagatgccaattatattggattagggcccatcctagtgacctcatttaatgacctctttaaagaccctctcaccaaagagtcatattctgaggtactgggggttttggacttaggcatttttgggagggactcaattcagcctctaacagagcaataatactcagttgacatttgttaaacatatttctcatgaaaataattggtcacttattcacaaccgtggcctcatttgaaaagtacttaagcaaataccacttgcttgttaatggcttactgattaagttttattttagtgaaagtgcgccttgaaggatattacctcttcattgaagctacagacgtcttacacaattaagaacaacttatagtaacatctacctctttactcagcatgagatgtgttattggtggtacaaagcattttgaagacagtctgtataaattgcattatataacttaaaatgctctgttattggaatatgaggatagaattttgtaacactttacctcaagcacacttataaaggatttgaatgattaatccgtaaagtaaatctgtgtaaataacaagtgtagcagtatatatgttgtttttaaattttgatttttgaaccccaattttgttgaagttattatgccatcatcaaaagatagaggattgaaaaaaatgacatctcatcgctatttccagccagaaagtgtttgaattatcacaaatttttacattacaataaaggcactacattttatatagttgttatatttggtagtttgtaactgctggaagtggttattaaagagaaactttagaggtgataccaacatggttctgaaatacttgtactaatgaagaattgtgagctatcttaaaacatctggtattaatccagatatttcagtactacataatttccaaggttatacttctttcttagtaggaatgttaaatatacaatttcttgtcctctgtctgctagtttaaggtttctttcagtttgttcagtttgataaagaatcagtaaacttaattgagaagatgaatgttcaaaagaaagatgtatattaaacccagagaatgtctgaagtgagagctacataaccaattctggtagatgttagttttatattttcagatactcagaactgaattttacattttattattaatagctctcttggtaggatttcttcctctttataactctttataattttaaactggattattttggaatctatgatacaacggtaacagcatgaaattgcatattatacaacgttgcatttgaatgcaggtgtcccttgacacttcttgattaaacaagttacttaaccttttctgtaaaatggaagaatctgtacacctcaaggtttcttttttttcctgttctgataattaaattaaataatctttatacagtccaccctaatccaagaccatcattcagtgcttgaaatctcagatagtaccaaactctatatatattgtgttttttcctaaacatgcataccaggatgaagtttaatttataaattaggcacagtaagagatgaacagcaataattaatagtgaaatagaacaattataacaatattctgtaataaattatgttacgtggatgtggtctgtggtctgtctctcctttaaaataccttattgtactatacccactcttcttcttcctgtgatctgtcaacctgataactgagcaacccactaagtgactaatgggaaggtagcatgtacagtgtggatatgctctacgaaggcatgattcgcagcccaaggaggacacagcaggatggcatgagatttcatcacactactcggaacagcctgcaacttaaagcatatgaattgtttacttctggaattttccattgaatatttttggactgtagttgacagcaggtaaccgataccacagaaagtaaaaccaaagataaggggggactactatgcatttcctgatgtaaaacagaaaaaaaaaaattatttcacatttttctagcggtggtctctattttagaaaaaaaaatgcttccagatcataaatgcaaaactcgtgggcatacttttctgtggatatgatggaacgattctcatttgtttttcctaaggttttccaaataatatttccatgaaaacgtatctttttttagtattgaggtatgatttatatacaaaaaaatgcaaagatcttaaatatgcaacgtaaaatgagttttgactgtgcttacatattctaatggaagggttgggtgtggtggcactcgcttgtaatcccagcacttttggaggccacggcaggcggttcacttgagataaggagttcaagaccaggctggccaacatggtgaaaccccgcctctactaaaaatacaaaaattagcttggcatgatggtacacatctgtagtcccagttactcgggaggctgaggcaggagaatcacttgagcccagtaggtggaggttgcagcaagccaaggttgtgccactgcactccagcctgggcgacagagtgagactctttctccagaagaaaaaaacaaaaattctaattgaagttttgtgaatgttcttgttttcattaatacatatttctgattaaggacaaatctgagggatttcgtatgaattaaccagcttaaaaaaaaaagccagtttaaagaaaagttgttcagtaagtatgattttggtgtttgcaagtcagtgtaacatttttgaaatctataaagaaaaagagttgtgaaaaatggaagtatatttgataaaaccaatttatgggtaaaaaattgagtaagtgtgtataagtatgtgtaagtgctcccttgtaatacactgatacacgtgtgatacattaattactaatgacgaaatatactttgaaatctctggagaaatattttaattatatgctaataatatgtactaactacgaaatatcaatatttatttgttaagaaacttcatttacaaaaaactgcttaccgaaaaagaaaatcattttttaatgagctcagtgtaaatacgaaatgagtaactggttttattaattttaaagaacatttactatatagttatttaaatcatcactttttctctactatttatacgatttttttgagtttaagtgttcttcatacccttttgaggactttagtaatagcttcatttgagaaattaaaaaaatagagaattgtaattagatgctctgaattaaaatccctgaatattttactgtagggtttaaatgtattgtatatttagttgttttaaaatatattgaaggatgtatttgaaaccagttctcttttatggtcctctgtaactaatatcattttccctacaatagacagaattctggacttacgacttgaaaacaacgctatgacattataaatacgtatgtttaaaatacaggtcaaatgttatagatagtaagtattggaatagtttaatagcaataaatattatcctgaggcagaattttagaaaaaaacttcattaaaggaggtggaatttgaattggccttaaaatcaaggtgaattttggtttatcagtaagacgaaacatcattttttgagatgaatcaggaaaagagatggaacagccttaagaacctgtatagaggtcaaaatggggataagattgtttgagagtaacgaagagactgcttttactgaaatatgtgattttgttcatagaaatgtaaagaaaattgtacataatctggtatcccaatcatatctatctccagactccttcccagtaagatcagataaacagttttgctttccatcctctattaatttccttgtcacactgtacctgtttgaaatcctgttgcagtattacgtacttatctcaatataatctacattaaaatattctgtttatagttaaccatctttggagtctttccatgtcagcctactgtaatttcaactttttatttctctagcactcatttggacatatagctaaattggccaccaaaattctattcttcattttgtaccatgtaacttaattgccaattttattaatttgtgatctgctgaatcctatagcacctctcaagaagaaaaatacttttatccctagttacaaaggaggttaactcaagcgcagattcacatcatattctgctaaatcttgagtgttaaacaaaatacttaaaagagaatgaagattctattttgccttgcatgattagacatttttaagtatatatactatgtttccttttgagccaagacactatgttttgtattgtgttttgcattttatgaaacagaatatctaagtactagatattgattgattgattgattcaaagatgtttgacatagattgccaagggttttgaattacctctaaacaattttaagttttcaaatgtttgtgagtaatagattgatgaaagtagtgattttggaagatttaactagaagtgaggaattggaaagtaaagattagtgataatccaagcgtgatacattaaacattcagacagaatcagttgggtcaaagtaatagaaaagtggcagtagagaataggaaatgcccgttggctttgtgatggattgtaaggtagaggtgccgaagttgaagcttaggtcattagaagaatggttgtaatattgatagatgcatagagtgctggaaagataaatttgtttgcatggagaatattgacatttatgtgtacagttttgattttagagtgttaggacattcaaatgggatatcaagtcaaaatgtagtcaaccagtagttacatcataagatgtgaaaatatagacctggctgggatgggatctttcatgtaaaagagctgttgaatttaacgatacacatcttctaaaggagagaaatataaaaagagaatagaacttcatggacaaataatgtcatgtatttttcttataattaacatacaatttaccattttggtgacctctttaattttcataaacttagatatataacttatgttgattttatttgaagttcatatatcctcagttgaacttaaatggtctatatttgtattactacaaatactcaaatatgtgtttactgtgaatttggacattaaaataactaaatctttactatacatcctatcagttttaatgttgttgccttttgtataaaaacacacagtaaacaagaaatcttgtcgttcttccttcaaatatgtacatatatatgtatatattttttcctttaaaatatattcaggatcagatcacttcttaccacctgctccaggataagatcacttcttaccacctgctgtcaaactgctttacgtcatcagcatcttttgtctggattactgtagtaaactttccctggtctccttgcttctatgcttgcttcgttatagtctgttcttgacatagttcatgtcactcttcttacagtcttgcttttatgactcaccatgtaattcagaataacatctaagtcttcaccagcacattgaccctcttacatttccttgaacatgtttctatcttaaggccttcatgctggccattattccatctctcttatatgtgcttcccccagaatccatgtgactaactgccttgccttgttcacaactgtgctcagatgccaaagatgtctctgtggtgtttatcctgaccttcttcctatttaaattgcaacctgctccccattgtcaatacttctgactcccttacttttttctgcttttccttttcttacagcactttgcacttatagtatacagttcatcacacacacacacacacacaccacacacacacacacacacacacacacacacagccccatgagactagagatcattgctttgttcactattttatctcacctgcctaggaatgtaacttgccatgtattagacactcaataaatatttgtagaataaataaactaacatacaacaacagtagctaacactgaaggcttatgtcacacttttctaaaaactttaacttattataactaccttaatgaagtagagatccttccatccccatttcacatgccaggaaactgcgccatatgttgcctaaataaaaagctcaattctacacagaattcaagcctcgcagcctggtatggagccagagatccaaatcatttgtgtatgagatttctgttaaacatgagtattgtgtttagtgctataaaggtttgtgtttgtttttgtagagacaagctcttactcttgcccaagctagaatgcagtggcatggtcacagctaactataacatcaaactcctgggcttaagtgatcctcctgcctcagcatgttgagtagctgggactagaggcacttgccaccacactcaagtaattattttttgtagagacagtgagtgtctcaaagtgttgcccaggctgagtgccaaaaagtatttatagtagaagcagaagtgatatatcattgttaaatatagtgtatatatatatacacacacacacacacacacacacacacacacagagagaacatttctcatataccttgattcacactgatagtttaccgattaaatataaagatgaattttgttcatctgtagccttcaaatagcaagcttaaagaaatataaaattacctcaaaatttaagtctcattgggcagcctcaaccagtaacactcattattagttaaacccagtctgaaggcctgcaaagcaaagccatggtactgtcaaccatgttatataggcctaatgtctgaatccttaccagtgccatttttatttcttagacacgtttcatttatcatactgttgtgctatatttcacatcagatgtcaagataaagtctctgatgtcaaagatttagaagcagtgactttccagatttgctcatcagaatgcagtggtcctggacatacagagcaaatggatgacattagatttctaaagctgctggcattaggtgaactttaggggaaatgtcattcttgagaccatataagagaagtttcaagaatgtaaattaaagctatctgaagtactggacattttagcatgatataatggcactaagagattttgcttatattgcgattgaggcagtgaccacaaataaatacaaatccagataatgatcgaagggcaatataacaaatatgttaaaaggttccttattaaagagtaattccctggccacccagggttcttgtcatccatgttcatgtgctgacagaattatgaaagcattttcatgtgaatactgaagagtattatggacattcgtattcataggtacatcaaaaaaagaaaatgtaagagatagactatgcttcgaagaagacaatgattcttacctattttttgtttaaacacatgttatagactttgcttgataataacatctttttttatctcctaatcaccccataagtaagaaaaaatgatctgtacttagaaaatgaattacagagtggttacatagctttcctggggaaatcattcaatttattagcaaatctggattagggcacagagaacctgttcctaattcatttcttagacaatcacaagtgcaaaatatttggtgatatgaaatgagtaacttcatccttaatgcagaattatgtaaattttaagccataaaagttttttttgttttgcattttggatttacatttataataatgatatgagaatattaatgttccttgatcaagttgctttttttcccccaggataaaaattaaaatggacacacacacagagattatacttttcatatatacgtgatgtgacagctacaaaagtaattacagcatagatttatgtattttctgtattcacattaaaagctattcagttgaattttaaaatgctgaaggatgtaatactttttcattttgaacttttaattgcatttagttaaacacaagaaaattctatgaaagtaattatacatttcagtttttctttgttactgaacaaaatgaaatctgtaagtctagaaatatgttatcaataaaacacaaattactaaaattacttaagcagttcagtcacaggacagactttttaaagtttatgtttagaagaaacttcatctaggttatatttttgttgtctcaacatttatttggaaaatatagtagaatgagaagctctctaattggtatagtatttttgtatatatatacaaatatatagtatagtatactactatcctaatagtatagtattatatttttgttgtctcaacatttatttggaaaatatagtagaatgagaagctctccttttaacagttttgatcacaaagtataaagtgtttgctgaaacacaattgattcccattagctgtctcactagtgtctggggcttagggttgttttacgttatcctaggatcctgggagttttccatacctgcagtctatgtttttgttggctgactttctacggaggggcagctatcgtgaattatttcagcatagtctgcttagggtttccttagtattgatgggttttgtttctttcttttttttttttttcctttacctacaacacctagactaccagtcttattgacagggtaataaaggtaaagctcatcaggagagctatttctccattttactatcaggacagataactttttatgaagaagggactgaataagaccaagcatggggtcacagttaaccaaaaatctgtggactgaatctagtctctggttaggagctgctagcccaccatttggttcttccatctccaaaaggctcagtttctctcttcctataatatttaccatgcctcttatagtattctagagactctctgagaatactagacaggatgactgcaatttgaatttttagaactatgtcgtttgttatgtggtgttgtttacctgcctgattcacttcatgtatacagaatcttctgttgcttgggtgcaacttgccacagctctctatatgacttctgtctgtagagctctggactcccactgttccaatggaaaatttttgttaaaaaacaaacaaatcatcttacactggtaagatattttatctgaatgtgtagcagttcatttgttattaaaaaaactgtttaaataaaaaaaaacccttcttacttgtgagaagttttccctgaatatatagcctttctgaaagctttcacaatattacacattgctccttcccatacagcctcccacaaaatgtagttatttagtgttatttagtcatagcttatagctcattagtagtacaaatttctcgtcctaccacagacctattgtgtaggagtttccatatatagagcctgaaaatctgttttttaaacaaatatctctggtcagtttcatgcacacactattttgaaattcttttgagaaccactgacttaggttaagtatcaacctttttgatcctcaaataggaaaataaaattctaagatgactttttggagtatgcctgggccaggtaagaatttcatactccacaacagatcgtgcagtaagttcagcagagacattgctaaacgatgtcctgcaacttccagtgaaaagagaatggtggcttattgctgacacctcacagagacaaaattctttgagtggcaagtaatcaagatttgtcactgttttcataaagaactgttttatttctctgttgtaatcattttttagttgaagccaaatatttaatgaagtgcttaggaatttcaagcacaagatatgtgcagcctctggggaaatccaacaagtggcattttttgtcacctggatgtagataatacctctttatatctcttctttcaggcaaatccagaaagacttggcctgagaattttatcatctatatcacatctgccatttggtgtagagcctagtaagaactaatgctgcctcaaagaaggccccaaggataggactacaaacatgtaactagtaggaaacagaggaatcttttattaaaatgttagagtgggatttaagcttattttgtgcaatgacagtgatgacccaagatacttcctatcttaagagttcaaaagtatcctttcctggacattagtatcctaaaaaagaaactgaaaagaaaataattcttagtattttagcacacaaaggagactcaggactagtatcatgactacattcccactagctgataggttttgaagtgctatcttattcacttagaattactgagaggtatgaactgaattctttccctctaaaagtcagatgttgaagccttaaccccgcagtgtgactgtttggacgtgggtctttagcaggcaattaactgtaaataagctcatgagagaaggtccctaatctgattggattggtggccttataagtagaggaaagtatagagacgcctacctatctctgtctgctcacaaagaagaggtcatgtgagcacacagtgagaagctggctgtcttctgcccaaggggatccctcaccagacaccaatcccattggcaccttcatcttggactttgaacctcttgaactgtgagaaaataatttctgttgtttaagccatccagtctatggtattttgttagggcaaccaagcagactaagacacgcagtaaaaataaactgaatctgtcatgcacagaaaagcagatctgtcattttatatagacattgatcaggaaaactagggctcttctactggaaaatcttaaatagttaagatgaatttcagagataggttcgtttaaaaacagcaaggcaaccctttgacttcttagaagtgttgtcaaggaaaatacaagattttttccctctgtttcgtttttaggttgacagtaaattatcatgttttcttccttctttttgctttggcaataatttttgtattcataaagagtactgaatcagatgctaaacagttgagagattatcacttaaaagattttcttagattttgcatgtccattgcccttgttctggcaggtagtgaataaaggactgaaacaggctgaaaggatttacactagtactttttcatgatgttttcaaggagggtgaaagaaaatagatgggaaaagtttgcatgtcatttcatactgatttgcataaaactgcatgacaaaattggactgaaagaattcatatagttagtgagagataatcacccatgtttcctctagctgcggacaagctcttggtttattttgcaatcatgtattttaaaatgcaagaagaagggaccaaaaagagtttttgtggatttgacccaaactgagacaaatcatcatttgggtatcatccaacactgtcaaatcttagtttcatttgtcatttacttaatgttataaatggttctttttaaaataagttataattttaaaaatgatcaaaattccaaaatttcatgggattgatggaagcatttttaattttttttagtaaggattatatgccaaagcagagacgccagcactgctttatcagtgaataaaagagaaataattaattttaaccctgtgtattattgtcttcaaaatagctattttctggcatatatgtattactgaacaactttttgcactctgcttatattataatttacttttgatcccaagcccatttaactaaagcagtcattgttagggttaatcaaacacgtttgttagtatcttttgctctcaaggctgataatatcaggttgggtatataagggacttgcataaatttacaaaaacaaattactcactggcaagagaatttaactcagatatagtttgctattactgaattaacagtgggcatcaaccagtggagattaattttaccatctgtgagtcatatgacctaagacattaaaatttggaatctcgtttgaatcttagatgactgatgatgatgatgatgatgatgacggtagattacatttattggcttcctgctgtgtttcaggcattaggccattttacatgtattatcaattcacttctcacattttattattttgatcaaagagcttaacaatttgaagtttagagtaatttgctaaaggtcttactcatgaaacccaggacagagaattgacttcagggaatatgactaaaatcgattttataaagtactgcactacattgtttccttcatgctgtcagtttccaatttgcagattaggaaactgaggcccaaattactgaactgattaagtaacaactacttcattaaattgaatggctattattaacactggaaactgacttctaagtttagtttgctttttgttaccctagctctcttttcaagtaaccttttggtccaccatagccattcttattttcggaacattacgtgtttaaaaggactcctcaaggagtatttaccactagcacaatttaaaaatgttgaaaaaccagaacgtactgactggtgtcatcttcccaagaattcagtaataacttaagtaaaatcaggtttatttcacatactgatatatagtatatttagcttaatttccattttacttttattcattcttgatattgccatataagaggtatagaaacactaatattaaacaaaatatataattttttattttcaagtatgttacttgaaattaagaacatagtatcattcatatatattgttttttcatattatgctatgctatttgtcttctgcataaaattgggctttaagtaagtcatgagtcatggtaatgaattttgttataaccttatttttatgaacctttttttattgaatcactttttattttatgttggttcatatgctctatgaaatattcaatggggccaggtgcggtggctcacgcctgtaatcccagcactttgggaggccaaactggccggatcacttgaggtcaggagtttgagaccagcctggccaacgtggtgaaaccctatctctactaaaaatacaaaaattagccaggcatggtggtgcacacctgtaatcccagctactctcgaggctgaggcaggataatcgtttgaacccaggaggcggaggttgcagtgagccgagatcatgccactgcagtccagcctgggtgaaaagcgtgaaactttgtctcaaaaacaaaagaaaaagaaaagaaatattcaatggattagacaactaaaaaacatttatattaatggtttctcaaaatatttgttcctttggaagaattgatcggtatccattatcaaagcctgcacacatttttttcttgactattcacctgatctgaaaatgcattgcccttagttaaatatatattttagaataaattatcctgagttactgatacgtccctcactcatgagaattagtaaaatatcagagaggaaaataaataaatgaacatcatgctttagctttcagggaattcattagtcaatattccctctttcaaaggattttgaaagtatatgcatctgttagatacaaatttttaagaccagcttaaaatcgcagacctaaggttaattttaggtgaattaagtcattgctgcaggggccccataaatgaaagctaactatctaaggtcaatccttaagacttttgcaatacttactcattggtattcttgtgcttactcttatagcttttggtgtgtgccagtaatctctttgttgcacattagtagacaaaatgtattcttgtaatttgtgtagctgtaatttgtgtaatttgtaagctgcttgagaatataggtattttttcctataactgctggatttctgttgcctgaattggtgcctgatacatactaattgatcaattaaaaatttgcaaacaaattcaagctaagtaaatcctgaaggctcgtagggtatctggttttgatgtgattttgaagacacacacaaaaaaagaagtacaaaagtcaaatgttagtataccttcctgaatattatattttaaaactatcagttcagcacactaagttcacttgtgaaaaggaaatgaatttctgaatgctgtttgtttagaagatagaaacagcttctcggccttttggctaagatcaagtgaacaagatacaaagtttgttgaagtggaaactatgaaatgatttgtttgattacatttgatcacttacactattgtatatcatactatcttacttgatttttagtaaagtatcttgaggaatatcctcttaatcctattttaaaaataattgaggttaagtagtttgttcataataacacagttagtagatggcaaattcaggactgtctctaaagcctttcctctctcctgccttatgtatacaagaaataagctacaagtgttatagatcagtttcatgaaataagtctctaaggacaaagtgtgatttattttaacctggctgcatttttaaattgaaaagaaatacataggtttcttgttattgtgactggaaatacaaaatgcattacatgatatgatgtttttctcacacatctgagaaagcattgaagggttctgagcaaagtaatgataggatagttttgacagtattcatctgaatgacagatcaactctagggtagagtcagggagaataaaggaggctattgcaatcatctaggcaagagatgatgagtggctggatcagacaaatctttgggccttatattttagcctcctttcctagttcttcctggtagcggtgaaaagtggttgaatttggaatggattttgaaagtagagccaacagtattttctgaatgattggatgtgtggagagggagggagggagggagggaggagagaaggagggaataaaggcaaggaaaagagtgaaagaaaagtaaggacagagacacaaaggtgattccaggatttttgcctaaacaactggaaaaattaagttactctcctgagttaggggagaatgggacagaagcaggtgctgggatagaaagggatatcaggagtttcgttttagctgttatcagacttccagtatatcagattagatactaatgtgagaatcaatatagacataattaaagccatgaaactggatgacaacacctgggaaggctgagtagagagaagaggcctaagcctgttgagctctgagatactccagagtctagaaagaaggaaaggaacagccttctccttccggaggaggaggagccaatgaggtagactcatcctcaagattggggtcctggaagtcaagtgaagaaaatattaaagagaatgagtggtcagatgaagcagatttttcaggtagattaaggccaggaacattgagatatgaccataggatttggtaatgggggagtccattgatgaccttgacaaaagattgatcagagaagatactgttactgaaaataaacagaagagattataaatcactcacctagaagacgtctgaagttattctctaaatttgtgatcttcagagaggcaaactattttgcagttgttacgtaaatttggccatattatcctgtactgttaaactcagatatgttagtcagtgatgtaaatattgatgttaattactttaactgtcaacatttaattaaagtttttacaaagttttacttgacgttcctcctctgttttggtaagttgttactatgtggtggaaagggcatacatacctatacaaacagtcctaggtttcagtccaaacttcatcagttactagttgtgcaatcttgaacaagttaggtaaatttttctaagtctcagtttcctcatttggaagatgacaggtaataactactttatgtgattgtcaatcaacagtggactggattaaaaaaatgtggtacatatacaccatggaatagtacacagccatagaaaatgaaatgatgtcctttgtagcaacatgaatgcagcaagagggcattatcctaagcaaattaatgcagtaacagaaaaccaagtaccacatcttaacttgtaagtagtagctaaacattgagtacacatggacagagaggggaacagtagaccctggggcttacttgaggttggagggtgggaggaaagtgaggattgaaaaactacctatcaggtactttactcactacctgggagacaaaatcatttgtacatcaaattccggcgacatgcaatttcccatgtaacaaatctgcacatgtaccccctgaaaaagtttgaagacgagaaaaaaaaaagataccttcagaaaactatctgaagcatgtgatacaattatacatcataaatgatgtaaaagttgaggcattgatttatactccaaggtgttattttttttctccagtttttttatataaatagaaaataggacatttatttaaaacaactgcacagtcactgatattcgtaagagagattatcagcagaaataatcatgggaatcaatttagaagccaaataatctagatggagatttgtgttggattttctataatcaactgttatcaactatatactactcagtagggtgaaaacaattttaataattttgttttgaaaaaatttaaatgctataatgaattatgtgcatttataaagctgactccgtattttaaaaactttgataatgtggaaaggagtgattagacatttggtcatttctaacttattttaaaggatgaaaaatcataaaaatgttttgctatattttgtacttttgcaatacctctacaggaatcatattttatgtgtgtatgtttgtgataaatcctttaacaagttatattaagtttgcttttgatacttagttgccacctagagtttacaatagtatcatcaaccaacattgtcatctatttgcatttaactaataatcatttaaaataattggaacttagtagaaagtaataaaaaattagtaaaaatcgaattagatttttccattgtttatcttcatgacttaaaactacaaaataattatgaggctttctcagactgtaatttctgtttgtcttcttttatagagctacattcatgggagcagccaggctcagtttgtggcagaatcacacattattctggtactgagtatccttttaagataccgacgaattgaaaagggcaaactaaagctacatgtttttaaattgacatttttcctggcagtaaatatcaagacttttaagagacattaaattttaggctgtactatatgactaatttttattttttatgctaattatttcctattacggtataatttgttgctattccgtatcattaacagatcataatttttttttactgagtgttgaatttcagagtattacttttactctacattgatgatctctggctagattttttcaagtgtatatggcttttccgtatagcatcctaatggcaagaaaaaagtgccttatgatataaatagcagcttaaaaaaggtattttcgtactgctccccttaaatatatggtatgtcagaagaaggagatttagagtggttcaacatgcctttttggaacatatcagagtgagtcagactaagtgttgtgaatcagatcatacaatgtaatttatgatttggagttagaaggatgaagaatgtaacaggataaaaaatagtagcagggtaagaaaaaggtaaggttaagcatctaatgtgaatattcttagaatgaaataaaattagtttggacactgttttgggggaacattgattctcattatgagaatgtaacgtgtgcctctagtatcctttataaaatttgattactaatatcctggttactaagattcatattcaaatgtgtagtctagaccaaattgtccagtactgtatataaccaaaggtgtaaatctttaactatctttgaattcatctaggccaaacctcattttatatgtaggaacactagagcccacaaagggcttatgttagggaagcccacttgagctagaattagaattcagttgtctttttcatggtctatcctgtgttcaagtacttcagttttatgtacaatactttattatggtgtgtgacatatcatttcaccaatgaatgttagtcatgcctattatttttaatctggaggaaaaatactatctttttaacaacattgaagtttttggattttattactttgttgtgtcataacaatgcatttttaaaaatctactggcaaagacttatttgaccccttcagtttattcaagcaacctattttatttgcttactgtgttttaggcactgcatcaagtggtggtatatagtgattacggtatggtggggaaaagggatggaaaatgtttgaagcacttggaattctcaagaaactcaaagacttcctcgtttgtaaaatcaggattagcaatactgaccacacgggatttctgtgtgaagaaatgagatagcacacattaagcatccaataatcacaaaaggctagttggtgtattcctctgttttcccttctttcttactctgaactttggtggccacagataataagcataaatacgtatatatgggttgattccttagtgatatggtttggctctgtgtccctacctaaatctcaccttgaattgtaataatccccacttgtcatgggagggatccagtgggaggtaattgaattttgggggtgggtttttcccatgatgttctcatgataatgagtaagtctcatgagatctgatggtattataaaggggcattcccctgcacatgctgtctctttcctgcttccatctaagatgtgcctttcaccatgattgtgaggcttccacagccatatggaactgtgagtccgttaaacctttgtttctttataaattacccaagctcatgtatatctttattagcagcgtgagaacaaatacacctagcttttgacaaaggtgtagatgaccaggaaaaaaaaaatcatcttctaataaaatttatcaaaattctaaaacttgaaatgtaaacattgaaatgacttaatttttctagagcaacatttttgaacccgttaaattgtataacttataaggtaatacaaaggcattgtttttcaagctttaatgaaaacgaaggaatgaagttgagaagaacaagattacaaatcgcgtttatattgcaggagaacgaaaagatacctttctgaaactcattgaacaccactgaccatcttcttcctgtgtctgtctccattctcaacatttttatttctcccacccttgatgatgcatgcttggatacatacgtgaaattgggcacatctgcagcccatttcttgcttacatttacttacttgcctgtatgctttatggtttcaaaattaagaaactactgtgaggagtacttgtttggctctagtttgtctcatagactggaactggaaatacaaattttgttgtatttttcaacaaatgctcagtttctgcacacctgctttaatatggtaagagattaatgctttctgcacatcagaggtgccttcggtgagaaaaggaagtctttgtgtatatgtttatagacatatctactcctctctattaaaaaataagggcaaagctgtatttactctcgacttactatttaaagatattcaggaagcaaaacatgttaacattaaagcaaatggatagaaacataaagcatttgttgcaggtaagtttttaactcatttatttaaatattatagcttctttttgtttttttttttttcctaacttgtttcaatccatgatgtagcatcttagcagtatactttatctggataaagtgatgactatcgaaacacatcaggaataccgagctgaaggatgaaaagctgtgttgagatcatccttttattgtatggcaggaattctccaaggtttaatttcatggatcattgacatcaagctgagatttaggattcaaataaatttcacaagcagtgtgaatgttttcatatagatcttagcagtgatacataaaagaattaaaagtctgtattctctttatgctaatagtcattatttgttgcttcatttttcctgtgttttttattttagacatatctattactaagaaagagaaaaattcttttaaaatggtggactcattatcagtgaaactttaaaagaagtccaggcacagtggttcatgcctgcaatcccagcactttcacaggctgatcattttagttgaggagtttgagaccagcctgggcaacagtagggggaatcctgtctctacaaaaaattacaaaattagccagatgtgatggcatacacctgtggttctagctacttgggaggcggaggcaggaggatcacttgagcccgggaggtcaaggctgcagtgagctgtgctcacacactacacttgaatctgggcgatagagtgagaccccgtctccaaaaaagaagttatttttcaataatttctgattctagtttcatttgacagtctactgctactttttgaacaatccatattttctttgtaatttgtgtattttgttttcttctggcaaaaaattacaaataccagatgattacttttcatttatctgtagagagaacatttctatcttttggatttcttgtcccaatttagtaagtcagattatcagatgcagttgctatatacaaagttttgctgaaaaaatcataagagaaaacagatggagcattttgtatcataggttatagatttatatttactaagaataaaaatatctccatatcagtagtgttttattttttcagtatcttatttaagaaaacaatcctaagtagtctttgagagaaaactatatgaaaaaataagaaacattatattttaatatggaatataaaccatctaaaaataacttacatagggctttatatttttgcaagtaaaaattcatttttatttcatttatttttccttttgttaatgctttcaccatctaatgcaaatgtgaatgagatacttgctgtttacagaaaggtaggatgacagaaaaatacttataatacagtgagacaaatgtatgcgaaggcaaaggaagtagcaagagaggaactaactccctgtctagagaattggcactgacttttcagctggatattgaagtataaaaagtttcagagacagagaaatgggtaaggaggctatattggtagaagatacaacaggtacacaatcaaaatgacagcaaatattctttattgcaggaagataaattcatcaaggctggaatacaaattttgaggagattggtgaaagttaggttaggctggataatgaagaccttgctgagaaatttgaatcttagctacacgtagtagatgcagtgcaattaatatgccaattttatatatttggcattgggtaacttacgaattctttttgaagtattatgaggttgagccccgcatgtcttcttgataaatttggctgtggaaagggaaatagtagcgtcatgcctgtttagggaacagaaagccaatggaggcttgctcctgtaataatattaaggatagggtagagaaggtagagcaaaggaagcaggagtcgctggcagtcgttctggctgctggcaatggttcatcctccagcatgaacctaagtaagggaatggagagtgactcagctgctgttttagaggaagaagaaacaaaattgataataaatgtcacaagtaaggttcaagaacaggaatcagagatgattctgaagttcagctatgtgttgtaggatagaaatatggaggagaacaaggtttggagggcaatgtttagcccaaaaaagttcctaagattgattaggcctcataattggttgatgagaaagggattaatttgtttaaattgcttaagatcataaagccaatcagttgaagagtcaagaacttaaaacttttaacccattgtttttctacttagtaatattttgccaataaatcaaaacctctgtggtgaataggccagtaatgttctcaccaaattatatattgtgtttatttgttgtaaatatctgaaaagatcatcataataaagatacagtggatatgttgatttattttttatttttattttttgagacggagtctcacttcttggtcgcccaggctggagtgcagtggcgtgatctccgctcactgcaagctctgccttccgggttcacgccattctcctgcctcagcctcccaagtagctgggactacaggtgcacgctgccacacccggctaatgggttttttttttttgtttttttggtttttttttgtatttttagtagagacggggtttcactgtgttagccaggatggtctcgatctcctgacctcgtgatccgcccaccttggcctcccaaagtgctgggattacaggcatgagccaccacgcccggcgatatttctttagttattctatcgtatttttgtacagaagacaatatcctctagcagtataaaaacaaatgtgtgtggggatatgtaaacataaatacacacatacacgcaggtgcatgtgctttgtgctgagatacaagagtcacaaaacctgacaagatgtctgatggtgtggcatttacagtctaaaggaagaggaagacacacaacaaatgacagtgcaaataattcttcatttacaattatgttcttaaaaagttttcaaatgtccaaaattcagtagactcaggcttgaggcacatggatcttaagtggaatatcatgaagtgaaaatatgcagtttttgaaaccataattggaagaattagtatgcatatgaaatatataaaattgtgtttaaaactctttatataatttcccagagtagagaatttgaactgtggtatcaaatgataaaattaaggtagggtatgtttttgattatagaatgttcttaaaattcaaaacctcatgtatgattttaatgagataatcttaaatctgcttttcttactaaatacacttataaatatggcacaataaaacagacatgtaattacaagtagtggttttctaaaataaaaaggcatcttcatttcacatttagagaaatgtttgcagatatgtatgattttactgtcctaactaatctgcctttttttctatcaatcagtagtcagtccaggaggggcagaactatgtcatttaaaattttatttaaaatttcaaccagatcaaattagtttccgtagacagtaatgttcccactgaattcaccaagatatggtctctctgtatgagtggatatagaacacgtgagttctaggataagctttagtgtcaactatataatctctgacctaagttagaagatctcaagaaaatgacatgaaataaatattagttagaagtaaaattatttatataaaagtaaaggttatactagcaatttaaaatttttattcttataaagataacattgcattttctgtgagcaaaacattttttccatttattatgaaagaatatgattttattcgcatctgtttctagtctattatagagagcaaacattccttttaatgtgttatatccaaggagaaacatactatagaaaaaaattaatgatagatgcagttgaaaattttagatttagaattctttaagtaagtcttctataatgtgctaacatttttttcaacgtctatttacatttatctatctttaaattgaaaacatcttgattccattcctagtagcaacagtaaacttagcatatgcaattgagaagggattataatgttttgtaaatatattcgttactaattctgtagaatgctcagtgcctctgggtattgtatgtaatttacacaaatagcagcttttttatgtgggatcatgtcagtattttgactaagcagtaggaaaatgatcaacaggatcagcaaagaaactggagtgtgcacagtagtttaaatatatattgccatgatattaatcaataaaaatgtgcaaagtaatacaaaaactaggccaaagtatgtgtgtataggataaagggtagaggtccatctgttattttcttttaatgctgggatattccaataaggcaaagctagacggctacacccatcaatttaatgaccaaaaaagaacgtaacattctttttggtcagacgtagaatcttttcagatttggagggtctttcattaatcattcagccttccactcagtgaaagaaatgccacgtaagaacagtgagagatgatcatctagcttcttcctgcatataaaaattaagatttttatgttacaaatgtaattttccccaaatggtaagtattattcagtctctttttcagccaaaaatgtttcagttaatacaatgaaatttaagctaaacgattctcaactcaactcctaaaggccttgagttaaaaaatgtatctttaaataatagggagggttagcgagcttaaagccattttagtataattcatatgtcttaattacacccatcaggtttttaaacggctcactgctcttttcttgttaaagcttagaaaactcacttttgcaagaaacattctgagaaagagatcatacttacttactgaccccgctgatttctaacaaaacattttatcttgaggttgtatataacctatgtctagtaatccctttgctttaaaattcccactttaaggttgtgtgcacaaatgtttactaaattcttgcattttaaaaaattgtcaagtaagaataaagctaaattccagtgagacataatggtatacagtttttttgacatcaccttaaaatctttacagcagggtttggcaaactaggaccagttcaggcccaatccaacctgcctgctatttttgtaaataaagttttattggaacacagaaacacccattcatttacgtattgcctgtgactacttttgcactacaacaagttgagtaatagcaacagactccatatgacttgcatagctggaaaatacgtgtgactctttcctgaaaaagtatggcaatttctgctctataggctgtggtcaataaagaacacaaaaatccacacttttattaactcacccgtgaacagttactgtttttatctttcattccctgcaatcatttctttgcatttgttttaaaggagtcaggttttatatatacttttatacatattatacaaacatatacatcttttcacttggtatggtgacaaaattactattaatatatcttgctttttttttttttttttttttttgagagggagtctcactctgttgcccaggctggagtgcagtggtgcaatctcggctcactgcaacctctgcctcccaagttcaagcaactcctctgcctcagcctcctgagcagctggcaccacaggcacgcgccaccatgcctggctaatttttgtattcttaatagagacgggatttcaccatattggccaggctggtcttgaactcctgaccttgtgatccgcctgcctcagcttcccaaaatgctgggattacaggcgtgagccactgcgcctggcctcttgctttgttattaagaatttttgtcaatttcattttatatggctagttaacctgtcacaaaaatatctcatatgttatagttggacatttacattttaatttttcactatataaattattctaaaatagatttttgtatgtatattaagttttttcagtattttatgttttgccttatttatttgggaatagctttataggagtgtagttcatgagcatacttctggcacatataattaatgataattgatgatttgctgaggtttttgacatgctgaaatcttaaaattttcatgttgacttggggtttctgttccatttctgccctgttaatagggagtctgcatatttttttaactcatataatttgaaaaatgctatattgttactgcatttgctcccaacaaaaatagtaaattataaaaatgatttaaagcagcgtgaaacataagtgatataaaggtaaattcatagacatctttaaaatggcaattttgtgagttattgcaaacttatttgtaaaatctggaatatgtttatggagtagtaaaatgtatttgaatgctctgtgctttatgaagaagatttttattcttagcctaaagatatttcatgctgaaactgggctagcaattatgttctttgcccaatgcttgttatcattttcatctaatcctgatatcatcttacttcattacttttgtgcttttttgctttgcatctttcactctttagttttgtgactttgagcaagttgtttaaacttctctgggcttcagtttccttgtttgtaaacagatggtaatgtctacatcagagagttattggtactgggtaagatagtgaataaaacaaagttcttgcccttttggagctaaaattgtagtgctggaacaaagacaataagtacattgtaaaacgtatacaatctgaaatttctttcaaaaacaattttataataaaaaaaaatcagagtaaaggtgagaggaggcttctctgacaagattgaatttgaacagagacccagtggaagtgagggagtaaattacatggccatcccagggaaaagtacctcaggcagtgggaataacaagttcaaagatctccttattacctgacttgctttgaaggtattaggagaaaaggctagaaacctagaaggaggatttaatttctaaagcaggaaacaaccaccaaaactcataaaggaaaagatgcataaatttggccacattaaaattaaagttttctacatgacagaataatttaaaatacaaatataaaggagaatctgaacgcaatacttcagtcaattcgtatctggaaaaaaaaatgttgtcctccaagttaagaaaaagcaactgtgcttttggaaaaacgggaggaaaaaaaaagaacaagcagtgtgccaaagattaaacccaaaaaagaggaatgaacatatcaaaagatgctcagaaccaagtggtgagctattcgtacaactcttttccttatcagtttgataaaatcaataattgggtagtattgtgttagtgaaatgtaagaaaacttgaactaacattgctcattttagagagcagtatgattgtacgtagcgaatttgaaaatacacttaccaaacctctcaaaaattccacttatggttatagaccgtggagaaaatattgcacatgtacactaggagacctgtgaaaatatattctttgcaggaatgtttatagtagcaagcatttggaaacaaatgccatcagtaagataaagcaataaaatatggtatactcttacgaaaatgtacgtaattttctgttaccacattgtttgaatttaagcaattcaaatgagaaacatgttactcatagttttcaacattgtaacaatacagagggagagtagtaaaaatgatatgaagatacatttatagggatatgttatacttgggtgaccataattaatgccctgtaaaatatacttttccctgagttcatggctttgtgtgtgtataaaccgataacatgtttgtgtacatgtgcatttatatgtgtataaaatttgaccctaagaacatactaatatattgctttactcccattaaaactgtcatacattttattttgtaggctttattttccccagtaatagaaatactgccatttcccccatgattcattaatcgaattgaggaagctgcttattagatgaatcataaaatgaatgtatgttttacttttaatgtctacataaattcatcttaaatgccatttatgttttgaatatttaaaaatgtcatagtagctgggcgcggtggctcacaactgtaatcccagcactttgggagaccgaggcaggcagaccacttgaggccagcatggcgaaaccccaactctactaaaatactaaagttgtccgggcatggcggtgcactcctgtgatcttccagccactcgagacactgaggcatgagaaccgcttgaacctgggaggcagaggttgcagtgaatcaagatcgtgccactgcactgcagcctgggctacaaagtgaaactgtgtctctaaaaattaaaaaaaaaaaattaaaaagtcatagtaaaataatctgcaattctatttgaattattagtttaaatatgtgtatttaaatgtgtagataaaaatttatacatgcatataaaagatattgcagaaaaaatgattaaaggggaaacttagtaactccttgttaaggatccatatcagtcacatctatctgctctagaaaactgagttttaagcagtagaaatctcctacatatgaacagttttagtgaaacaagtttttaatttttatcatgttgttattaacaatgtcccatgtctgtggattcggggtaatgtatacaagtagatggtccaaaacactttaagaataatggatttaatttaaagtctacagactaccatactgatgatacaaaacagtcattctcttagaatattcttttcaggctactgcctacatgattgaaaggcaggaatttcatagaaatttcagtgtttttcaagctgtgtagcatggatctctaaaagtttagtgctagtctatggtatgtgtatggtgggaggggcttttctcttgtatatgttaggctcccaaacataggtttttctttattttccttttttctagaaagggttccaaagctaaaacaaatacaatagtttgaaaaaccgtttgtatagagaggtcatggaagcataaatgccttactagagaagtcaggcatttatccttatccagaagttggataatatggtcatgaagacagattcaaatatgaacattataatttattactaattagaatttcaataatatggttataaaaacaagactcagagaggaaatgttctgtgcagaattttctctgacctcctccacttgctggtatattgcccaatactgtcctttgagcttttgttgatagagacatcctgcacaggagattcattgatgctgtttatacacaaatagcagtagaaagaaacacaagggaatcataatgaaattaagcaaattgaggaggttctgggctagaattgcttcatttttctcttcaatttttagtccattaatcgcttgggcgaaatacatattttcagaattgatgagttctaaaatcttaagagtcgacaatgtgaaaaatgttgtaatgacatggcaaagaatgtttttatgaagatgaaaatttcccattttcttaattctggcattattcaacatagcatgaatatatccatcctgttgcaagcaggtgttaaaaacaagtaattttgtgatctcattcttaaggtatcagttagctgactagctcagggtcctgctagattcattaaattgttttattataatatgcttgtctgcttttgtaagattgttaattgtataaccccagattttcaagtgacatgataccggaccttcataaagatttcaactaaacaaaatctatgaaaaaatgcttttagaagaaaaagctgtgtacacacacgttatgaaaatgaaatgtgtcaatgacatgtgtcatgtctataagcagtgcatatctttatgtataatgtgaaatgtggtaactggttttgagagtccatatagtttatatgtgctgtgaaaatcctggaatttaagaacctttggaattagcctctcaatatatcacaaattgaagtttcaggttataaatttttaaagttaaggcatatttgctcacaaagaatggtaattttatgttatataaaggtaattgattgtatttacctctgtgtgcatttgtagtttaaccattctggaacattgtgttcagagccagaaaaattaatagattttattcacatctatgtctacggcttccttgacaactactgcagatgccgctatcaccatggggatggttcttctaaatgaagcagcaacttcgaaaggcgatgttggaaaaagacggagtaagtctctgtgttgccatttttgtaatttcgttttagtcttaagattcatttaagtcaaatgggaaatacataaaagccctttgtaaacaaacttctaaagaaatgttctggtttgaagaagattttaacttttttctattgctgggatgtgttcatatacttgaaaatatatttcttccaaaggggactgggtcgttttctgttgatttgcttataaagtggagctgtccttcacccttgtcagggtgctctaatccatccctgctgaagccatagtcttggttgtaattccacccggcacagagagatggaaaattttgagggcagagtcttcagagattttattggcatgtaacatattccctctgctacaagaatcaggggtgcgctcaaagcgtgacttagatgaagcttctgcataggtattgtacagtgagatactcttattacctttctattcgttccaaagcttcctttaacattttttaaaaggcatctattgatactatcttttccagggtctttgccttttccattgatataccaagatttacaactccctcaagttctccggcattatgtttttaagcaagttaattctgtggcttttctttgatgggaccatttctctcagagttgtagaaaaacatatatgaggtttttgagaagtaaagagttttctagcaaaaagagaagaacacacagggaaaatgtgctctgaggagcaaaggacagtcgattgtttcctgccacagacctttttatagttaatatcaagtccctatatgatttgatatgtccacagacctgttatttttttctttctttgcatttctgaactctctttaaaacccaaaatttatgtatgagcagtataggtatctgaaaaagagtatttattaagatatttaaaataaaaatccagacttcatgggtttttagctagggtgacatgtgtgtaaacaaatcatagtgctttctaaatacttaaaagtcttaggggtagaaatgtttttgatgtaatacacagtttagactgccctcttttcctatggtatcatctattgtattaaagaaactacaaaagaaaggagattactttatcatgttgaattttatttatttatcttttgaataaacaccatgtccttaggattgacaaattatgcctatgaggacatactatttttttaataatttattttagatttgggggtttatgtataagtttgtcccatgggtattttggatgatactgaggtttaggtaaggatctcatcacccaataatgagcttagtaccaaacaggtgatttttcaacctacacgctcctcactccatccccactctagtcgtgtctgttctcatctttatgttcatatgtacacaatgtttagctcccacttacaagtgagaacatgaggtatttggttttctgtttctgtgttaattcacttaggataatggcctccagctgaattcctattgatgtaaaggagatgattttgttctttttggctgcatagtattccatggtgcatacataccacattttctttatctagtccgtcattgatgtggtatatatgtaccatggaatcaacctgggttgatttcatttttttgctgatgtgcatagggctgtagtaaacataagagtgcatgggtctttttggtggagtgatttatttttctttgggtgtatacccagtaagggggttgctgggccaaaggtagcactgtgttaagttttttgagaaatctcgaaactgttttccacagtagctgctctaatttacattcccgacaacagtgcataagcattcccttttccccacgacctcaccggtatgtgctttttgactctaatcatagccattctgactggagtgagatggtatctcattgtggttttgatttgcatttctctgctgagtaatgataatgaacattttttcatatgtttactggccacttgtctgtcttttaagaaatacctgttcatatcctttttctactttttaatggggttgttttttgcttgtggatttaagttccgtgtagattctggatactagatgtttgtcagatgcatagctagcaaaaattttctcccattctgtaggttgtctgtttactctgtcttgttgttttgcggtgcagaggctcattaatcagtcccacttgccagtttttatttgcaattgcctttggagacttagtaaaaaaaattctttgccaaggccaatgttgagacaggcatttcctaggttttcttctaggatttttaaagttttaggtgttacatttacttttcatctatatggtgaagggtaggggccaagtttcattcttgtgcatatggctagccagttatcccagcaacatttattggatagagagtcctctccccattgcttgtttttgtcaactttgttgaagatcagatggttgagagtgtgcagctttatttctgcgatttctattctgttccattggtctgtgtggaggagatactgttaattatgtgtttattgtatatcctgtcttaaggtaaataagaaatttgtagtaaatttttaaatcttacaatatttattgtagcaatatgatactcaatttattaaatcaccgttttcaactcctctcttggtagatgtttgtttctctaactccagctcccagccacccccaaattaattattcatgttgtgtatgtgcttgtgtgtgtatgaaagtgagctggaaaacatattttaaaactttcaaattattcctttttgatgtgatttttatttttgatgtggcacaactactatgattaatatttcccaggtcagaatgcatctgcctcattatggcattttattttcacaggtgtagtatctcatgtggctgccgtggttcctttaataattattaacccctccctgcactgagttcctctgccttcccatatacaagtacttgagtagcattattttgttccactgcataggatcaagtaattatcttctgtcttacttgatcacacatttcaagcctcatttctgatagagcacaacccaatggggctactaaaaaggagcaaagggaatgaaaagagtgctttattcttctgaaaaataaaaaaggagatggaaggaaaagaaaagaaagacgtgttagataaaatgacagatttgggaagtatagagtaaataattttgtaattaattataggtttttataaacaaagttgttactatgctgtatctgggtcctggtatgtgtcatacagggatattctataattttcaaaaatgttttttttattttatgatactcacagactcattttttgctttattttctcccaatattcatttgaagttcagctgcatgagtgttgtctgaaatgaaatgtcagaggctacacttggatgctattaaatgtttgtgttgtttcacaattcatattcaaaacttagaagatattcctgtagagttgcataaaaattgacacatttgcagaccatattttgacaaagccgtaccttatgtactccatgattgccagaattgcagttaaacttggtttggtttatatattggaaaaaattttaaaaatcatagttccttattatagaatcatatagatctgtttgattttccttattttcttctgctttaatctttctctattttacaaataacttcaaatatttttcaaattgtttagaattctctgaagtgaataaaaggtgtattgtgcaaattatgtgttcttaaaagatgtttagatatttcttaagagattaacactaatttctacttatatatttaaataaattttatttaaatatctttgtcttttattctaaacgtactttaattggctcagattaagtatttaaattttataagcatgtttagattgtactaactgcagtgaatcttgtttaaatatccaaaatactatatgcaaaagaaacatattttattatgcatctgctttagagtaaaatcttctcaatcatactaaaaaggaaatgagaaaataaagtactgctcgtattttcagctttcctgggacagaggaatattgaaaacctagaccgcagcacattcgactataacatatgtcctcagtttctttgtaagacaaacagtaacaatattttgacactactacctgccatggagggagttttctcccctctggttttcacttagaccatattttctctctccaagcttttattccttgctttctataacatgctcttactgaggcaatactaaccaaaaacctaaaattattgcatagcatcggaaaagatcaaaattatattaagcattctaacaatgcaaatgttcctgctaatatagccaatgcttcataacgcaagaggcaataatcttgtttgtggtttataacatgttttgttttgatcactctggggcatgttagtacttgtaagaactctataaaagaagaaaacctccagaagacttagatcagtcaattttgttgttttcataccacaaatagtacattttcattgagaagacacaaatagtacattttcattgagaagaatgtggaaaataatgaacacattggatacctgtatccaaatacctgtttgttgtacctgtatgtaccatgaactgttaaatgtaagtatactgtaattgaatgcatttaaaaatataaacaattggggtttcatttgcatatttttagacactaatggtattttctgtctgtttctagtaatttgcctagtgggattgggcctggtggtcttcttcttcagttttctactttcaatatttcgttccaagtaccacggctatccttataggtaatatctttatactaacatgaatgtttttatttttaactaatagaacagagtttcagtggttaatatataattaaggatgaatgtaaagttgctgtgtggtttttttaaattcagttaagcaagtttttgagcacctgccatgtgttcagcatagtgaagtacacaaaggagatataaggcatggttcttgttccctgacagcatgtagtttctttctagacatacatatttttatataacaaatgaggtttaagctcattttgaggacttgaaaatttttatcttcccttagtttgtcgtgatttcgacttcatttgcaagattgttttctcatataattcactgttcattgtctaataaactttgtattatcttttgaattctacaaaattttaacttttcaaaataagagccaacatgaaagggaaaagttaagtaataaaataatttctggtcattataaatcatcataacgagtatctcataagattttcaccaacaaatatattgaaaattcaaaggccgcattattattaccaaactatagtttcagtaaagcacactacagaagaggtgcccgattacagttgttcagcttatgaattaggcatatattcattcttgagctttttcctccttcaagttttcttaaataacttaacatttttttctttctctaaggagtccttcttttaggttagctcatttctaatgagtaaaagctcagtatttcctttttcagagattttgaagactctggttaggtagtagaaccagtgatatgttgatagaaaataaaagctcctcaaagcctacatttcttccacctgtgagcagtggacatttttagaacgtttccacacagatcatagcagcaatatatagctttatcagggaaaaaactaatcccataaaagggagatctgactttgggattataatacaagaataagacccttcagccccaccccctctattttcatatgtggccagaggtacatttccaattctcttcttcccacacccattaaaaataaatataccaagggaatggaagaaatgtgggtatcagattttctgacaccctgcctgcagtgtaaatttttaaaaatatctgttctgagggcagcaagggttatgagagaggcaagcagagtcttcaggtttttcattttactcttgactttagagagccagccaattttggttttgatgatgtgaaataatcaaatccaagattaagtaatatccaagaaagatgaagttttttttttttttcttttgccctgctctaggattgagaatcatgtttttgtatgattggtacttagtttggcctgtgttctataatggaaactgtaaattaagaaaaatagaaatcctctgtattttatctaggatgccaaaaacacttgaaaattaatccattttcatctatagcacttatagtttcaaaggaaatgttgtatctctttttatgaaaagataaactatacagtaagtgatactgtgagattttttttttttttgaaacggagtcttgctctgttgcccaggctggagtgcagtggcttgatctcggctcactgcaagctccgcctcccaggttcactccattctcctgcctcagcctcccgagtagctgggactacgggtgcccgccaccatgcctggctaattttttgtatttttagtagacgcagagtttcactgtgttagccaggatggtctcgatctcctgacctcatggtccacccacctcggcctcccaaagtgctgggattacaggcgtgagccaccacgcccagctgagattcttaagccctatttagttgacaggaagtagggaagggtaaagggcaaattctaactttccttgtatatcagagcatgtaatgatactaaaatatcattccctatctagattattatctgacagcaatataatgactaggaaaagtggagaaaaaaatattttactagttttttataatgttgcacttgacagccctatttttgttacgataggaagagtttaagtttgtacttcttttagtttgtactttttttttcaagtagtagttgtcatttagtataataactctctactgctctggggttatgttgttgttgtttttaacggaggctggacatagaaactacccagaaagctttggaaaatacatatccttggcctcaccatagatataaatagtaagcacatctgaaccagcatacatgccacttacgttatttctgtgtgaatgtggcatttgaacagtcttcttatgtaaccagccccacactcctgtcagctccccaccagcctaacaggagatagatttgccttcagcaggcctcataatgctagaaatatagatgaaactcttgtaagaagtcagagatggaaattattttttagagtggtttgtgaatatgaaatttgacatagtttagatgaaaaccctaaggaggagctgccaagaaacagaatcagaagagagcctatcaaagaagcttgggacaccaggtgtgctaaacagtgtgacctgctgtgtagagaaatggcaggcaggcctctggctgctataacagctcttcacagtgctccatcatctcctgtgctattgtgtgggtttacgagattgacttaggcaagctaaatagagtttgggttgctctgttaggcaactttagattcaactagccaaaaggcaatcagggtattttaggtaatgggaggtttattggagagagatatggagaagcaaggaagacaattaaaaaaaaacctaattgccacatagctaggtgtctcagatgttggaaaaagttcagaaagtaggtcattcaacaacagaaatccattgcttcagaggtaactcaaatggctaatctcttgctccaatccttccactattattactgagtaatgtctttatactgttctcttcagctgattagagccttctatgtccctttggctcccacctatatatactaccggttctcactctctcaacatgattttgtgaattttctaggaggaagtgattggctaagtttttcatcccccagtataggggcgtctgatttaagtagaactttgaagccagtctaccctttggactccttggaggtgttcaaagagctcactgaatgtaaattaattgtctgtttcttaggcacatccaaaagaagccaaatacaatgacaagtacctataaaagttaacaccaccaaatatgtgaccagagtagtatttaattcagttcatgtatttgggaaaaaggtgtgcaggatagatctttgatcctaagagatcgttctcaaaactctgtggcttcttattcctacaccatgcacagctgagtcagaatctccaagtgtgggttttaagaatcaggtgaatagttacccaggtaaatctgatataaccattttatgagcctgtcttagggaactaagtgataaaggatttcacaattgcctctcagttttaaatttgagttgttaaatgctttatagacatgccgtggtgcttactgtgaaatcttctgtttggagaaaatacatacatccatgaaccggggaataacaatataaagtgtcacaagctaagtggctggcagatctgttgtatggaaataatttacaggtgagaaagatcactgtgggtctgagaaaggaagactccagaagaaggcttgaattaggctaaaattcaacacagcatttagacaaaggagagaggaggggctgagggtatttcatgagccgaaagtcataatttgtgtacaaaggaatgggaagagaaatatgttcatggtatattctgaggattatgagtatactgctatggtgtgacagccttaatatgtactactcaatagtgaacgtttctggtttaaaatacattaattagacagaaagaaatatatgaaaaggaagatatatacacaaaaggaaatattcttaaccaatttgggtgaattttatgacagttctctaattcaaattctagatgtttgcaaaactaataattatttttccagatgagtttttgggattttttccagaacatcatagtgttctggtattttagtactgcaaaggatcatggagatcatatcactgaaattcattttatagatgagaccaagagagtatctttattttatgacagaagcagaaaatctgactctgcttacttgtctctcctgtgccatgttttgtgtagaaaaacgtgattcgtatattcctataagtagaaaattatcccagaatcaaagttgaaaataacatgaggtcaaatgtataatgacctcaataatctgatagccaaagcctctaagaaaaatgttgacaattagataaatgttcagcaccaagataataacttactttggcctcttcaattcttgtgagctccagaagttcaagagatgacgattttactcaaggaaaaacttccttattcttgaacttggtacaaatatatgcaatgaaacaaaaggaaatctacataaaaactaagggacactgacaaaatctacttattaaacaaatttaagtaatttttatatcttattctttactaatgaaagctgctatagtttacatagatgtgattccctttttatgttttttctaatcctataatgttctcttcatgtatcctcagatcatttctgagatttgttctttcttatctgaatttcatgacttagttatccagctattctactgtccaatttaaaaaatccctctaattatatcttcccagatcacattaaagccttctaatatgtccgttcagctcttttgagaactgtcatttaatcgttttcctacattctatggatatactgtaaattgttcagcaagctttcataaatccttatggtgctcacagataacccttcttgtgatcattcatacgtgaattattttgctctctcaggtttatatagtataactgttcccttcatgacatttacagtatcctcctaaaccaacaaaatacagtggacatgggagcattatgaacaaaaaaccagttttccatttaaaaagttttaatcccttttgttagtctagcacatgtatatgtgctaaagttaacttagtaataatatattttacttggagtcatctttttattccattgcattagtttccttcttaaataagctttcgttttcttctcagttattttatcaactctcttgtgaatgatgatgataactgcctgacaaacatcgaaaacaaatgtgactaaaagactgcagagatatatagcagagatttggacacaccctgagccaaattacaaaaacctgacagtacagggaaagcaaatatatatctattcaattagttaactaaagaaagagcaaatgtgatggcaaaagcaagtgtcaaagagggaacaaatagagggaacaaatgaaggagaagaagaaataattctgatagtagttgaaaggtgagatactgataaagaagagaaagaccttttcccatcgaattatcctgtggtgaacatagcaccacgttgttaaagaatattttggtattcctggaagcatttacctgtggcaccagcattatatgacatgttttaaaaactactcacatcagataaaggcagtctgtagaaaacgagagaatgaaatgcaggaaagaattattctagaaagaggaaaacgcacaacacatactcccgaaggtatttcctggcctttagtacttctgcaaagacatttgtagatgtccattttctaagaacattaggctgtacaatagtaaatcataaactctagggaccaagagctgaaccactccaaccatccaagacagaaataaatacattgaagtaggctgacaagaggagaaaaatagtttctcaaccaagactctatccttgacttccccaattttaacatgaatacatgttgcagagatcaactgctagtacagacacacattcttcttcacagtagctcttggaaagcttcctacttctactttggatcatacctgtacttgggataagacacttaagttaccctttagtgaaaatgcacatttgaacataacaccttctactttttttccttttcttaagaaaagcacctttagtaatggcctttaggctccaatgccaaagtacttgcttgggtgttatgcctccgccttttagccctcagtgtcttcgttttgcatttttgtgaattataaactgttgtaccactgatatacaggactgtatccataattatctttatgtacagaaccgtgatcataattgtctttaaactaattttttttacattttttcctcacaattttgaattttatttaaaatacagtccttaagttcttctatctgaagtgatcctgttcggcttattcatttttattttaatcttaagccttacaaaaccttaaacatctatgcccttcatcatattttttcagtacttcatagtactttcaaaattgttgttttctttgctgacacaggtacctgctaaaggataaaaatctactttaaatatttatcctatagtcttaaatcttcccctaaagtttacccttaacagtttacgtatgaatctgtctcatgccattactaaattctctcagattgtcttttaaatttaataggcaaacttccctgattggaatacccagcctgctcgttactagctgtgtgaccttgggcaagttacttaacttttgtcaagctaagttctcatttataaatggagatgatttgtcatatgtcgttcaactattagaaagattacatgagagaatgcttggaaatcacttagcacattgcctggtacatagtactgattactcaataaatgtttgatgctaattatcattaattctgatataaatatttaaattcatttttatttaatcttctgctaaaaagtttttctttacgctaaagattaagtagttttgtctcatagttgcatgattcagttgaatgaagaaaagattttccctgaaccttttgatgagcttagttgggctcctgggtctcttgaaattgtcagtgaaatagtagggttactatgaatttgatctaattaccatctgagccagcaattataaacaacagtttataattcacaaaaatgcaaaatgaagacattgagggctaaaaggcagaggcataacacccaagcaactactttggcactggagcctaaaggccattactaaaggtgattttcttaaaaaaagaaaaaaaaaagtagaaggtgttatgttcagaaaggaagaaatatgatttcagtagtagcaatgaattcattttatatattacatgaactttagtgcttgccccattttctaagaagagcaaagtgctagcaaggacatcatattcttcacatatgggtaactaccttatcaatatttttcactggcactctgtgctcacaaaagtttcctttagaagatgtctgtagtaacatctaagatacatcaagtctctgcttttgagacatgagacatttctagtaattctgtcactttgcttcctaactgttcattagactctgtcttagggaggtcgtatgatataatggaaaaataacagtaattaggagaagacccgagctcaaggttggggtttaattctgtgtattagctagagctctagctctgcatttagacaaatccaggtttgaattttggttcctcttaactaactttggggcttaaagttagttacttaacttccaagtctcatttttctgcagctctagttacctctctctctatatttaacttggttaagcctgtttcttaatctgtaaacttggtatgataaaacctacctcagaattttatggggataaattatataatcagttcgtagtccctgaaatgtagtaggttctcaataaaaagtactcactttcacttacctcctcttcagctatactagccatttcagcaactgattattcagtagtactttgtcgcattatgtttttcattaagtattcatttacagttgtttcatgtgtttgtcttttttttctagattataaggtatttgtgtctttgataaaaaccttttatatatctccaaagtgctaagcacatagtaggtgctcatcatatacttgttagttgaatctgtttacttgaaaattttattccttgtctacttccattaaatgcaactggaaccattaaaatacaaatacagtgaggcttattggcttgccacagctccagaagatgcagtccataccaaatgacaccccctggagttgtcaggttgttcttcatagttgaaggtgtgtggaaaaatagttagttattccccaaactcgagctctaaagctaactatcatggctgggcgtggtacctcaggcctcacgcctagcacattgggaggctgaggcaggagaatttcctgaggccaagaatttgagaccagtctgagcaagatggtgtctctacaaaaaatttaaaaaattagcctggcatggtggcacacgcctgtagtcccagctactggggaagctgaggtggaaatatcactcgagcccaggagtttgaggctgcaagtgagctatgattgtgccactgcactccagcctgtgccacagactgagaatctgtctctaaaaaaactcgttcttaaaaaagaggtatcgcagttccaattctaagctgggtgataacaagtgaaaaacagaatatataaattaagcttacagtggacacagaaagtggcttccattgtcttaaaacgaaactgatagtttctaatgtcgttggttaccttgagatgaaaatggaatgatattcagtaaggaaatgtacagaataacagctaaaaatgaaaggcattcataccaattttgaaaaaagtatgatagtgaacaagtacagcaaggcaaaaattccagcatgtagagggtatagcaattttgcattgatttgtacatcttaacaaccttaagctgtacaaatagaacaataatatctaaatggtgtgatgatcagcccacagtacacatcattgatgagaatttcactggtctcaacctttctcatgctgagtcctggctttgtaaaatgacttataaaggtccaaggatttagagatgattaagagataagctggcattctgtaaaggcaccatcgtctatcccctgtcttatctagataaagaatgtagtgctaaatcttgtaataatattgtacaaatggaaattcaatcttaaggattattttttccatattgttgtatttcattgtggtgtattggaaagtgatctggactttgagtgagaagatgtgatttggaccatggcacttaaaaactctataacctcaggcaagtcttttaatcttctctgagcctcagttttcctcatttttcaaatatagagagtataacatttatctcataagacaagttgtagtaaattactgttttacaaatgtaagataacttttaactgtgagattccatattccagtcttacattattatgtttatctgccacagggagaagtcctcagataaaaatgtctaccaaaagactgacacgtggagttaatcatttgacagatgcaatgcttccacccccaacaaatatactttcttaacttctgtttgttatcacttagggaaaaaaggcagtcaacaaatatatttcattctatctaggaaaaatgtagccaaatcttttttcccattaacaaataatgtaagccttaatattcaagggtaataaaaaatacaagtcttccaaacagttaacttactgaaaacttttttaaaatcaacatttgctaaattcagaaacagatagtaggtactttatttatatatatataaaattactgtcaattttatatatatataattttacataaaaatataattttatatgtatgtaaaattgacagtaattttttgcagaaaattcacaatccagttttttgattccacactgcacatcccaccccctcaagaccagagaacacagggtctaggctaacacatcaaaagcagctctggagacttaattccattgtggtaatacagccttcttactctggcagaagctccataccgttcagcaacccactgaacgtagggaaggaatgggaagctcctgtgttccaaaagagttctgaactggctcttcatctgtcccttagcccctgcattctagttttattgttcttctccccccagattgactatccatgttctggtcattcctcattgttaaatgtggttaacactttacataggcctctctgtggaggctgtgtagaaaattggcctgagcactaggagactggactgctgttgccccatgaaatgacagatctaaaaagcttccattcccagagatgttttcctactctcaataaaggcctagatttctttaggcctttttagaagaccacttgttttagactcaaagacttttctgggtttagcaatcttctattacagagaagagagccccaggacttttggctaaagaattctagctaagggccacaatgtacttctcgctagcattctcatagaacacatgtgaatgtagagtagagattaaaaagaatgactcagtgagttacactacccacaaggtcaatgggccggaatgaaaattcaaccactggcctatctgtgcttagtgaacaacccagaccttttttcccgtttgcaccttttttggataccaaatgaaatctgagcagctgccccttacccacccacataagtgatgtgagacaggtgacattatgtaaccactgggtcttcctgacttcctctccagtttaagaacaggaagagcagtgcacaaatatgttctgtcgagctgaggatatcggaacttaaccggcttccacttggacagaatacatttgttccagaacactgtgtacattctgggttttccaaatatgagaaacagatggagtcattaattcaagataaataaaaaaaacaaaacaaacagcaagccattatttgctacctgttcagatatttcacaggaagggaaaaggaacaaacaagcttttgatataccctcggtctccagtaaccaccagtgaccaaatccaaagttctcttcatgtgacctttctagcattttagttgacaagcccctcttggaaacttcataccctggattttgtaacatggcattcttacaccttccttttttctcttagattatttctcagtcctgaatatacattatcaagtcctgacctttctcatgacatccagaaccagacctgaataccacattaacagttcacctcactacgttaaaaaatcattatcatctgcctccaaatctctttctccaccccttttccccgacactgtcattgtcacagtcacacaagatggaaatcttgaagtcattttgtcctcatcctcatccttctttatgttatttggcctacattacttttctgttcccacagttgctgtcttgagtaccttgtgtctttttctgactataaccgagcctcttaaattgtctcccggtatctagtcattatcccccataatacatcacttattgtagggtagtgtcagaattattttaagatatgcgctgatcatgttgcttcttcattaaaattcattaatagctaataacaaagaggaaggcaaagttaatacatgttccttctagaagatacaggtaagcaaaatgaagaaaatatattcataaatcccaacacccaggtcatcaaatgtcatcagtttagcctgtacatattttgaaccttgggaattatgtaatacatattttgtaagctgcttatttttcttttatacatcatgagcatattcctatgcagttaactacattctacaatatatatgattttacacctatgtagtaatatcaatgtatgaattgccacaactattttaagttttatgccatccagctttttatggtgtatctttcagtacaccctgtggtttaatacaagactaagtaactgctgtctgtgttagtttatcctacaaactaagaatggcttctacagttctaaatcattggggggtgggacgtcaacaaagaatattttgtgacatgaaaattatgaaattcagatatcagtgcctatgaataaagtttcattgaaacgcagccaggtttgttttatgtgttggctgcttttgcactacgacagttcagctgagtggtttcagcaaagacccatggcccacaaagtttaaaatacttaaccttctggctctttacagaaaatgtgctaactcccggtttagccatgctgaacacagcactgaatatgttcccatactttcatacctttcctcatccagtttcttcggtcgaggctgctgtccctgcatcttacttgttctcagagttttgctttttcagttcttgtaacaccgtcatcatctcaaatatgtcactgtatcatacttaatcacacccaggtctttcctttagctaaaagaaatgtaagggccatgactttcagtcatttcattttctgcaacatgcttctatgcacagaatctagtacacaatggttgttaaatgctgattgaaacagacttttgggggccctgagattaagaaaatagctaacacttgcgtgtttctctagaaaaatcttttgaatttcaagtaataaacttgctaataaacctatggaatattaatccttagcaaatcaaagacagcattttcatctaaattgtggttttctaccatgagggagtgctgaggagagagccagccttaaggagagaaacggtttgaagtttcttctttgtgtaaacagtctctctgcatccctgatggactttaagcaaaaataaagtgacacagactagaaaggaatggttgcttctcttaggctaggggaagtgggagcttctgggggcacatttgtgctagtcctagccttctatctatcttatcccttgtgtgcgatttgctactcttgccaattagcttccattttctattactatctcagttacagttgaccatgcatatattctcttcagaatacgcgaataagccagtcacagcaatcagtgctatgcacatgcagactactactatggataactacagtgcgattcgttcatgactgagcgtggagcagagtccacacagaagttgatcgtggtacccaaggctgcttctcactcattctggaagcagaccgcaaaagtgaaaagcacacatcaggggaatacattcagttttcattattgacagttgtttttaaaaaagtatgatacgaaggcatttatacatttttgtgataggcattattagaaaaaacaatatccaggcactcctgaaccataagtttgtgagaactattatactgttagattaagaagcaaaagtatttattagacagataaatgtgaaaagggaaaaaaatacgtgtcagatcttgtttagaaatgagagactaattccttgagtgataatatcaatataaaacattcatactggaacatactttggaaatttaatatttataatttaatatttatataatgaaaataaaagtgaaacctgaaatactgattagagaacagcagttcatacttttctcagaaacgttttaaccagtcaaaacatttttgacatttttgtgcttcaagtgtttccagtgtcttgaacaaataaagaaatttttataactatttaaaatgaaaatgatagttttgaaaatgatagaagcataggaagtactctaattgtcctacaataaaggatacatctaactaacaagtaatcagtttcagattaaatatatatttatcatttcataatgatataaacaactgattgttacaccaggttaagaaaattactaaatgaaaaaaacagtagcataactaaagataacattaataaagtactcacagagatccttttactgtgaatatacctaagtatcataaaactgctaaaaagttagaaggtataaaattaccagtatggatcagattagtatttttgcttttacaggggtaatatcgttagcagcaataaagattacctttagtgctccgtaacttgaaatctgcagagcctttaaacactaaacaacaaaaagctacaaatccctagttttaagtatcagttcattttatgattaaggtttcttttttcattaaccctcattcttcagttagcttcatcttcagagcaagctgatgatggcttgtgtgtgctagcaggatgaacgctatcttttcaaaacataatgccacagttcatgtacagctggcacatctatctgctttaccagcagtgtttttaaggatcatgcggattgaacagcaactacagcttaaggccctgacaaggtttactgctgacattcttcatggagatggtcacccttatcgtacgctttattcgttacttattatcttgaaagtagaggcgacgtctcattgcatcctgatatcaccacatcatttttatcttctaatttaacaatttctcagaaacagctaacaagagtaatttttctagtttgtattgtactgtgactttatttacattttaattgatgttatataatatacactgtatattatataatttaaatatatatttcatgttttatactaaaatgttacattttaaaatacatatttattcttgcacatagtatcaccagaatcctaaaatattagcacgaaaagaacttcgggaatcatccaaaacaaacgttcttttcactaatgaggaaaccgaggttcagaaagacgaaacaatttatgcctaggatgatatgatttaaacatccaaatataaaacttacctactttggacatttttccagctacatgttttttttttgatgttgttgttttttgttttctttttttaagtacaagaactattaatttcatttttgcttttatatttaattaaaaattggtttgtctctggttgccttgcaaagttgtcttgtgttgtcaagactcaaaaagaacatgccacgtgttagcagaaaggtacagatgtaaacaaaagcttcataaatgttatttaaattgatttaccatcttacaaaattaaattttgtttcataaattaaagctttgcttagggaagtttaaaaaaataacatagttatcttttacttttatatgtacaagtatctctgctgatgtttcatcagaaattttatgattcatgatttgtgtatactctttttggttgttcaatatgatgaaattgtaaattaacaaaagaccaagtgattaaattatacggttagagaaaaaatatttttaggacattcaaatgacccacttcacgcatttgtttcagtccattcccttgtatttcccctacattaccattttaaatgctgatttaactgctgttctagccagcaatgaaaggaatgtctatgtaaatttaaaccacaaattaaagctttcagcatcttctctcaccctgaccctgttcccaacctaagcctcatctggttaaaggcactagtttagaaaaattgccctgatgtaaaaattacaattagttgaatacaattatgacattttaatgttatatttacatgtgctaatttagaatggaataacaaacatattgtattttccttatgttctatgttcagcacataataattttctttctttttcagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatg

SEQ ID NO: 37180 - DNA, 28376 bp, Homo sapiens
aaagactgaccgactgactctgacaggatccggggctgagggaaggaggcggcggccatggagttgggcgagctgctctacaacaagtctgagtacatcgagacggtgcgcgggtccagatatgtatcctcctctttccaaccctgcgtccctttgaggcctggtcggcgttcccaacctgcccctaccccaccaacccctgtccctttggccattagtcccggattatctagcgatgccccgtgtaccgtctggctttgctgtttactccgcgcttggccagttgaggccttttgtatttattcctgattttctcataggggtaaagtgccttcgggaggataggacaagtcccatcctgttcatacgaattacagctcggacttcgggcccttttacactgccttttgtatctgttaacttgcgctaaaaacgattcggttctttttttttgaggaagggggttggggggcggagactctgtcgcccagtcctgagggccgcggcgcgatctctgctcactgcaacctccgcctcccgggttcaagcgattctcctgcctcagcgtctcgagtagctgggattacaggcgcccgccaccacgcccggctaatttttgtattttttggtagagacggggtttcaccgtgttggccaggcaggtccctaactcttgacctcaggtgatcgacccgcctcggcctcccaaagtgctggcattacaggcgtgagccaccgcaccctgccgatttggttctttatgatcagtacatgatatgtttgtaaaatcttggaaacagggcaagtggtcaattaacgttactatcgttattttggttttctttgctttctcacaactctgatactcatagtcattatcctcgttttaaggccgtaaagcccacgcgtggaagtgggatttgaatccgcgtctgtctgatgccaccaagctatagacattcaaattatgagtttattccttgagtccctagtttcctttgtgtttttattttttgagacaggttctcactctgttgcccaggctggagtgcagtggcacaatcacagctcattgcagcctcggccttccaggctcaagcgatcctctagcctcagccttctgaggagctgggactacagacacgcgccaccatgcccggctaattaaaaaattttttttttgttgagaaggggtctcactatgttgcctaggctggtcttgagctcctgtcctcaagggatccgtctgcctcagcctctcaaagtgctgagattacaggcatgagccaccatactcagccatagtttcctaatccatcattgcttttttgatatcctggactcactccattgtggacagcaccccactttatgtttttttctctcaaatgggagctttcttgatggaaacctgtagtccagaaacctattaagtttgctttccccggttttccgttgttttcttttaggcatctgggaacaaagtcagtcgccagtcagtgttgtgtggaagccagaacatcgttctcaatggcaaggtaagggacaaagccagctccaggctgcaaaccttagcttgcgttctgctaattgtcaccacagcagggcagataaaatgttgccatatctcctatttattgtttacatttttaattctcttgtttttaaattttttattttgtaaattggatctcctttttgttttttttttgtttcggttttttttgagacagtctcactctgtcgcccaggctggagtgcagtggccccatctcaggtcgctgcaacctccgtctcccaggttcaaccagttctcctgcctcagcctcccgagtagctgggattacaggcagctgccaccaagcccggctaatattttgtatttttagtagagacagggtttcatcatgttggccaggctggtcttgaactcctgccctcaagtgatccacccacctcggcctcccaaagtgctgggattataggtgtgagccactgcacccagcctaagttggatctcttgaatgcaaaaaggttcaataagaggcaacagaaaaccttttttcttttatgccaggaacaaaatacagtggtacctagaaccaacattattttatgatatagtgtgcattaaactactgggcacaaagtgtaacaggtaatgaaatatttgaaggtagaaactaaagtaatacttataaaattatctctttagtaaaaattaataattcactattaactgaaactcttaaaacgaatgtgacaattggaaaagatattaaagtatgagacaaatatgcaaagtggaatctgaaagcctgagaatcttgtaatccaaataaattacaatagcaaagagacgagtataaacttggaagagaaaatatcacagggtatatttgagcttgacaaacagtgaagttcacagttgttttcctgccatctggaacactcaattttgaaattaatttttctttaaatattacatctctaacttccagaaggaaaatagtctccttataaccaagagatcacaaatattttcagtagaagataattagtctccattaagcctgtcataccaaggaattaagtggaaaagaaatataattcagtaattgctgctcagacatactgtttcttttttttccttttttgttgagacagagtattgctctgtcacccaggtcggagtacagtggcgcgatcttggctcactgcaacttccacctcctggcatcaggtgattctcctgcctcagcctccagagtagctgggattacaggctcccgccatcatgcccacctaattttttttttttttttttttttttgagatggagtctcgccctgttgcccaggttggagtgcagtggtgcgattttggctcactgtaagctccgcctcccaggctcacgccattctcctgcctcagcctcctgagtagctaggactacaggcacccaccaccatgcccagctaattttttgtatttttatcagagatggggtttcaccgtgttagccaggatggtctcaatctcctgacctcgtgatccacctgccttgtcctccgaaagtgctgggattacaggcgtgagccaccgcgcctggcctaatttttgtatttttagtagagacagggtttcaccatattggccaggctggtcttgaactcctcacctcagatgatccatccacttcagcctcccaaagtgctgggattacaggcatgagccaccacgcccagcccaagattttttttcttatggtgaactatgtataacaatttgccattttaacaattttttaaaaatttttattatttgagacagttgcccaggctggagtgaagcggcgccatctcagtcgccacaacctccgcctcttggcttcaaggattctcatgcctcagcctcctgtgtagctgggactacaggtgcacgccactacactgggctaatttttgtatttttagtagaggcagggttttgccacgttggccaggctggtctcaaactcttggcctcaagtgatccacctgccttggcctctcaaagtactgggattacaagtgtgagccactgcacccagcctaactatatatatatatatatatatatatatatatatatatatatatatatatatatattttttttttttttaatacgcagttttgctcttgttgcccaggctggagtgcaatggcacgatctcggctcaccacaacctccgcctcccaggttcaagtgattctcctgcctcagactccccagttacaggcatgtgccaccatgcccagctaattttatatttttaatagaggcggggtttctccatgttgatcaggctggtctcgaactcccgacctcaggtgatctgccctccttggccttccaaagtgctggaattacaggcatgagccactgcgcccagccttaccaatttttaagtgtacaattagttgcattaattacattcacaatgttgtgcaaccatctccactatccatttccaaaattttttcatcaccccaaataaaaactctacacattaaggaatacacgcccattccctacttccttccattgctgatagcctgaatctactttctgtctctatgaatttgcctattctggatatttcatataagtggaatcatacaatatttgtcctttttgtctggcttatttcacttagtgtaaggttttcaaggttcatccttgttaaagcacatcagaacttcattcctttccatagcagagtaatactccattgtatgtatatgccacatttcgtataggcacttggattgtttctaccctttggctattgggaataatgctgcagtgaacactgatgtgcaagtatctgtttgtgtccctgtcttcagtttttttgagtatatacctaggagtgtatatactcaatacttgatttggcaatgtttggtatatacaaaagagcgtgattgctgggacaaatggtgagtctatgtttaactttttgggaaactgacaaatttttttccaaaatggctgcaccattttacgtttccaccagcattgtgcagggttccaatttctccacatctttaccaacactagttattttctggttttttttggattatggccatccaagggagtataaaatggtatctcatagtggttttgatttgtatttccttaatgactaatgatattgaacatctttgaatgttgcttgttggtcatctgtacatcttctttagagaaatgtctgttcagtcctttgcctatttttatattgtgttgtctttttcttattgagttctaggagttctttatgcattctggatattaaacacttatcagatatatgatttgcaaatgctttcttcctttctgtagattttgtgcatccctttgatgcacaaaagtttttaattttgaagtctggtttatctgttttttcttctgttgcttgtgtttttggtgtcatattaagaatccaaacttatggccatgaagatttactgccgtgttttcttctaagagcgttaatggtcttagtgctgtgtttaggtcattgatccattttgagttaatttttttttttgttttttgagacggagtttccctcttgtcatccaggctggagtgcagtggtgcaatctcggctcactgcaacctccgcctcctgggttcaagtgattctcctctctcagcctcccaagtagctgggattacaggcatgcgccaccatgcctgactaattttgtatttttagtagagacagggtttctccatattggtcaggctggtctcaaactcccgacctcaggtgatctgccagcctcggcgtcccaaagtgccgggattacaggcgtgaaccactgtacccagcttgagtaatttttttatatggtttgaggtaggggtctaacttagttcttttgaatgtagaaatacagttatcctggcactgtttgttgaaaatactattctttccctgttgaatggtcttggcactcttctagaaaatcaattggtcatagatgaatagatttatttgtgaactctcaattctatttggttggtctgtatgactatctttatggaacactgcactgttttgattaccatagctttgtaataagttttctggtttttttttttttttgagaaagagtctcactctgtcacccaggctggagtgcagtggcacgatctcagcttactgcaacttccttctctcaggttcaagtaattctcttgcctcagcatcctgaatagctgggattacaggcatgcgccaccatgctagagacagggttttgccattttggtcaggctggtctcgaactcctgacctcaggtgatccgcccgccttggcctaccaaagtagtgggattacaggtgtgaaccactgtgctcggcctactataataagtttttaatcatgaattatgagtcttccatgtttgttcttttataagattgttttgcctattgagggctgtttgcttttttttttttaatttttttttgggggagggggatggagtattgccctgttgcccaggctggatgcaatggtggaatcttggctcactgcagcctccacttcccaggttcaagcaattgtcctgcctcagcctccccagtacctggtattacagttgcgtgcctccatgcctggctaatttttgtatttttagtagagacggggttttaccatgttggccaggctggtcttgaactcctgacctcaggtgatctgcctgcctcagcctcccaaagtgcttggattacaggcatgagccaccatgcctggctaccttttgctttttaaagatgtttaatttggcaatattttgggtatacaaaagaatatatgtgacatatatgtcataaagcataaaattaaatcaacaccagtgaaccctatacccaactgaagaattggaacataatctgtatacaataagtactatttttatgttcctcccctattcctatttttgccaccctccaagagaaaaccgctgtcctgattttgtgtcttataaattatttattatttaagcaaattttccacatatccctaaataatatatattgtttaacttggtttcctgtgatttatttttattttaaaaatctttatttatttgtttaatttatttgttagttaatttttttgagacagggtctcactttgttgcccaggctagagtgcagtggcacaatcatagctcactgcagccttgaccttccaggccaggctcaggcgaacctcccacctcagcttcccaagtagcttatgctacgggcatgcaccaccattgctggctaatttttttttcttttttcttttttttttttttttttttttagagacacagtctcgctgtgtcgcctgggctaaagtgcagtggtgcgatatcaactcactgcaatctccacgtccttggttgaagtgattctcatgcctcaatctcctgaatagctgggattacaggtgcacaccaccatgtctggctaatttttgtatttttaatagagatggggtttaaccatgttggccaggctggtcgtgaactcctgacctcaagtattccgcctgcctcggcctcccaaagtgctgggattacaggtgtgggccaccacacctggccctatttgtagtttttttaaggaacgttcatactgttctccatagtggctgtactagtttacatcccaccaacagtgtataagagtttccttttctccaaatcctcactagtatttgttattttttgtctttatgataagcatcctaaactgcggtgaagtggtacctcattgtggtcttaatttgcccttccctatgattagtgattttttgtttgtttgttttttgagacagaatcccgctccattgcccatgctggagtgcagtggcgtgatgtcagctcactgcaacctctgcctcccgggttcaagcaattctcctgtctcagcctcctgagttgctgggactacaggcgcacaccaccatgctggctaattttttttgtatttttagtagagacgaggtttcaccatattgctcaggctggtctcgaactcctgacctcaagtgatccacctgcagttggcctcccaaaatgctgggattacaggcatgagccaccgtgcctggctgattagtgatgtttagtgaacattttaaaatatatatttgttggccattagtatgtcttttgagaaatgtcgattcaaatcatttgcccatttaaaaaattagattgagtttttttgcagttgagatgtttgagttccttgtattaatatattctgtctttgaagaatagtttgaagatatgttctgccatattttcattctgttgattgtttcctatgctgtgcaggatcattttagtttgatataatcccatttgtttatttccttttgttgtctctgcttttgaagtcttactcatcttttccaagaccagtgtctttaagcatttcccctatgttttcttctagtagtttatagtcccaggccttcatttaggtctttaattcattttaagttatagaccaggtgcagtggctcacgcctataatcccagctcttcgagaggccaaggcgggcggatcacttgagggcaggagttcaagaccagcctggccaacatggtgaaacccatctttactaaaaatagaaaaaattagctgggtgtggcatgcttgtaatcccagctactcaggaggctgaggcatgagaatcacttgaacccaggaggcagaggttgtagtgagtcgagatggtgccactgcactccagcctgggcaacagagtgagactctgtctcaaaaaaaaaaaaaaaaaaaaagatttcattttgagttgatttttgtgtacagtgacaggtgtggggtctacttctgcttatggatatgctgttttcccagcaccatttattgaagagattgtccttttccagatgaatgttctcgtcacctttgtcaaaaatcagctggctatagatatgtggattaatttctaggttctattctgttccattggcctatgtgtctttttgtaatgccagtattatgctattttgattactgtagcattgcagtatatttttaagtctggcagtgtgatgcccccttcagctgtgttctttctgttcaggattactttggctattcagagtctctgcgaattttaggatcttttttctatttttgtgaagaatctcattgttatcttgttaagattgcattgagtctgtagactgctttgggaggtactcagcttttatttctaagattcattgtggtctgtgcattttattttattttcttttaagatggagttttgctcttattgcccaggctggagtgtaatggtgcgatcttgactcactgcaacctccaggttcaagcgattctcctgcctccctccctccccacacaccacctcttcctcccaccacacctggctaatttttttttttttttttgtatttttagtagagaccgggtttcaccatgttggccaggatggtcttgaactcctgacctcaggtgattgcccactttggcctcccaaagtgctgggattacaggcatgagccactgcacccggctggcccgtctgtgcattttcactgctgtgtacaattccacttatccaccctcctcttggtggaaagttactttgtttctagttttttgctgttatgaacaatccatttatatttctatcccttctctttcagaactttgtcatttctgttttcctgagcccatatatcagatgtcacagtgcctgcagggatagaaagagatcagatgagtcagtaagactgagtgtgaacaatagagagtggtggggcctggtgaattggagaatgtgaccaatctaagcccaagctggttgttactgtgtgggaatacaggcccacgtggcaacaatcagctttccagagcgtctgattctttttcaaaagcaactggaaatctcactttttaaaatgcaagatgttccactactcaaatagtaatgtttaattttaaatgatttgttaaaatgccacgtgtccttcctgtaggagatagctaaaaaaaattaaaagaaataaataataaaaatgctgcatgagccaaacaatacaggtttgcaagtatagtccttcaacctccactttgctatctctgccttgcccattgttgagttcagtgaactctttgctttgcttctgtgaagggcagccacctcctttcatttgcttctctgaagggcagccaccttctttctttttaacaccccgttacctctgttttgaatctgacttctcttcctcagcactactccttgtgaaataggaaaccaagatttgagtccatcttcctaaatttctctgaccacctgtgatacaatttacttcctttgcatgtgtttgcttctttagttagtgtatagtttaggctgacaaacagacttatgtggatgttctttatttccagattaagcttgttgtacttatttaaaacacaataaaacaaccaccatcaccaaatacccaggacttttggaattctgttttcctccaaaagaaaaggaagccattttctctgattgtaggtggaaacatgaaactgaaaacaataattgaagtaaattaagactcttagatggaggaagttcatgctagaaatagataatctctttaagcttgaagagtacatcttttgaaaaccaaagtggctgggcacggtggctcatgcctataatcccagcactttgcgagaccaaggcaggcggaggcgggcagattacctgaggtcaggagtttgagagcagcctggccatcatggtgaaaccccatctctactaaaaatacaaaaattagcctagtgtgatggcatgcgcctgtaatcccagctactcaggaggctgaggcaagagaatcacttgaacctgggaggcagaggttgtagtgagttgagatcacaccactgtgccccagcctgagcaacagagtaagactccatctcaaaaactaaaaataaaaaagaaaaccaaaagaactgtaatacttcataatcagcagcagatgtggaagttcttttttatgagtacaagttttgtagactatacgtatgcagttgagtaagtttttccaggtatgagtctgtttcttttttggtattcttcagagtcaggtgttcaggctagcgataaatctaaattcacctatatatcaggagttccccacctacctccctagcctgaccttctgtccttgacctcagacctttatttacaactgcctattgatcatcccgtagctatctcaaattcaacatttcaaaatttaattggtaatcctcataattgcttaccctattgtaaattctctttgtcttacctcccaacagccgaacagtcaccaagtcatatagattctcttccttcttttctttttaaacattttattatggaactaaaaccaatcatctttattgaggtataatttgcatacaataaatgtatccattttgagtgtgcagtttgacaagttttgactgatgggtacatctatgcaaccactactacaatcaagatatagaatacatttctattactctagtttccttgtgcccctttgcagtcaatcctctacccttgtacccttgcctcaggcaaccaccaatataaaactaatatagattagttttgcattttctgaagtttcatataattagaatcacaagccctttttaaaaataatttttcattgacatataatagatgtacatattttgggggcacatgataatttaatacatttataaaatttataaagataagattggttttggctggacgtggtggcccacacctgtaatcccagcactttcagaggccaaggtgggaagatctcttgagcccaggatttcaaaaccagcctgggcaacatagggagacccccatctctacaaataaaaaaaattagctgggcttggtggtgcacacctgtggtcccagctgcttgggaagctgagcagggaggatcacttgagcctgggaggtcgaggctgcagtgagccgtgatggcaccactgcactccagcctgggcggcagagtgagaccctgtcccccaaaaaatgaaaaaataaaaaatcagtgtaattgggatactcatcaccttaaatatttgtctttatgctagaaacaatcaaattatttccttctagagtagccaaggcaatcttgagcaaaaagaacaaagttgtaggtatcacgctacctgacttcaaactactacagggctacagtaatcaaaacagcgtgttgctggtacaagaacagacacagaacaatggaacagaatagaaaacccagaaataagaccacacacctacaactatctcatcttcatcaaaccttctaaaaacaagcaatgaggaaaggattctctattcaataaatggtgcttggataactggctagccatatggagaaaattgaaactggaccccttccttataccatatagaaaaatcaactcaagatggattaaagacttaaatataaaacccaaaactgtaaaaatcctggaagacaacctaaccagtaccattcaggacataggtacaggcaaagatttcatgatgaagatgccaaaagcaattgcaacaaagcgaaagttgacaaatgagatctgattaaactaaagcgcttctgcacagcaaaagaaactattaacagggtaaacagacatcctacagaatgggagaaaatttttgcaaactatgcatctgacaaaggtctaatatccagcatctaaaggaattaaacaaatttacaagtagaaaacaaccccatttaaaaagtgggcaaaggacatgaacagacacttttcaaaagaagaaatacaataatcatgacaaaaagctcaacatcactgatcattagagaagtgcaaatcaaaaccacgagataccgtctcacaccagtcagaatagctgttattaaaaagtcagaaaataacagatgctggtgaggttgtgaagaaaaaggaacacttacatactgttagtgggagtgtaaccattgtggaagacagtgtggtgattcctcagagacctaaagacagaaataccatttgacccagcaatcccattactggatatatacccaaaagaatataaatcattctattataaagacatgtgcacacatatattcattgcaacactgttcacaatagcaaagacatggaatcaacctaaatgcttatcagtgatagactggataaagaaaatgtggtacaggtacaccatgaaatacaatgcagccataaaaaagaatgagatcatattttttgcagggacatggatggagctggaggctaaatgatgagaacacatggacacatagaggggaacaacacacactggggcctatgggagcggggagttgggagggtgcaggagggaaaggatcgggaaaaataatgggtactaggcttaatacctgggtgatgaaataatgtgtacaacaaacctccatgacacaagtttacctatgtaacaaacctgcatatgtacccctgaacttaaaagtttaaaaaaaattatttccttctagctgttttgaaatacataatagattactgtaaactgtagtcaccctactgacctatcaaattctaggtcttatttcttctatcaagctgtatatttgtgcccattaattaacccctcttccttcctcctacctttcttggcctttggtaaccaacagtctactctctgtcttgaaatctgcttttttagtgcccacatatgagtgagaacgtgtgatatatgtctttctgtgcttggcttatttcatttaatatagtaacctccagttccatccatgttgctgcaaatgacaggatttcgttcttttttatgactgaataatattccattatgtatatatactacattttcttcacttgatcttagccaaaaggccaagaagtgatatataccacattttctttatcctttcgcccattcatggatatctgggttagaatcatatactcttttatgtcaagcttttttcacgcagcataatgtttttgagatgtatccatcttgttgcatatagtagcagattattattttttcctttttatagctaaatattatcattatggaacttttaagacatgtacaaaagtagagaggatatataaggaattcccacaaactcatttaccagcttccataattagcaatattctgacatttttgcttcatctctaaactcaccttgtaaactcaagtcctagtttgactagggtggggtagggaacgctagagttttttattcttacttatttattttttctttttctgagacagagtcttactctgttgcccaggctggagtgcagcaagtggcactatcatagctcactgtagccttgattcttagtgatccttccgcctcagcctctggtgtagctgggactataggcacgtgccaccatgccctgcttaatttttttttttttttcttgaggcacagtcttgctctgtcacccaggtgggagtgcagtggtgtgatctcagcttaccgcagcctcgacctccacatactcagacaatccccccaccgcagactcctgagtagctgggactacaggtgcacaccaccacatctggctaatttttgtattttttgcaaagatagggttttgccatgtttcccaggctggtcttgccctcctgtgctcaagcagtcctcctgcatcagcctcccaaagtactagaattacaggcatgagccaccattcccggctggatggtattttaaaacaaattgcaaatgtcatattatttcacccacaaatacttcagtgtgtcttactaattcttaaggacttaaaaattcagtagaggtggggcatggtggctcacaattggaatcctagcacttgggaggctgaagtaagagaattacttgaggccaggcatttgtgaccagcctgggcaacatagcaagaccatgtctctacaaaaaatgaaaagaaaaattagccaggtctagtggcatgcacctgtagtcccagctacctggaggctgaggcagaaggatctcttgagcccaggagttcaaggttacagtgagccatgatcatgccactgcactccagcctgggtgacagagcgagaccctgtctctataaacaaacaaaaatgagtagagtatcactgttatcatgttaatattgtaaaaactccagtacttccttaataccatctaacgctcagtccatattcagtcttcccagtatctcaggatatctttttccagttcatttgttcaaagcagaatccaaacatgatgctgcacacattgtatttggttgatatgtctcttaagtctcttttaatctgtaacagttctctttccccaacccttttttctctccatgccatttatatattgcagaaactgggtcactatccagttgaattctccagctgctgaatttggctgattatgtctatatggaattgcctaatagggtccttatctccctccttccttgaaattggtcattaaatctacagacttaatcagattaatttacttttattattaatttatatatttttactatttattttttctttctatatgtacagttattgctttagataagatccattataggctgggctcagtggctcatgcctataatcccagcactttgggaggatcacttgaggtcaggagttcaagaccagcctagccaacatggtgaaaccctatctctactaaaaatacaaaaatgagccgggcatggtggtgggtgcctgtcatcccagctactggggaggctgaggcaggagaattgcttgagcctgggaggcggggttgcagtgagccaagatcatgccactgcactccagcctgagtgacagagcaagactccatctcaaaaaaaaaaaaaaataaagactcattatctatttttaccttgatccattgtagtcatctaaagggtcagttttcctcaggtctctcacctgtatcctccatgcagatgccagggtgcttccagagtagtagtaataatacggaaatttatgtatgttaatcctttgtttaaaatactggggccaagtgcagtgtctaatgcctgcaatcgcagcactttgggaggtcaaagttggaggattgattgcatgagcctaggggttcaagaccagcgtgggcaacatagtgagactccatctctacaaaacatttaaaaattagtgggatgtggtggcacacacctgtagtcccagctgcacagaaggcttaggcgggaggatcccttgagcccaggagctcaaggttgcagtgagctatgattgtggcactgcactgcagcctgggcaacagagtgagaccctgtgtcttaaagcaaaatctcactcttttcgtccaggctggagtgcaatggcgcgatctcggctcactgcaacctccgcctcccaggttcaagcgattctcctgcctcagcctcccgagtagctgggattactgcaggtacttgccaccatgtccggctaatttttgtatttttagtagagatggggtttcaccatgttggccagcctggtcttgaactcgacctcaggcaatccacctgcttcggcctcccaaagtgttgggattacaggcgtaagctaccgcacctggccagaaaaaattttttaatgaaataaaatattttattgactctatatcctctaggaaaaatgtctaagtttctgtgcttagcatacataattcctcataatctacttgcatgtcccttgcttactttttccagttacaactccagcatatgcactttttaaccccattcatttattcagcagacattttgagggtgcctactctttaccaagtataaggcattaatcctcccagacttataggggaacaacttctggggaagccacgccttacactttgcagtgtagcacttagaatctgagttcagaggttgggagatgaaccagaactccagtgggtccacctcttggagcatggagttggaggaggtgtagtgttaagaaagaagacaaaggtaaagcagccagaactcttggtaagcgagcagccaaggcttggggggcatgaggacttacctgagcaaatctaaagagacatataagccagatctgctataggtgttctcactaagtgctcattcagtgagttctattcatgggggattaagggcaaagcttgtgatgtactaggaacatcactaactgcagtcactgtcatgagggcagttctctttttaccttacaatttattccttttggcggaacatttgaaacattctgtcagagtggattgtaacataactcagaatcagtatctcgttatctactctttttttgttacgtcttaggctatgttgctaattttttaaaatttgcttcgtcttacagaccattgtgatgaatgactgtattatccgaggggatctggcaaatgtaagagttggacgtcattgtgttgtgaaaagtcgtagtgtcataaggccaccattcaagaagttcagcaaagggtatgtaatttaattactttgttcaagtcttgggcaagaagctgccactggtggtgtggtccatgtgttgagttgtggtataatgactaggtctgtcctgtttgaagcactgagtaagagttcaccataatgaacacaactctgctggtggttgtctcagtctggttgatgattggttgctacaaacagaatccgcttacacactggcaaaagcaaaggatttctgatcaaacagactggcgtatataatggaacctaagaggaggaaaaggagcaagccaggcctcacaagggaccggaacctggaattggacagctagccggaatcaagactgttttgtctacctatccctctctgtatctgagactgtattttttcttctatactgcccttctctctgcatttctacttgccttttctctctcacagatacctgccccatttgttcatggagcctaccttgctgactcagcctctaatttatatcatttctccatttaggcttccagcagacaccaactagagatcttatgtgttacttccaaactcttgagagagagaatctgattgactcatcttaagtatccctgatctgaacgactttgacccaaagggcagagtcaagtcaggtccactgatccttcagtgggaataaagactgtccaagaaaggccagggacagagcaggcaaactgaccaccatagctgataatggtgctaaagtattctctttgcctctttgcttctctcctccttgactaattgccctcctggcacccatctgcatttcatccaataagtcagcaagcatttattgagcaccttcctcatgcctgcagctgggttgtaagctgagaatatataaagatagataaaataaaattcctgcctcaaggttcccaaagtctagttgtagaagcaattagcataatcagatagcgacatatgacagctactatatgatgtgatacacctgtcacagaggtatgaccatggttaggaaggaacagagaagggagcaattaactcaaactaatgataatacccagaagtatatcatgcagaaataatcccacatttccaataatgatgttggattccaggctttccatgacatacaagaactggatcggagaatcattataaaacattcacatgattagctttgaaggctactaggggaaaaccagaaaacctcctggtaccctattatggttttatacagtgtgactgatacactactagaaatgttgattaacagcattgttgggttggatatggcacaggaaaagcaccaagagtgaacaaggggtttattgctgaatgaagggatgtgtaaataggaatagtacatgtgagaaatgctgaaaatatgaaagtgtaaatagcaaaacatgaatagaagctaaatgtggatttttttctacctgcatgtcataccagaaccagataatactatcgaacttggaatcttaaatttaaaattaaagaactgtcagtactgctacagactgtgatgagatcagggaatgcattgctgcacaagaggtacagaccaaaaatactagtggttaaggaagatttaaacaaattataggttcgtagaggacaggtatcatctctgaaaaaatattctggacagaatagaacagaattggaattcttctatactgcccttctctctgcatttctacttcccttttctctagtgagcatctagcactttatattcattccagtccaaatattttacatcccaaggtatagaaattacatataaatgtgatcacagaaccactgtcagtgacatttgaggaaccctagagaacgggatgggaatgatgtcagatatctggagaaagcctgctgactcctactcaaagtcaattaagtttttcctaaatccatggactaggtaaggtctccttgttatatatgctcataacttgatattgtgtttctgtagcccttatcacagttgtcactacttactatttaatctcatttcttctcttgattgcaagctgctcgtggacagtgttctctctcttttgtcattattatagccctaatttctagcattgagtctggcacatagtagtcactcactgaagtctgtgaatgaataaatttttagaatgctgaatgtggaaattataactcatgagcctactgtcaatcccctggaacattatagggcaggttactaaaaatgtgatctgtgagcattttcaaaggaagtgggaatgaacaaacgttcattgatttttatttggtacctgctcttttagctttgaagatcttgcccctcctgccttggtttttcctttcatatttctttggtgtactattgcaattttgaactagtaatcatattcattttcttcaatattgtataatttttctagcctgaggtttctttccttgctgggaacagtcttgctaagatgataaagttcaaattatgatctgtagttctataaaccttgacccaaagtacatcatcttgacctttctgtgttcatcttcttttcctcttctagtgttgcattctttcctttacatattggagaccatgtctttattgaggaagattgtgtggtcaacgcagcacagattggttcctatgttcatgttgggaagaactgtgtgattgtgagtatgatgacttggctggcaaagcagcttcactttcccttcagctcccatccctcacttcggtgggaccctgtttctgtgactaagcagggtagcagtggtttccagtcttcccagagttggatttttcttgacagatatggaattttttcagctgggtgcggtggctcatgcctgtaatcccagctttttgggaggttgaagtgggcagatcacttgaggtcaggagtttgagaccagtctggccaacatggcaaaaccctgtctctacaaaaatacaaaaattagctgggcatggtggcgcatgcctgtagtcccagctactcgggaggctgaggcaggaaaatcacttgaacccaggaggcggaggttgcaatgagccaagattgcaccactgctttccagtctgggcaacaaaacgagacactgtcttataaataaataaataaataaataaataaataaataaaaagatttggaatattttctagacattaatacgggcaagcgtttatcaagtctcctctatatgatgttaaactctttcctttgatgatttcatttaatccttacaaccattcagatgtgttaggtgttatccctatttgcagatgagaagactgaggaccttaaatattaagggatttggggccaggtgtggtgactgtagcctataatcccagcactttgcgaggccaaggcaggaggatcccttgagcccaggagttcaagaccagcctgggcaacaaagcaagaccctttctcttaaaaaaaaaaaaaacccaaaagttaagggatttgatagggctagaaagcagtagacctgggatttaaacccaggcaatatgattattagccatgctgctatatggcctacttattgccttacttcacggagcttacagtctaatgggagtaaggaaatctgaagggtgagttgaaactgggggaagacaggcatttcaggaaagagattcacatgcgtaaggaagggttcaagtcatcaaagggcatttacatgtaattcagggtgcaagcgggccccttgctcagcagaatctgtaggaccctggtccattggagcctaggaataggttgatttaacccaaccaaggcttaacaaggttggatttcctgtgatttcttagatgatgagcttgatttcagttgggatttatgagaaccatgtttagggaaagtgttttctgcattttagatttgtactccagactagattctaggaaaagccaagactctgtttctttaatgaccattcccgttaatatggagccagctctctgccctggataagactcagaccctgaaatatcaaaaaacttgcagaaaccaaacagttcacattccaggagctatgagggtacagcaaaggtggacagaaagtctttgggacaaggggaaagttagtaaagttcatctctcccctcaccctaattgcttgacaaaagctagccttccagctgggggtttctgatattttccttagcaaagtgaagatatcaccccagtagcctagtcatataaccctgtcgtttatcctcagagcgaaatgtctgaaaggttgaatccaaattctattcccagtgcttaggaaattctaatcctattgtcaggtgctcttgtttttatgccactttttaatacatcacttcatgatatagtcattgttccatattggcggtactcgctgagccttgacaaatactcgatctcaggagagattcttttagaattctagaatctcagcactggaagtaactcttttagtccagccgtccccatgacacatagctccttcctataacatcccatgtgatagtcttaatttccgtttggatatgtgaagatgtaggtgttcatcagaattgctcagatgcctgaaggaaaagcttaacaagcaatatttataggcactgttactgtactatgagttttacatttattctctctattcttgacaacctccctgcagatttggttttccatcctgtttcatagatgaggaaaccaaggctccaagatgctaacttacttgcacaggatatataggtagctgtagtattagcagcacggctgcagttgttaactccttggaaagctctctagggaagaataaagaagtagtttcaggccaggcgcagtggctcatgcctgtaatcccagcactttgggaggccgaggcaggaggatcacttgaggccaggagtttaagaccagcctggccaacatggtgaaaccccgtctctactaaaaatacaaaaaaattaactgggcatggtagcacatgcctgtaatcccagctacttgggaggctgaaacaggagaatcgcttgaacccaggaggtggaggttgcagtgagccgagatcgcgccactgcactccagcctgggcaacagagtgagactctgtcccccgccaccaaaaaaaaaagaagtttcagcttttacctcctcagctattaccagtacattcatgcctaagaaatacctacattttaaatgtttaatttgattgatcagtctacccagacagcttctgaaacccagttaagtattatttctctaagtgggcaaaatggccaaccagtggacagagcaggtgccttcaggctgcatggtggctggtatacacagtgaaaatatcccatcagctagtcttcttttccagggccctttgtctgtggatccctccatgggactatatcatgccttatgtagcacattgggtgtccttttactcagtgcctcatgaacttagtctgagttagtaggagcttagtcatgacaggaattcttagggtttatgttaatttgaggtcaccagggaagatagttgccctatttttgaaattgccactagcaggtaacccacggaagataactttacaaggaagaacgaagaactatagtcataatgtgcttttgagctaaagatgttgctgagtattctcatagctgttatccacctagctggagagagatcagccacttgggaaattcagagccacttaggaaattcacatgctttcataagaagttcatttagcaatctaccttttcctagaaaaacatatgatttaagtgtttaataatggggaaaaatttaaacacaagcaaatcaatcatgttctttgctaaaatctgaggtctggactggttagcattgtcctggtatttgtaaagatttccacattctcagtcaggtatattttctgattgtctagccaggataccagtgaactaacaggccctgatgtaaatgcagtcagaatgatcaaaactttcatttcctcagcaaggagtctaagatacagctgtaaactgtacacagaagccccatgaaacagatgagtctctcagaccttatttcttgctctctgaatgccgtggatcatggcagaattgaaaagtggtgacagtggttaaagtcagggatgaggttcaaacatctacatgactatcactcaccagtgggagaacaaatgaactaatagcttcatatccaaatgaatttttcagggtttttccagtttgaattgacaaaagagcaaaccaaccaaccaaccttaagctggtggatgtggagtggaatgggtggtgaatataaaccaagagtacaggagtagatcttaatgtcacggccaaatggctccaggcattcagcccatgttgtaagaattagtctccatctctgtgctgctttcctctgggaggttcactcccaggcaggttcttccttcatggaaataagatgcctattccagtcttccagcctatcctctggaaaccccagtgggaagtgctgctttccccagtagtcccagcaaaagccctgaggttggggtccatcagactaattggggtcatatgctgacctgttattgtttccaggcttggggtttggtgtgtgggctggggggtgaagcacatggatgagatggggatgggagggttaccgaggaaaatacaggttctgttaccagaagaaaggggaatggatgctggacaagcaaaagcacaaatgtccactaaatcaaagggaaaattcaacagagctcatggaagactgaaattcagtctgtaatgtctgagacagtttgtcctgcctctagcatacagccttccccccgaaatgtacacaaacacacactctcacaaccttgctgcctccttctcgtcaggtaccacctgaagcaggaagttgcaaccaaccctcttgtcaccgtccctggctattacatggtatcatgaatggggaaaatagaaaggagcctttcacacagtagactgatccatttcctattaacaagattttaatttcaggggcgccgatgtgtgttgaaagactgctgcaaaattcttgacaacacagtattacctccagaaactgtggttccaccattcactgtcttctcaggctgcccaggtaaccttggctgttgattaattttattttaacttcctaaaactcagttgtattttccatcgcaaaagtaatgcttacgattcctatctctggcaatatgttgatagagctaacttagaaattcacctgtacaaagtacctagaaatgctacctaacatataacaagcatctgtttaaatgcataattgggttcaccagaaaataaggaaattatgaagggccaaacacaaagaggaaactaagcccaagctgtgagattgcacgggttaatgctgtcttcataatagagtgatttgaggggtgatactcatgtcgggatggaaataaagccttggatccacacatggcagagagatcctcaaatactcttaaaggattccctctcaaggaaaagtcgatgtaaaacaaatctgctgccaacacagggaatgtacaagaaagcatttcttgcctggcctggactctgggtagaaaaagtctgtctagagaattttagtactgggcttaccctcacattggtcatgggtttaatttgtacattccacatggcccaggaattcccagactgaaaagttagcataaaccatggtctaagaccagcaataccctggggatacctgagaggggcaaatattaatacattatctctggaccttggctgatagaatgctcacaagtaaagcccatcaggagcccggagttccaaattataaagcttgaggaaacaaaagtgatacgtacttctctcagaaaacttggaaaacactgaaaagcagaaggaaggagaaaacctcacattcccttagccctaccccaagacagtatcttcttctccatgttgttttacacagctgaaatcatgtagcatatacagaggcacgtcataaattcacagatggaaaataatatgaacagagagatttgacagtatatgatacctaccactgagtggtttaattgtttttccaattaaaaaataaatctcatctctcagatcattgaatctgagtttctaagatgaacaaaatcatcactcagattcttcggggaggcatttggccattctaccgtgtcatgcatctctgcttttgcagaggaggaaggagagacttttgtttagtaatttctccatattggggtcctgctgtgaaaaagtttagctgttcttagcaagcactggaccagaacagcctcagcgattatttaagtgattgtcagacatgcatctgattgaggtgagaaggatattgccagagaaatatcttaacttcttgtaacttcttcaagctccttagagctgggtctttctttccccaggactcttctcaggggagctcccggagtgcactcaggagctgatgattgacgtcaccaagagctactaccagaagtttttgcccctgacgcaagtctagcatctctgcctcatgtcttgaatctgcttgagctctaagatgaacctggggacaaagtgagccagtcagcacctacaaagagcttttgtgtctttgacatctaccaccctcctccttttaaaaaatttctttagaatttctcaatcttcaaggctctaagtgcttaagaattcactaacagacagaccatctggaggagctgtcttcaaatgctgtgcttacaccttatctatgaacagtcactttgtaccattatctgtggaacacagaatcatctgttcccaacactccagccccttggtcctgtggatggctggatcccgcctgaaacggacctgcagagcagcagcacccttccggtgtggaggctatgtagctggtgcgctgctcacggccattcactgcccatgctgagcgcctctcacacaggtaatgcccagcttttctgctgctaacacatttggccagttgttgcagttgctcatcatcttgggaaaggtgtttgtgacttttcagagcccagattcctgttgtctattaaaacttgaagggaggggtgaatagtgtttctctcttcttcccaaaatgaccttagctgtcctaggatagttagtaaaagactttttagcattttgacctagggcctttggctttcactaaaagtggggacctcagtatcccagattgtaattttgccaagtgttagatttgagtctctcatgtggatgcattagtcaggtggttactccttgcttcaaggtacttaccttatttcattgaagacaccgcatttgtgaactcttgcttcctggcctagaaccattcagcctaccctgtatttgccataaactccacaattcacaccaaaatgtctgtacttagagctaattcgcatatatacaggaagggctcttagaatcagtttgtgggcacagagcctcaggagtaaatgaagttactagggctgttcttaccatctccttctggccaaatagcacaacatttcctcgttctgctctgacctcttagcttagaaggaagattcagaagtgaggggctaagaaggttgtccttgcctaatgctctgatctgtaagtgaatagggcagaacagttcagccttgaggttagaatttagcaggagctatcctgacttaatatccagttgtggggtttgcaaaacaaaacagctgtatgtaatcattgccactagttccatctagaactcctttctagtttgttatttttaaaatgtttatacataaaaccaccaaaatacatagcttcgacaagatggaagtttatttctctctcccataacagtgcagtgatagtcagctggtccaggccaggcaaggggctggtccatgatgtcatcaggcacccaggttcctactgtcttgccatgtggccacagttagcaacaaaggaggctgtaaatttagtttctacttgggcagccaaaactctgaggaaggagattctgctagtaaaaaggagtgggggaagaatggccattgggagacaacaagcagactcaaccaggcctctttgttggcttcctttcctcctgctgcacatgagccttcgccgtgcatttggagccatgacagctgatagctccagacctgcatcctcctagcttgggggctctgaatgaaaggtttcttcccttccagttcgaatttggaaactcccaaagttctcaatggtttgttgtgagttccatgtcctcttggatcagtcactgtggccatgcatgtttggccacatgattaatccagtctgggtcatgaccttttcttcatccaaaacaaggtgatgggaagacaaaaacaatagctactacaaacaataggagtttataattatgtgctgatgtattcgaagatgtgttgacagtcgtgagtgtgtatcctaggaaaggcgagctggactctgtctccatggtggctctcaccccagggacctaggaacagcctgtcaccacacaattacttttataaccctggagatgaaaatctccttgtcctcaaaatacttccagaagaacaaccagatgggaaggaccttggttgggactctttccagttcacttggggcagagggaatttaatggctcacgtagctgaaaaggatgggctagattgggcttcaggctgcatcccaggactccaaacagggatctgtctctttggctctcagctctgctttcatttgagttggctttattcttgggcttcacagtgtggccccacagcaccagttattgataaaaagagctcccctttgctgacagaactgctggatttggttctcattggtccagacgaggaaggtatccagcctcaagtcatcattgtggccaggaagatggaatacaccaaatggacaggcctggcatgtacccacagagactgagagttggtgctggtggttgtggtggcagatgatattacctgaagaagggacgaatgggtgctgggcaggacaaagcatcagctgtccagttcaggcctctcctctttccctggtgtcttcattttcctccgtctccctgctgtcccttaccctctgcccaatctctcattactcctggtcttgggagttgccttctgaggatactccactgggggtacctgagcctggattagagggcagggggaggatattgcctagccaaagtgggtgttcaataaagaaccatttggagatggt

SEQ ID NO: 37181 - DNA, 66147 bp, Homo sapiens
cgggaggagaggtttgggaggcgcgggagatgtccaccctgggctggtggcgccgccgggcgccgggcgccatgagggtgcgctaggcggctgttcgtgcccgaggctgcgcagcactgaggtgaggtgagtgcgccttcggccgccccgcgcgcctcctgcccgcgggaccttggtgtcgcgacggctctgggccagagtggccgtcttgccgcaagcccaagaccccgcggcaagccagcgacccttgtggcagggcgggctggcggacatggtacttggccgcccgctgcccagtccgagagtgggcacagtggcggccaggctgtggatggttggtgcctttttggggcaggggtgggcgcagcccgggctgctgcgttggtgccgccatcttgcagtccggggtctgaggggctgctgcagggtctccgcgcctttctgactggccgggggccaccgcagcaaaccgggggcattagggcagacagccgggggctctgccacggcaagtccagcaaggtcgacaccaatgctatccctgttgccacggcggaatgcggctctcgggagccctgggcctcctgggctgggtctgggggctgcgaaaatgccccttcctgcggggtgccatcggcctcgcggcgccggcgtgcccggctaccctctgggggcggggcttgtttgccgcagtggtggtgggaggggcgaagggctgtcctgcctgtaggggttttctttccccgccctctcgggcggtatcttaaataagggcggctgaggcttgctgcgcaggagctgccttggttggttggcggcagatggggcggggcaaggctcaagtgactgggtggcattggacgtaatcgtctgctcaagccccacccactgggtgccatcttttatgagggtggctgaggtttgccgcgcaggcgctgttctggttgattggtggcagatggggcgaggcaaagctgaatgactgtgggttgcattggatgtaatggtctgttccagccccacccattgggtgccatcttttatgagggtggctgaggtttgccgagtaggcgctgttctagttgattggcggcaagtggggcggggcaaggctgaagtgattgggtaactatccactcaggccccgcccgctttgacgccatgtttgatgggggctgctgaggtttgctgcgcaggtgctcccctggttggttggtggcatatggggcggggcaaggctgaagtgactgggtagcattagatgtgacgatctgttcaggccctgcccgcttggacgccatgtttgatgggggctgctgaggtttgctgtgcaggtgctgccctggttggttggtagcagagggggcggggcaaggctgaagtgactgtgtagcattggatatgacgatctgctcaggccccgcccacctagatgccatgtttgatgggggctgctggagtttgctgcgcaggtgctgtcctggttggttggtggcagatggggcggggcaaggctgaagtgacagggtggcattggacctagtggtttgttcaagccccacccacctgggcgccatctttaatgaaagtgcttgagatttgctgcgcaggcgctgtcctagttggttgggcgagacaaggcccgcccgcctgggcgccatctttgatgggggcagctgaggtttgccgcgcaggcgttgcccggattggttggcggcagatgcggcggggcaaggctgaagtggctgcaggtggcatgggcgggacggtctgttcaagccccgcccacctgggtgccatctttgatcggggcggctgcggtttgccgcataggtgtggggttgtccacagggaggggcggggccacggttgctgtgcttgcctgccttgcggtgatggaaagctgtggagtgccgcgctccttgggctgtgtgtgctggtcgccaggctgttttgccagtgggactggctcagtccccgcatctgggggagccgggagacgtgcctaaagagtttgccttagcggccgcggagccatttatgcttaaggacagggtgacgggttatcaccgcgctcgctgtgtttttggctaacggtggcagaggctcaccccttcccctgttgttgcctgaccaagactttgttcaccacaggatgcgtgtggttccatcttgtgtatgggggcggcttagtgggggagctgcgaggcgggttgtgcaggcgccctgctggcggggctaagggctggggcccgggaccgttcctcgggactgatagggctgagagcaccctcacctccactgcccctcaccgcctctacggtactgtctgtgctagccacagggtggcgcccgaggttgattgcgcaggcgccatcttgagtgacacctgggtcggccccaggggcgggcatgagggagggctttctcagtgactaggggctgccgagcctggtccactgtggtgcaatctttggctgtaatggggcacgtgagggcagttacacaggcactggtttgaatgactgctgggttggctgtagggccgggtgcagaggactgagtgactgacggggtctgcatggccccgcccactctgtggcatcatctttgctggccattaggtggcagccacggtgtactgtgcaggtgccatcctgaatgacagctgggctggctgcaggtgcggttctgagggagggtctgctttgtcttgagtgactgaggggggccatagcatgtgtgtcttgtctgatagagcagccggcattcaatgtggcgggtgcagtgcggaggcaccattactgaatgacagctgcgctgtaggagtgagcgtgagccccgtccatcctagtaccacgtgtgttggccggtggcgggggcagcagaggtgtactgcgcaggcgccatcttgagtgacagcagggctgttggagggggctgaggggatttcaaggtaggcagggccgtagagccgtgttcattcattctgtgccatctttgccggttcatgggtggggcctgcactggagccttcctgagtgaccgcgggctgcactggcgtgccagctgagccctacccccgctatcttgggcagcgtgccctcatggctggtggcgccttacttcctccagggggcgccaaagccaggcctcgggaagcgggcgggttcagctgtgcagccttgggtcagtgagcagaaaagtggaatccaaggccaaactcagacgttttaagagatttggggaaaggtgggattttaagtgagaaaatggaggaagtgggctgtgggtgtaagatttggggtctaggtgatttggagactctgttggtgaaggattttcactcaaaatcgtacagctggaggtggaaaaattcagggctgcgggtggtcctgagaggggcagtgcatgggaactaggaggctgccctgggcaggtgggggtgtgtttaaaggggctgccccataggtagggtggggcctctggagaaactgttcatgagcagagccgctagagggctgcccagcttccaaagcttagttcgtttgggtgtggccctcccagccctagctctcctacggagtcctagagctcacttacctagccctggctccacccaaggagatcttaagtcagcccttttgttttgtttgaggtagggaaagtgacacatatgacgcttccttcctagcctgtcataattttttttttttttttttttttttttttttttttgagacagagtctggccctctcacccaggctggagtgtggtggcgtgatcttggctcactgcagcctctgcctcccgggttcaagtgattctcccaccccagcctcttcagagtagctgggaatacaggcgcgcgccaccatgcccatctaattttatatttttagtagaccaggggtttcgccattttggccagggtggtctcgaactcctgacctcaggtgatctgcccgccttggcctcccaaagtgctgggattacaggcgcgagtcactgcgcccatcctttgaatagtttttaataagctctttaacctcaccaaaatatgcccacctgactcttggaatataaaccagtctcataatcatgaaggtccttcccccagggacctctaattgattgaacacatactctgaggtgcagtgggacttggactatgtcctattagtccactgagaacatgttgataaaccctaaaatattttacgtgataaagggtactattacctaataataacgataggatagcggtcctaacatggggacggccagcgccaaaaatggggttcttgaattgattccttaatctagagccccagagaaggttgtaagacaccccagaaattgacttgaatgcctttgatgtaaccttgttggagaaagtctatgagtacatcccagggtgtgaggtggtctaagggagctatacccgtggccattcatcctggatgggatgcttttcatggtctcatttgacctgtgccatcatagaagataaatgtggaactgttgtggtattgttcccccctgaggaacccagtaactgcaaaataaacttggcgtctcacattttcttttcctctacagctttgccttcttgatcttccgtccttcttggagacgactggcgagaggaagagggactaggtccaaacgctaggtggctgggtccaggtgagttgaatttcctcctcacagtgccacattcatctttggagtgaccaccgcacttccttactctgacactttcctactgcatatgtgttccacatagccaccccagcaccatttgtgccctctgagaacacccagactcttctggtggattgtgtattctctaaaaattctccttggcctcacaccatccatttcagtatcctccctctttttctcatactcagctactccttcagggctactctttttctcttgcctggtgattaaagaagcatgagagattcatccactcatttgtgaatattgatcaagtgtgtactttgtgccaggtactgggacatagccccaatgggggaaaggaagtgttttcaaagagtttttagtctatttgggaattaaagctgtggaaaacataattgtttgatttatacttttgcaagagaacatctgctagcaacagctgacttaatcttagagaggccacataggggcctccctgagatggtaaagaacattaaagctgagccctgaaggagtgtgaatggtgtgtgtcatggggagagtagtctcagcagaggggatagggttgttgttgagagatgcagagagaggagctgaaaatccaggattcctagagcaagggaatcgttgagtggcatctgattgaggtaggaagaaggtaagttgtggtttcattgtgaaaagacttgtaatctgtggtgagtaactgggcttgaccttaagtgcagcgggaagtgcttttaaccatgggagtatcatgataatcagatttgtggttttaaaaagatcatctggtttcagggtgcagaaggggagggtggacgcagtgggtgtggggagaccaacttgggcctgggtgagagatggtggcttggtttgtggtcatatcacagggaggagtgaagtgggtagattatttgagaggtgttgaggagggagactcctcactttctctgttcatggcctgctgactgattcagaggaggcacagtgagtcacatgatgtggggaagcaagcacatagctagaggttgtctgtttgttcatttgttagcaagcattgatactgggcctgatccaggacaggatcatgccaggcttagagtctccagaagtgaatgacataatccctggcctcagtgtctactgaatggaaactcccatcacaagaagagtaagaatgtgtttaccaagataggtggctatggtggtggtggaatactgcttagggagaagctgacatgaccaggtgagcccttgggatgggttggtgtattcctggcctcagtgctcaagatatgcattatggtgcttaaccctgtggagacttggaaacctcctttgcccgagggctcatgttggtagatccacatttaactaagctcaggagacttaaaaccgtactgacatgtgacttgaaataggatgttcctgttcccacaattctggtttattaattcatggtaggagtacaatagcagggacccaagtactcagcagtgtgtatgatcagcaaattctctccctgtaggcagacctacatgggaaacacaaccataatgagaaggttgcttggtgagtacggaatcagaaccaagaggatgtgggtgagctttaatagcgctggtttgtcacatagcctggtacagccatgttgtcacagtgaaacccttgcttagggttaccaagatatcggaagccccttatctaacacccttgtcctccccaaactccattcaagttaggtctgatgagagttgttcactatcctgtagatggttggatggaccaagctttgtggcctactttttagtactccctccccttaaaaaaatcagatgagccaattattgttattagaatatagtcaaataactcatactgttctggaagacattttgtctctttaaagtagctttatttgtcttgaaccattttgtgctggtcataagactgaactcttagatattatttcctctctttctaaacttttggggaaatctctcaaggatggacaacaacaaggagattttgctgcagtgtggtaagtgctaagcttaatgtggtagaaataagcccaggatgttgagattatctgagagaagccagccaacagaccagagggtggaggttgtggcctgtgagatggagttggtggtcatttactccttgctcctatataaaattttccctctaaagtccctatgtcccatatgtaccttattcataggtgattggaccagactggataccttagagcagtggttctcaaagaacagctcctggagtgattgtaggaatgcttctttcctggggaaccacagacctcctgagtcatcccacctggaaaggtagctccgtatttcataagcaccctaggcaactcttctgcacatctgagtttgagaaccactgccctagaaggaatcaggctgtagcatgcactttaatactgagaatttggatgaagggacactgagtgtcgggcatttaaactgggaggtgacgtaggcctgggctgggacagcatcttactccatgtgcgtgctgaagtagagaatgtcggtctgcagagagaggcaggagaatggagcaaacaagaagagagacgagaccacacaccacgctgtccctgggagacgaagagagtaacctcctcggttcctgactttaaagttctcaattccagcccccttttaatgaggtaggtagaacgagttagggggctgaatctaggtgcaccatggtgagggaccaaagtaagtaaatagaaatgggactgaaggagactcggtggattttctcctgcatcagatgggatgtgggagcctgaggccaaaccggagtcacaggatttcttctcacacatggtcccagacgctttctagtgcatgatgtgttctttcattaagttcttccctgctcagttgaacactgacccatcatttctctgattaaagccatggatcttccctgacttctggcaaggatgcctgatgagtttcatctttattatgtgttatattaattgtaagagccatgcttttatttcctactcattttaatggaatagaagtaaagtgtcataaaatatccaaagaatggcatcagtaccaccatccagacttcaatggcaatgctgtcatgcagcaggcagcgccaggcttgttctgtatacagagaggtttcatgtttagacatctagtgtaaagaaaacatcctttggagatcaaagaacgccagactcccagaagcacccttcctgcctggctgtgtagagggatcctttattagtggccccatcacttggcgcctctcctccctccccttgaagttggtgacctttctttgtcccctggcccagagtcagctagcccttgtgtgcccctaactgctgttggctactacttaacactgagtcctgctctgaagagagagcagagggagatatggaagctttagtaatgaggggtgtgtgggagcccaccttcaagccaggaaggatatgggtttgccctgtgggccagagttcagtcttgagccatatgacggctagacagctgtcaatgaagtgaggatttgggtgtggagcttgatgcgtgttagccccctctgtggtacagtcactggagaggggaggtacagatggtgaccacagggtactgtcggtgggagtgcttaagggtcagagggagattgtattatggggaacccagcagagaaagggcagggcctgatgtgctgtaacaagctgggcaggaaggaaaacaaacacgctaggaaacagtaattgcatttacttacatttttatattcagtttttttcctgattgcgaagttaaaataacattttaaatagagatggaaaaagaaacagagacttgttattattaatcatttattctgatagatttcctctattttatgaatagtcttaatacaagtttatgtgagttttcttccagtttagtttgtatgtactgccatatgtttgattattttttacatacatgagatcatgccatttattaaacagttcacactcaaggtctccatctatagctttgctttctgaaaactgcattatattccattgtgtggacattctcattctctgtgtacacgtaaatgggaatatttgcagtaagaacaacataagtatagattttaagatttattaatagcaacaaagttaaccagtgggtgtggcttgcagtttctatggtgaatgttttgcaatacctgcatgtagtgctgtgttttatttttataatcagaaaataaagctgtaacattccttgacaacacgacttaatggttatgtaacattttgctaaatactttgttttcattccttgtttaatgaaaactcaggagagatgctgatttttggatgcagtaacttacttagaacaaagtatgtttgtcactggccctagtggccttagccttccagagatgtgtagctgaaatacctaatttcttaggggaggctccatgccagcagtggttatattggcctttcctaacgtcaaaggccaaccctaattctagaaatgcatgcttgagtaaccaaacactgaggtattagcggtcctgtcatggcctttttgttaaagttatcctttgccatttagctgtaagaaagttcctagtttatatttaaataaggaatccatttccagtcctttattataaattaagtccccatgtgtctatagacttttacacagttgaattctggactctgttatgtcccagtggtatatttgtcctagtgcttatatccttatattggaaaaaacactttatttttgtgtgttggagtcattttacagacaaaccacctcccactccaaatagaccttatgcagggttgtcttgatattcttgtacatttattcttccagaagaactggattatcagtttgtcaaaactccccacctcaaaataaaaaggagctttttaaatgtgatacacgtgtctttatgtatttatttcagacttattgcccttctgtcatttattttattttattttattttttattgttttttatttttttggtgattcagtctagttctgtcacccaggctggaatgcaggggcatgatcttagcccactgccccctccacctcccagggcccccctgcatcagcctcttgagtagtttggattacaggctcatgccaccacacccggctaatttttgtgttccttctgtaaatttttgaaattttgtttgaagttgcaggtaactttgttaaatttatttatggagatttatttatttgttttgctattaatgggaattatttctcttgctgtatttactcataaggttttgtagttcaaaataatgcttgccccatatttatacttttctttttcttcagttgcactagctaggacttccagggtcatgttaaattgtagttgtggtatagctgtcccttccttgtccccacttccagaggaacatctttaatgtttaataacatgcttgtttgcatgtatttgagataagtctttataatgcttagatggtctcctgcttttactctgctaagaatttatgaggaaaggctgttgaagtttgcaaatgttttttaacttgaaatactgcttgtgggctccccttcccctttcatcctttatgtaacagtttaccctgatgggacatcctccttgtattcctggaatagcctttcaagatcatgggctattatttggactttgttagtttgggtttattaaatgtttttgcatctatatgcaaataatgtttattgaacacctataaaaatatagagatgaaaaaggtaacagagtctttgcccatggagccttgcggtagggtataaatacaggtgctctgttgttctgttggattcatacatcttcaagcacagctctgattaataagctacgtttttattgatggcccgtttaggccatcctcaggcagattaactcctcagctttaatatttcatttgatagcatcaggcaagcctttagacctttcttcctctcagcacctgcaaacacgtatcttctgttttcttcagtggtaggcgtggctgttgccatggagaagctggcctggggaagtgggggccaagtgggcagagcagttatgcttttgattggccagactcgctgtcacagaaggtcacgtgggatctggtcttccccagtcagggtgaggtaagtatgtggccctggcaggtgcaaatttcagcatctggccccactgctagttgccctttgggcagcaagtagaggacgggttgaatccaaggctaagggttgggccactcggccaggaaggcagctaacctcattgcatatggcccaccttgtgtcaggtagccctgcaggagaaggttgaccagcacttcctcttcctgcctttggctctgggttgctctaatgtgacttgtgttaggactgtggttacatagcagtaacacaacagaacacgtttccctgtcagtggtgctcgtcccttcccaccattccatgtgtaaaatgtgttacctgccattattttgtgttcaaggttttaccttttacaaaccagaaattagctgtacatacaaaggttaaaccatagtgtgcagctgacttttttttttttttttttgagatggagtctcgctctgttgcccaggctggagcgcagtggtgcgattttggctcactgcaacctctgcctcctgggtccaagtgattctcctgcctcagcctcctgagtagctgggattactgccaccacgcccagctaatttttgtatttttagtagagatggagtttcaccacgttggccaggctggtctcgaactcctgacctcaggtaatctacccgcctcggcctcccaaagtgctgggattacaggcgtgagccactgcgcccagctgcagctgactttttagcttttttttcttattatcattttatctacttggctatatttgttcttaaatggagaattgctggttcaaaagaagtaggtgttttttttagtatctttaaacagtggccaaaatgggatccagaaatgtggttcatgcctgcaccagctagcttctctacaccctcactagcatcaattttcatcttttaaacatttgcccattcgacaggtcaaaaaaggtttattgtaatattttacatttctttgatttttgatgttaagtaaccggcctttattatcactaattttaggaactctgtgtattagtgttgtttattttcatattgggctatttttcctaatgccaaaagccttttacatttcaaacattaactgtcatctgtgttataaaatacttttccccctccctttttgcttggtttttattttggttggtttttatagtgcagaaaagttggacccatctttattttcctgtctcccacgtggtggcctttcagtggtctctgccattggaattacgcttgagcatttgtttgactgtccctgttctctgctgttgtaaacagtgcttctgtgaacacacttttgaactgtatatctttgtgcacatgggcagatgggtctgtgagttagatttcagaagtggaattgccaagataggggatggcattgtatttatgtactgacagttgttgggtgtaattgaggggtatattcagattgcaactgcaatatcataagtatttattgggtctaacaggtttcaaagttgattctttagggttttctaaattgactttcatgtacctgctaatggccaggttagggtatgactatggattcaagctgtggatggtgatagggaggcgatgcggggagagcctgggctcagcatcagtgtaaagatgttacggctgcctgcacctgctctgtgagtagcacaacctctaaaggcctctactggtagttttgtttattgttttgttttaactttgaatttatttttttgactaggtaatacatgctcatggtaaaataaaaataaaaacaaaaaacaaaaggagaatatacaatgaaaaagtaagttgccctccctttcctgacccctagttcccttccccagaggcaattgcgattagtcatcattaatagtctcttatatatccttctagaaatcatctgtctaagcacatctttttttagtttctgagaatgctgtatacagtgctgtgtccggttttgcacttaactatcttggagatcatttcatactcatttatttagagttgccttattttaaagggtttcatagtaattcattatacaaacataacatatcttgtctattaacaacacttcaatgaatatattcttgcacataggtcattacatatctctgaggtaaattcatagaagtagaatttgtaggagaggaggatatgtgcacttttaattttgataaaatttgcattgccacaggcagtatatgagtgtacttgtttcttcccgtgcatacaaacatatgttgcccggctttatgattgattgttttgtttccaaagcctttctttactcccaaatgagtttcctctgccatggtgggaagtagctcagatctgatttttttttttaaggtttttctgttaaaaaaataacttccatttttcaatggcttctattgaccaagggccaagttctattggcctggtcagaaaatcttgagcatgttaagggaagattgtgtatgtttaatcctgaatttcttgaggaaaagcaatgtgttttattttttttggcacagaagttggcatccaccttgtgacaagatacatatgggcattcaagtggtcacaaaattaattgtaggaagtcctccatctcttttctgtgctctggaatggtttttataacacggtaaatattttattcacagaaagtttacttgggaagttgctctttacattatttcagctttttagatttcttccctagtggtcatatttttctctgcttcttgagtcaggttgggctatttgtattttctttaaaaaaattattggtttcctattgaactctataagcctgccattctgatatatagctttcacctagggtactttatgcttcaattcatgtctgttagggagagaaattcacagaatagaagcatatatatgtgtatagatcttacataagggaatgttagttttatctctctgtgcctcagatgtgtttttcttgtcttattgtaattgagtagaactgcatagaataatgttcaataatagcagcattaagacttttatttctgctttcatgagttttggttcgtggtttcttagtgatatctttgtcttgcgtttttgacttgttctggtttcataaagacagtttgaaagctttttatttctcctgtctggcatggtttatatagcatgggaatggcctttccccgaaggtatagaaggcatcaccccagtgctatttgagtccccagttgtttggggagttaattctctgacactccttctacatgtctttcatattcttagtctgtgtatttcttcctttaaaacttctgcagatacctgtgttttgactctgttcctgtggatagctgcttggtctgaagttccagaaaggatcctgttcccagacaggtgattacatatctgagggtatcttgttgcctgaggatgagggctagtatcatttcaggtaccagagtgttctcctgagtctgtctgccacataacagagttgggccgtctgcccttgcctgtctccctcacaggcacagacctctgctcttgccctgtcctgggttagagtgaccatgtctgaaatgtcacaccaatcatctggagcctggactctctggtctgttgccttcccttgctttgggattcttctgcccagcagagcattatctatgttgtgctctccgtggtttctcagtcctatgaaggaaggcagcaaggaaatagtccagtcgctaaggtcttcaggatcgaggcatttgcattggatggtgcccaagctccatgggatgataatatgcaggagagagcgtgggagggcagtttgcatagggagggaagtgggagcccatcactgagacgagtaaacatgagtttaccgtgattaccacattgatttgcaagtgataatgtctaatgagagactctgaataatggaaacaccttcagttttcctttagactttttccaaattaaaaaatttaaacttgctttccttttaaaacaaagggagaaaatttctgttgcatatggttttttttcttctctggaagtaaagccagtaggtagtttatgctcccagacctagatttctttcccatattgccttacttagttgcaccagatgtgctgaccagtcattaaaatacgcaataaaatgcaaataatagcaaaaatgctttaaggaaatgtatagctttacttggttacataaaaaaaaggagagattgaaaatctttacatttatgtccaatctcaaaagtttaaaaaatggaagggggcagataataaaataaagagaaggaaataaatgaactaagtaaagaaacagtaagaaaggaatgtcaaaacagaaagccggttcttttagacagattagacctttgtcaagattgatgaaggcaaaagaacgtgcagtagcatcaagaggctcaatggtcacttctcactgtgtgagggaataatgtcatattacctagagttgagtacttttaatatttttgaatggtcttccattttttacatgttgtatactgtgttttaataattgtgttaagggaagaaatgttaggggaggatttgccccaactcctacttccccttttcatttttgctaataaacgtgctgacgtctgattttagtactggctagggccttgaacatttctcttgtgccttgcattgggcagttaagtctttttaggtatcttagtttatttaagcttcacaattctgaaagggatggaggtgctgttattcttatttctcagattacagagagacttctagggcattagacaagttgcccacagtcccaagttagtagcccaagttagtagccgagctaactcctcgagtaggtctctgtgaagcccagaggtcatgcttgtaactgctgtgctgaggccaactttgtgcggttgtttgcctatttactggggactcccatatcccaaaagcattgtcgatgcctctggtaaggtggcctccactgctgcctggtcttcaacttctgggacatgtgtatatctccttacgatccacaggtccctgagtactgacggtcacaggctgccgcgtctttcctgttgactcatgtttggttcctccagtgaaaattttacttagagaaatgctgcctccaaagcacttgtctgccaccaaacctaagaagtcctgggccccaaatctgtatgagctagacagtgacttgactaaggagccggatgtcatcataggagaaggtccaactgactctgagttttttcatcagaggtttcggaacctaatctatgtggaatttgttgggcctcggaagaccctgatcaaactccgaaacctctgcctcgattggttgcagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaaggtgagagtctccacggggtgttggtggtcagtgcaggcctcaggtgtcccctggggctctcagcctccacacttctgacatggtctggactggataactctctgtcctgggcagcggtggggatgtcctgtgtactgtgggatattgagctgcatcatgattttctgggtgtggccaccaaaagtgtctccacacatgcccaggtatcccctggtcgccaaaacctccctagtgcagaaccaccatcctgagtcaggagagggaaaggagacacttctgtagaagggagaaaacctcctatggctcctgcctttttggtgtggtgtgctaggaggttgccttctggctgtttgtgtctgggggtgaggtcggggtggtcacagccaccatgctccccccacccagtttttagtatgccaggagtggttggaagccgctgaagggttttgaactcagaaatgtcaggatcaggtcattccaaccatgtgtgtctgtgacagggagatgcggctcagggattggggggaactattgtgagaatgtgggccagagatagtaacttggcgaccggtgtcctcttagacgacaacaacagtgacgtgaccagcgacgacgacatgacccggaacagaagagagtcctcaccacctcactcagtccattctttcagtggtgagtacccatccccactggtcacccatgggcaggcgctgccagatgcttccagatggagacacagtgggttggggcctccatgaagatgacccgccatccccgagtggtcagcttcactcagagatctgaggagagggtaaattaattgatgtcataatgagacatttttatatctaaacagacaccttaaatacttaataccgttttattcaacgataaagtatataaagctatttggaatttgcaacaggctgcttccagctgtacccccagcctcctcaggaaggttcattaaagatgcttcagtgagcttttatagggagcactgctttcagggagggtgtgtgtgttgttttcttgggttttgttttttttgtagtagaataacgtgtactttaagatcggctgccagacagtagggggtctgcagtccattctcctgaatgtggactcagccccttaggaactgggaagccagcaaagagtctgaagtgggggttagctactggactgagctttggaacttgcttggaagcaagccccacttgggcaaagcctgcagaaaccatgttgcgggtatatgataaagaaggggccagatgagcctgggaacctggagctctctgttttggatccatctccttgtgggaagagggtagcatctctttccagaggggtgtttgtgcacatgcagggaaaacaggtgtgtcaaagagctttgttaaccactggaatgtctcacctgcttaggtgaccgggactgggaccggaggggcagaagcagagacatggagccacgagaccgctggtcccacaccaggaacccaagaagcagtgagtcttaaccactttctttcccagtaggagatatagagcatgtgctgtgcacaggttcaaggggaaagtgccagggcctcgaagtttctgctgctccatttggagtatattccgcttccccaaaagtttagtccaaggctcgtatttttgaagttccactcggtaccaccagcacaggtttcaccacatagacctgttgccacctaaactatttgctcagtattcttaagctggtgcattaaaaaaaaaaaaactggaagtttctgtatgaaagactatgccactgcaaaaattgaaaactagtatgaagtgccataggcagaaggcgagaatgaaaaacacattgtaacaatattgttaactaggaatgtctgccatgacttcctgcagtgttagggaagtgccacatctgagcaccaggcctgagatttggaagggaatcaatcatcacaccagtgtattgttggtgtccatactgctggaaatcatttcctcttcttcctggacttggagaacactgctgtgggcagcagggcaccctaaaattgatcaggagaaggatatcaggagtgagtgacatttagtgacggttcacaacacaataggcattgttcagagccatgaccctgtgggacggtctctgatgccatctccctgtcacacattgcagctggggagacccagaggttgtgcccgaaggatgaggctagtggacactgtacctggacccacacagcttgggcacaatctgaaccacctccgagactgggagcagaaggatgaggcagggcccctggccctgccctgggtctgggttgttgtagggccactggttttatgggactcctcagaggctgccacagaatgcagagaagagaaaggcacttgctctcatacactcacaccccagctggcttcatagttgagtgggacaaacctgggacctgcaggatggactgggccctgcttcttgttgatgccttttttcttcccagggatgcctccgcgggatctttcccttcctgtggtggcgaaaacaagctttgaaatggacagagaggacgacagggactccagggcttatgagtcccgatctcaggtatgctcaggtttcctctctttctagaaaggccatcttcatttcatggcagagacgcctttctttccccagatggtgtgtttatctgccccctagagtccagctggggtgagagtcccagcgctccaggaggagcccgggcccatcccttaggtgacaagtagcccaggttgctgctggctgtttctttgtcgttcatgtggtcagaggagctcctgccccctcagcatgtgtgtcacttggtaggttggtcacattggccgttccctacagggccagggaagcagagtgactctggagatgtttctggtcctcaggagggagccaggaaagctgtgggtctgcagagtagactggccagggagcacaaaggctctggagctgacaggagctgggtttaaagcctggctctgccacttgctagctgtgtggccttgggccatttactcataagctgaatttaagtttcctcatctgtaaaatgaatatggtgattgctcccagggctgctgtgaaaagtcactcacacacatacataaagtacctggcacatggtaggcacaccgttaaatgttaacaattatggcagttgtggtttaagaggcagcatgtgccggggagattcatgaagggaaaaaaaatgtggaacttgagcttgttttttaggaaggaggagaggggtcacttatacatggtggagtgtggaggaggaccccagcactgactggactcaaagaagggagaagccattgggctgagccttcctttccttcacatatcagtacccatcccatgtcagaaagcaggcctaggccctggggggcacagcagtgagcaacacagagaggggccctgccctgagaagcttttgacagttgcacaaataagtattgacacaaatgttgtatataactgctcatcattctcagtgtcctcaaggaaaaatagagagttaacaagaaattgtaacaagggccttgatttggattgaagggaaatgtcttggaggcattaacagttgccatttagagccaggagcacgccgggtcaggtgttgggggaggggaccccaggcattagggagagctcagctaaagttgtgggatgggaaccaaaccaagggccaggtggctgggatataggaagaaggctggaggcatgtgtgggcctggccactggtgtcttggtagttgggctttgtcttgttttgctttttaaatgcccttccttgacaatgtgtgaagaattggcatccgagccccatgtctgcataattaaaagtctggaagctactgattcctactgactcagtatggtggtaacaccagcagcaaatgacacaaattacattttgaaggtgtacacaacagaaaattctctcatcttttagcttcatgtgtaaatttcttaattgttcacatgtatagatcatgttgtgaaaactacattgagccatactagcattgttttcagaacagcatctcttccattgaacttgattgcagtttgtatgcattaagatgtcattgttgattacaaacacaaagcgaacaaccaatttagggctgcccactggcctagattttaattttcaatcaaagcgtgctttttctttcatgtgaaaaaagaattttatctgtgaagctctgctgtgtttccttgccctacttagtttttgttgttgtttctgcttttttgtggcaggacacaggcagttcatggataaggcttccctcttaaacccagatacccgtacctctttgtctttgcttactcagcaagtcctcttttttttgctacatttttcatgttgctccatgcctcttcccagcaatagaactatggtagatttaatatcaagacatttgtatttcctttacataattttcttaatatttaagcaagacatcacactgcagaaaatcctcacccacagtattgcaaagcagatagatactcttctccccattttacaggtgaagaacctgaaagaaaggttcaaaaagatttccgttcccaaggctgcatagctcataattggtgcaatccttctttgacccagatctctgtccagctccaaagcctgtgggcttcccacagcaccatctccctcctcaagtctctctccagcctcagtgccattcttcctgggaccatgactccctgaaaccagttctagtcagccctctggcaataagcaaaggtcctttagaatcctggtagaaggttctcctcagtaatgtgaggaattttaaaattcctttttaggtaaatatccattaagacagaaaaggcaattataaaaatgccctcagggcttacagttattcctgggtgatttggaaattgtgcaaactggagactccctcaatgtagccatgctatgccatggagaaaccgggagggaggtttaagtcacatcctgaccagatgtcttcctgaatgtgtgtgtcttctttctgttccctgagtactccgtgcctgtttgatatttagtctaagttttcccaccaatccctttctatatgtgtcataatctcacttaccacttaaggccccacctgccctccacaaacctttgcacactgttcaggcccaccctgaactgtccctctacaaaacccgtttagcacttactatctgtaccccgatttattgtttattgttctctaattgtttcatgagtcttttctctccaaccaaattataagctgcatgagggcaaggaatatgtgtcatgcgtctttgggatctgcctcagagtgtagcaccaaggtaggtacgacgtaggtccctagtaacacttgacttggatcactcagaaccccaataccgtgagcacttcctatataacttcatatatgtaactcccatgttgccaacattattctgtctttgaacatcggtggggacagactccattgagaggtctgtgtttgctgttttaggatgctgaatcataccaaaatgtggtggacctcgctgaggacaggaaacctcacaacacaatccaggacaacatggaaaactacaggaagctgctctccctcggtaagcagctgcttctctcagtcactcccagtccagtcattggagcattttgtcatcttgctcctttttaagctggatgttagagtccacattaatatatttggacttcaagggtaataagaaatctttgaaagatttcaaatgagggagtaaatgataaaatttgtgtttttaagaaatgcctctggctttgggtaaagatacattgtacagggtggggacaagcagggagatgcttcttgccacaagagttgatacttttttccagagtggtagcactggaggtttttaagtagacattcaggatgggatcctgagttcccatgtggactttcctggaagacatctagcccaagttggtagtgggcagttggctgtgctgcaggtctgtaaggccatggggcctcaagggagtgggtggaggaagagcagtcgcgaggtaagaggaagaaggccagtggaaaagaggacttaaaaagtggttacaagaaggtgaagactaaaagacaatgcactgatttcagggacatgtggggtctttgtacacatttctgagtggagtcagaagaattacatgtagattagaatggattagggaatagatagtagggaaatgagacagcaaatgtcttctgacatccaaggaatcagatgtgggccacctcatatttagtggctcagtgaaagatgaagatcaatttatggtgatgagtcttggtcctcaacttgaatttgaggcatcatattgtccttgtgaccaggagtgcagcttgctgaagacgatggccactcccacatgacgcagggccactcatcaagatccaagagaagtgcctacccaagcaccagtcgaggtaagcaggaggcacatcccacagaggagccacacaaccagtgagatgctatcaaggaacttctacactttgcattcctaaacatcacagaagggtgcacccctccaagtcccactgtccttcttatggggactagggagtatttacatttggggtttctttccaggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttagtgagcttcagaaaatatatggcaaagacaaattctacgagtgcagggtgtgtaaggaaaccttccttcatagttctgccctgattgagcaccagaaaatccactttggggatgacaaagataatgagcgtgaacatgaacgtgaacgtgaacgtgagcgcggggaaacctttaggcccagcccagcccttaatgagtttcagaaaatgtatggtaaagagaaaatgtacgaatgtaaggtgtgtggggagactttccttcatagctcatccctgaaagaacatcagaaaatccatactagagggaacccatttgaaaacaagggtaaagtgtgtgaggaaacctttattcctggtcagtcccttaaaaggcgtcagaaaacttacaataaggagaagctctgtgactttacagatggccgggatgccttcatgcaaagctcagagctcagtgagcatcagaaaattcattctcgaaagaacctctttgaaggcagagggtatgagaaatctgtcattcatagtgggccattcactgaatctcagaagagtcatactataacaagacctcttgaaagtgatgaggacgaaaaggcgttcaccattagctctaacccctatgaaaaccagaagattcccactaaggaaaatgtctatgaggcaaaatcatatgagaggtctgttattcatagcttagcctctgtggaagctcagaaaagtcacagtgtagcagggcccagtaaaccaaaagtaatggcagagtctaccattcagagcttcgatgctatcaaccatcagagagttcgtgctggagggaacacctctgaaggaagggaatacagtaggtctgttatccatagcttagtggcttccaaacctccaagaagtcacaatggaaatgaattggtggaatctaatgagaagggagaatcctccatttatatctcagaccttaatgataagcgacagaagattcctgccagagagaacccttgtgaagggggcagtaagaatcgcaactatgaagactctgtcatacagagtgtattccgtgccaaacctcagaaaagtgttcctggagagggatctggtgagtttaagaaggatggcgaattctctgttcccagctcaaatgtccgtgaataccagaaggctcgtgctaaaaagaaatacattgagcataggagcaatgagacctctgtaattcactctctgccttttggtgaacaaacatttcgccctcgagggatgctctatgaatgtcaggagtgtggggagtgctttgctcatagctctgacctcactgagcaccagaagattcatgatagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctggaagaagaagaagaagatgaagcagcagcagctgcagcagcagcagcccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaagggccagatggagaggctgcagagcccattggagaggctggacagccaaatggagaggccgagcagccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggctgagggcatggggtaaaggttagaaaaccttcacctaggacttgacccttaccaaaccacagagaatccaaaccaatccatgataatgtcagtaggagacttaaccttagtgtgttacacacctgacttaacatctctaaactcagattgaaaagagaccgaatgtgcagattccacagtcttaagctttccccttcagatgtcagtgtctgcatgtgggaaagccatagcacacatcttacctttccaagtaatcagattgagaaaaccctatgagtattccagactacagagtttgcccaaatcaactgtaaatgacacttgtgtaacgtatatatagtgtttcatgaggtgtatataaaatagcaaattatgacagaacagtgatcacatatatttggatttatatgatatacagttacagtttactctgcagaggtaccttacctggtattctttgaattttttttttttttggaggaggaagagagcaacaaatttgattatatttttaagtgtcttagatcctgagaaagatttattgtgcattatttgaaccctgtcaatatctttttgagtaattgttttgtttcttacccttaaatagtcttgtgaagctgtaggcatgatagataacatggcttttactccttactgtttgaaaagataagtactttagcttctttctgcagccatttcatctgcgccaacactttggaacctaatactgtgtaaggctttacaatatacggattggctttttgtgacccagattgattggttgccacatgttatgtttgttgaagtggttctcatgcaaaaatattacacatttgtgttctgggttttttttttttttaaccaactcaatatgtgtttgatgatagtgaattgataaaacccgaagcttttccctgtaaatcttacatctttgcctttaaagaatgggttacaaccatcactagatcacagtagtgcctaatgaaggttgagaaccgtaggagaggctctcatgctgtaaataatgttgcaggctaataacctttcatcacttcctttgtgcgcttcctgccttaagtgacaagtagcaacatggcttgggtcccctgtgcagcatcagcttatgctgccacaagtcagtttgcaccctaggtgcccaggagctagtatccttagatctttctatcgctaacttaattctcttcgttatttatctgaccctctaactccatgtctaacttgcattaaaaaaaaaaaaattctttacagtcaacccaagcttaacatggactcaggttccccagcagccttaatttgttttgttaacatctgttccttctttttcagctctcctagagtatttctgagtgttgtgttcatctaatcttagtattcttttaattacaaattgacctcacagcttgaggtttcttgtgtcctattctgtggactacctgtgctcctttgcttcccctcccctcgcataataactatattaagaaattttttttggccttgagttggctggaaaaaaaatataaaatttaaaaaatttaaaaaaaaagatttgcaaaatgtaagtgtagatcatttgaacaagcaaaattaaagtacccactgggggaaatgtgtctgaatcttactcttctggatctgcaggattagggcttggaagtatgtcaaagatgcagggagtgtcaaagtttaggaagattgtagagctgagagcaagaagcagaaatgagtgagtcaaagaagggagtcctaatatatcaccagatctaggaggggagaggagacagacagaagaaaacaccagaggcaagaactgtagaaggccaggtttctgagaatgaattgagcggggtgtcctgagcagtttggaaaaggagtttttgatggtatggtgtaggtgagggctggctgcataggaaggactgaggttggaacggacatcgggaaagctgaggggcagtgaggtttactacatgggaaaaggactcttgaaacgagaatcagtgttgatgtcggggtgaactttgtgggtacattacttggtgttaacattgttggcagtggtagccccttttcagaaagcaacttgctgtaagtcagggtgtccgttccaaccttcagctagtgaaaaggtagtaacaaatggtaaacaagagaatgattgtttaaacctatctgtggacacttaatgcaactgtttaaaaatgataatcacgagttatgtagcaacgtggaaatatatttacagaacattaagtggagaaagcaggacacgaaagtatatttatactacagttataactcaacagttcatttatatgctgttcatttaacagttcatttaaacagttcattataactgtttaaaaatatatatgcttatagtcaaaagctgttgtggtgttgttgttgtaggcttatagttgagcattattttcttaaatttcttgaatgttctttatggtagtgttactaaaaagtttatgatcacattttcattgtgaacataatttgaactcattatcacacacttggaaaatacagaaaagtggaggaaaaaaaatcatatccccaccatccaaagacatatactctcctcttatcttgttcattcttgtttctgtgcacaggtttatgattataactgtgtcaaaatgtatattcaaaatagctgttacattacctttgtggaattatggttaaatactttcactttaattttttcaaatgttccctataataatgtcctgataacagtgtattatgtgtgtctccattggtgtgcataatacatacccagaggaaaaattagaaaataaagtaaattattttaaaaaattacctatattcccaacacctaacaactactgctaacatcttgatctgtttcctctatcttgtttcagtgcacacgcttgtgataacagtgttaaatatgtgtgcataaagtcttaaatgaaaagatgtggaaaataactaaaatagtgttgtcattgtgggaatttggttaaatattttgtctcaaattccttaaataatctttggtgttttggtaataaattttatgtatgtattttccattacaaatataatacatactcatacaaaactttggaaattcagtaaagaaaattcacacatattcccaacacccaacaacaattaactgttaacatcttgatctgtgcactagtctgtgattattagggtgttagtgataagtatgcataaatgtcaaagatgggaagaaagatgaaaaacaagaaatagttgtgtggttgttgtgggattatggttattttgtttcggtttccttgaaaggtcatcattctagtgttttggtagtccacctttactacatatatttccattatatatgaaatgtgttcattatagaaactttgaagttacagaaatgtagaagagaaactcacccatgttttcaccatccaaagagtgtggttaacatcttgatatattttcttcatcttgtttctgtgcacaggtttttggtttgttaatatggttgtggtcattctatctgtaatagtgtcaacaataaaaataaagttaaaaataaatatttctcagtctcttttgtctgttttgtttttggggctttaaatatgttattttgttagagttataaatccaaaagcttagttcctcctttagcctaaaaagtttggtttgcaaatcttactctatttttaagtattatctatttcaacaattacttctaagggatttttaaatactgtttgatttcacatttgtaactgcccttatgaaactaaaacatatgttccaacaatttttttaaagttgataatgaccgcaagtacatcttagttacttgagtgggcatttttaattggaaatgtgagattgtctcaaacataaaaaatcacagacaataataaacccttaacataaaagtgttgatactatgttatagaatctcaagtgtttattcctgactcttgcctgaggttaaaaggtaattatcctgagtgggtcatctctgtactgtttttcccccaagttcattaaccatactttaacctgacttccccacgagaaacatcccatgcaattcagtagattgtcatccctgagagtaatttttaaacatgcctgtgattccataatgatcagagcttttcaaccagcttgctaactggaaccctgttggcgaccacagtggatagcaccatacccaatttgcggctgctgtgtccctgattccataagtcggaggaggagatgattgtgtacttcatgcccgtctaatatccttcatgtcacatgattggattttgttcttaagatataaaagtgtacttgccactaattctaactaggatttgacagagtcctgcattctttcatgttcttagaactttatatcttgtggcatctgactatttggtcacagcttccatggtcattctgtgacgagcatcagcataggtcagggtgggaggattgggactttttaaggatggatttcctaaataatgtgttacaagaggctgtaaaggaagggaatgaagtaggtgtcattaggggttgtttgaccaatccttatactcttgggcaattccttcctccaccccacaacccagttgaaggggtaactaacttccctactgctatgcttattctgttagacttgacctctccctggtgtcagttgattgatgcccataggttccccgtgtccagtcagactcagagtgagggctacctaggtggtcatatgggttggggctgggtatacttgtgaataaacaggcctagaaggaaatagaccataaagccagagggaatcctggttcctggtgcctcatccaccccagtgccttgtggagtctggctgaactgcctgcccttggtttcttttacatggttaatccattttttgacaaacctctcaaggattagtggatgttgaatctaaacactaattgttggggatcagaacattgcagggtgaagagcaatgaacatacactgtctgcaggctagccagctctcgagtttaagtcactcctcccctagaaaggcaggagtgatgaagaagccaggactggtaccatatctccccaccagccagacagcagattgattgatcataccaagcccttttaaccacagaaagggcagttttgtagcctcatggaatagagattcattctggacttagacttgacttttcctgcccaccagcctctcaggaatgtctgctgacttactgcatgcctcgtaccacttatataccatatgaagcagcaaggagtacagaaaaaatctggggagactactctcaaaccaaagtagttcaagaaggttccccgtgataattgcatggtttcttccacaaagccaaagggtgaattgtccaggatagctcttctgtatgcccagcatccgttaaataacagcacactgcatggttttggtggactatcctgaccccattccttctgatcaccatccctgcccctccctcatgccagcaaaggactaattacatggtttggggtagaccagtcagacttcctcacccaagaatttgaattttcagtagagcaatacatggattgaaggtgttcaaagcccagtcattcttatggccacactgagaaaaggcagtctattatttccccctagtgagattaacaagtcttctttgattgctgtcctactagaaggactgataactctttactcactattttaagctacacaatattattccagtaagatccagtttcccccttaaattaacctgaatgaatttaagttacttgcaagcagagaattctagcacaaatgtgttttctttttaattttcttttttttttttgagacaaggtctcactctgttgcccagcctgaagtgcagtggcacaaacacagctcactgcagcctcaacctcctgggctcgagtgatcctctggcctcaccttcttgtgtagctgggatcacaggcaggtgccaccacacccagccaattttttaattttttgtagagacaggatctcaatatggtgcccagggctcaagtgaccctcttgccttggcctcccaaaatcctgggattacaggcgtgagccactgtgcctggcctagacatgtttttttgttgttgttgccctgtcagagatattgatgaccattccaaactcaagaagacttattttcaagggaatctatcctatcacagctgaacatatggaaagtttctgtctgtataatcataacatgatacaaatgggaactcactttctcaaaaaattctgatttaagttctttattctattttttccctcatcccatcatgaggaagcgcataaagggatacgttggtcatttgcctgtcatcttgaattagtcttcagggatcactgggaaagaagtcaattttcattttggtttataaccacgttttgccttttattcaagaaccatgaggtctcttctccatgcaaggtcttcttaaaatttctctgactctgaactcccaagccaccttaattcattcaataattgatgggccatttgtaagtgtcaggtactgtttggggcatttggcattctgtgggggacaaatcagacatggtccctgccctcatggaaccaagagtatgtgtatatttgggctgccataacaaaatatcttagactggggaatttataaacaacagaaatttactgctcacagttctggaggctgggaagtccaagatcaaggtgccagcaaatatggagtctgatgagggcttgctttctgcttcaaagatgatgacttcttgctgcatcctcacatggcaaaagaggctaggtagctcccttgcacatcttttataagggcactaatcccattcatgagggcttagccctcatgacctaatcacctcctaaaggccccacctcttagtactgttggattggggtttgaacatcaacatatgagttttgtggggacacaaacattcagaccacagcagtatgtacggggaggaaggcagtaacaatatatctcccaatatacattctcctgttcttgctaaatgttgactggttatgtggctatttagaagaagtaaatattttctcagcttcccttgcagctagaagtaggcatgtgactaatgtctggtccatgggatgagcacagtaaaggtatgtgtgatttccaggtcacaaccagccttctactctctcctcccccttccccacaggctggaatgtagaaataatggtaggaactggagcaaccatcttggatcaaaaaagggaagccatgtattgaagatgtcagagtaatgagataagagcttatgtctgatgattcttgactacctatccaggcttttacatgagaaataaacatctgtcatatttaagcatctattaattgggggctcttcattacaggaatgaaacaaacaaatattgggaaataatttaaagctcatgggaaagttgcaagaatagtacaaagatcacccatcttcactgattggtaacatttctcctatttgttttgtcatttgcacactctattatatatatacctaatacattatttttataaccactgggcatagatttcacacatcacaaagctcacctctgaatacttcagtctgtgtcacctaagaataagaattttctcttacataactgaggtactattataacctttgcacatttaatattgacacagtgcttttatcaaatctgtcaatattccaattttatcaacttgctaaataccctccatttaaatattctttttttctccagtacagtatcctttctagggctaggaccaggcctgtgtttagcagttgtaaagtagcctcctttaatctggaaaacctcctcagcctttctttggtttctaagtcacactctgacacactttggggtttggggggccattttcctatgaattagattcaggttatgcagtcgttcctggaataccacataagtgattctgtgtcctttcaggacctcacgttttaacccacaagagatccatatgccatcactggtgatgctagttttgatccacccagtcaaggtggttgcctgatttacccactgaatactttctggtttccctccttgcaactaataaacaatcagtgggagacacttagataaagcaagtaaggaaggattggggaatattttgattggtccatgatgggtcacatgtctactgcagaaccaatccacaactgggggatgtaggactcttattggcccagcctgagttgcgtgcctggcccttcccagtggaaggtcccagactctccctaaagttaaacaatgaaattgtggagtaagtctgtggttctcaaatgggattgaacgatttgccctccaggggacatgtggcaatgtctggaaacatttctggttgtcacaactgaaggggtgatgctaccagcatctcataggtggaagctgctcaataccctataatgcacacgacagtgtccccacccccaggacacagaatgaaccgacccaaaatgtcagtagagccaaggctgaaaaaccctggagcagaggaaggatggttctgcaaaggaagggggacagagcagagacccaaccctccagtctactctgatgcctcgcagctgaaaatgccagcctggtgaagctgaaagcccagactctggggtctaactgcctggtcacaaatattgcctctgccactaacagctgtcaatcttgggttatttccttaactattctgtgcctcagtttcctcatctgtaaaatggggctggtgttagtacccccgttacggggttactataaggtttaagtgagtgcattacttgtaccattcttggaacatgcctattttacaaatgtttgtaacataactgattggaaatttccacccttgaagaaggttagatgcacacttctaatcctaaccctctgcctgtcccattctaatcatactgagtgggacaagttagtgaagctttcttgtctcagtttcctcttctgtaaaatggagaaataacaacagaggctaccttgtgagggttacatgagatcatagtacgtcaagcatgtagaagaggaaataaccattaggtaggaataatagtcttgacagaaatcgctacacctactcattgcttacctgaagactgcggtctccaggtagcatgtgggtgctatcttgtttctaggctttgagaagtagcttcagtaatggaagatatgaatgctggtccctcagttggattgactgaggcagcccaattcttgggacaactttctttaatagcacctttgccacctgatgtgcagtgtcagtgcaggtggcaaaggcttctatccaccctgaaaaggtgtcagtgaagatcaggaggtatttaaagtttcccaggcctctgggcataactatgaaaactttctcatcttcccctggacatctaccttggaactggaccagctgaggagccctctctgagttcctctcacccctgctatccccacgtggggtgggtatcaggggttattaacatagtaggtgggatgagtcccagccacctttttgattgactccctgaagtttgggacagtcatgctttcacaaaatcagttataaaggatttcttcaccaaagtgggtgttagagtgagcctttttaatggcctgcagtgcaactgtttttaggaaaagaaattgtccacgagggtttattagccatcctggatggtcaggatttttggtataaccccatttggtcgcctttttccattccttttgagagaaaactggggttaaaagagcaggacccaggaggaaaggcaaaagtggcatttggaatgtgaccttccctaaagctgcctgttttgaccctaggttggctttattattttctttaattacctcaatgtcccacttctggtggcttcagcaacggactattgccatgtgggctggttttcttccagcttccaataatcttaaaatgatggcactaacgtttaagagtttaacctgcccctttccttccaaatagccccatgtgggtgtaagatggaatacacgtgcctggaatcagtgtatacggtgaggactttcccttccccaaactctaacgcctgggttagagcaacaagctctgctttctgtgaagagcatcctggcaagagagcgctggcttgtataacttcagtgggagagaacatagcacatctgccctcctctgttcctcttgcagatagctgctcctaccagtgaaccattggacttccacattttcagtaggttcacttttaaggtctgggctactggagtacacttcaccatcacctctaagcagttgtgagataggtaaccatcttcagatggaaagagggtggcagggttcaagctgttacacaccttcaaagttatgtgggggtcatcaataagcattacctgtaactggagagccttgcctggggacagcccttctgccccctttcttttatgagggtctgggtatggtggggagtccagacagttaacttttttgtctcttttgaaagggtggccatggccatccccaaccaaaggcaaggtggccatcctttagcaactgagtccagctgcttggaaaagtagatcattacccaggtcagtgggtccaacctttgaatatgtattcctagggcaattcttcccctctcatgaacataaacatggaaaggtttgcttaaatcaggtagggctaattctgggtctctcgtgagctgggtttttagcttttggaatgcttggtcacattctcccatccattcgaaatggtcagatcctccagcttcatggctagggcctctccagatattttggggaagttttttgaacacctgggtcaacacagtaaatgtcagttgctgtttcctgcctgtctgaggatcctgccatttgaaagtgaagagaggctgagagtctgtggccagtggaatgcagaaaaagtcatcttttagatccaggactgagtaccatgtacaacttggaggcagagtggaccatagagtataaggattaggtaccctgggtttctgttttctgtgacctcattaattgtccttaaatcttacactaattggtattttccatttgatttcttaacacggaggataggagtactgcaaggggattgacaggccctcagaagtccctgttttctaagctttttaatcattggggccatcccttttagtgcatctcgtttgatctagtttatattttaggagctcaataaaggggctatcttttgccttccctcacgtttccatagtcaattttggtgggtaattttatccttgagggtattcaaaaccaagtaggtggccccctgtgttgaccaagaagtcaacaggcttgttcctcatgcccagtgtcagcctgggctcctgggggatggacacctggagggccaattgaggagtccccaggacctgtcatttttactacttggaccatctgcctctgtgaggcacctggtggaacctgccctcttccccctcccttcagacatgaaggagacagtcccttttccagtgatcctcccccttatagagggcatgttggtttggtcctagtcccttaggtctttaggatcctttctgttagttaggggacctgggatcactctcttcagctgtggtactttatggataggtatcctgtgagttatccagctggcacttgagggcaacagccagtaggtgggcttgccatttgtcctctctgtcttctttatgttcttcatccctatcccggttgttggacaccttattggccaggtctactagtcttgagatgagagcatcgagctctaattttactttttggagtttatgtctaatgtctgctgtgctctgagagctacaataggattgtttgtctcttctctatgggattggtccacttcctcccttgcccttttgagagcagaggtatttttctgtttcactgaggagaatattaaaagggactggacgtctgcccagttgaggtcatgggtctgaaactattctgaatgaggttttgaaacccctcaggatcttcccttagtcctttagaatgagactttccgttataaagctctgaagttgtgaagggaaaatgtacagcaaacatctctatttccgcactggggatctgctggaaggggcatcatagagtaaggctggtaaatgtcctgctccaggtagtggctgggctgagtccctcagcagagtctgaaggggattggtaaggagggagtgtgttgcctgcagaggccactgaggataagggagctataggtcaaagattatagaattaaaaatcaaaacctcttacaatctcattaatagtaaattaataccataaagagaccgggagaggtggctcacacctgtaatcccagcactttgggagggcgaggcaggtggatcacgaggtcaggagttcaagaccagcctggccaacatgatgaatgccctgtctctactaaaaacacaaaaaaattagccgggcatggtggtgggcacctgtaatcccagctactcgggaggctgaggcagagaattgcttgaacctgggaggcggaggttgcagtgagccgagatcgtgccactgcactccagcctgggtgactgagcaagactctgtctcaaaaaaaaaaaaaaaaaaagtaataccatcaagaaaccttgttttaacataggggaccaatctcagaaagactattatgaataatttcttattaattatagccaacttaatcatatacaaaattccttttataaattttcttccacagacttgatcatgaacttacacagaccatctatgacatgcttggaccttttgatttgttctatcatacctcttttaaaataatcggtcattttattttaggacaaaactttaccacatgaaatccttttcttatataaaattatttcttttcttaccaaaaatacatctttatgtctaaaaatcttttctctctttctctctcttacttactggttcctttctacctttttaaataaataacttttaaataacctctaaactacataaaattattgttttctcaataagaatacaacttacagagttatatattattgcaattcttacttttagtaaccttaaattttagtgaaaactcaggaagcaataaatcttgaactgtttatcagatgttagcattttatagctgaaaccattctgtaatttttagaaacatgtttttttcatattataacccatttttaattggaaaacacccaacatctaatgagtatttattattcaagataattataagattttaaattacatgaaaagtctgtctacaagcatttttcccatttatatgtacttagttctttcatttttttaaggattcttttttttctattgtgaggtcaaatttacatacatcaaaacatacagatcttaaggatattattcaatgagttttggaaaatatgtacacctgtgtaactcaaatctctattaatatacaaaacaatattgtcaatcccaaaattccctcttgctcctcatcaatcagtctccaactctgtctccttaggggcaaccaccaatttattttcaccacacattagttttgcttgttgtagaattagcatgaatggaatgacacagcatgcattcgttgtgtaactcttctttcactcagcatgtttttctatattcatccattttatcgcatgtataggcagtttgttccttttttgctgagtgtagtattccatcgcatgaacctagcatactttggttatttattctactattgattgacacctgggctgtttccagatttttggctattatgaatatagctgctaagaacattcatgtacaagtatttcttttgcatgtgtggccatatgtttttatttctcttgggtaaatacttaaaaatgaaatcactggatcaggtagtaggtatatgtttagggttttttttatttccaacttttattttaaggtcaggggtacatgtgcaggatgtgtaggtttgttacataggtaaatgtgtgccatagtggtttgcagcacagatcattccatcccctaggtattaagcccagcatgcattagctattcttcccgatgctctccctcccactccgcaccctgcaacaggccccagtgtgtattgttccccaccatgtgtccatgtgttctcatcattcagctaccacttacaagtgagaacatgtggtatttgcttttctgttcctgcattaatttgctgaggataatggcttctggttccatccaggtccctgcaaaagacattatcttgttcctttttatggctgcatggtattccttggtgtatacgtaccatatttcctttatcaagtctgtcattgatgagcatttaggttgattccatgtttttgctattttgcaatgaacatgcacatgtatctttataatagaatgatttatattcctctgggtatatacccagtaatgagattgctgggtcaaatgatatttcttcccctaggtctttgaggaatcaccacactgtcttcgacaagggtagaactaatttatactccaaccaacgtataaaagtgttcatttttcttcacaaccttgctatcatctgttgttttttgacctttaagtaatagccattctgactggtgtgagatggtatctcattgtggttttcatgtgcatttctctaatgatcagtggtgttgagcttttttaaaaaaaatgttcattgcccacataaatttcttcttttgagaagtgtctgtccacgtcctttgcccattttttaatggcgttgtttttttttcttgtaaatttgtttaagttccttgtagatgctgaatattagacctttgtcagatggatatactgcaaaaattttctcccatgctgtaagctgtctgttcactctgatgataatttctttgctgtacagaagctctttagtttaattagattccatttgtcaatttttgcttttgttgctactgcttttggcatctttgtcatgaaatatttgcctgtgcccatgtcctgaatggtattgcctagattttcttctagggtttttatagtttgggtttttacatttaagtctttaattcatcttgagttgatttttgtatatggtataaggaggggctccagtttcaactttctgcatatggctagccagttctcccaacaccatttattaaatagggactcctttccccattgcttgtttttgtcacatgcacacacacacacacaaagatccaaaagcctttacctcagtattttagccatgagatgcaatacgaactcaccattgtataaagatagctggatccaaattatttccaacaaaattggaacgtgttcacatggctaaactttgtttgccctgataagtaattcaatgaaagctgtggaccaaaattttgggtaaagcagtcttcatggcagttttgattgtaaaaacttctttttcatttttttcttcagtttcaaagaagtttccagtgttcccatttcagttagatcataaataataagtgttatttcagcaccagcaacttaataacagcagattcaaagctggcagagaagaaaagaaaggaagatatggagctttagaggattctacttaactctgtagcagcagattaaccatttaagctctaaattttccttactgtgcacaaaaccgatattggccattgcactcaggcatccctggtgtcttattgaggctagtgggcatcactggcaccctgtctcaggtagtctcccataggtaccttaacctcataatggagatttcttccaatcccccaaaagtggtcccttaaactcacagcctctgaatcatcctccttttggtagagcagccaaggccaccttgtttttagggcctcagggaggaggaagaggaggaggaggaggggaagaaggaggagaagaagaaagaggtacttttaagacggggagaaatccaagttcctccagtgcatggaaattgacatgtaggaggttttcacaggcataagagaacaaacactaacaggaataaacagaaagaaatagaaaagaacacacacacataaaagacttgctggtaggtcatttcctggttctgtagtctacactgtcaacccttcaattcctctctcacctttctaaggatggttttctttaaatcaatataataataaattttgtcatgctttcagctcaccctcacatagtcacagcttatttatttatttatttgtttatttatttatttgagacatagtctcactctgttgcccaggctggagtgcagtgggcagctcactgcacttcacgagttcaagccattctcatgcctcagcctcctgagtagctaggactacaagtgtgcaccaccacacccagctattttttaaaaatatttttagtagagagggggtctcaccatgttgattaggctggtctcaaactcttgacctcaggtcatctgcctgcctcagcctcccaaagtgctgggattacaggtgtgaaccaccaagcctggctgagccaccgtgcctggcctctttaaatcaatagaataataaattttgtcatgctttcagctcaccctcacgtagtcacagcttagtttagtctttacgtagacaagacccctaaaaacttaaaacaaagatggtgtgtttgtctgcttgctttctgacgacaccctactctgtaatggaatagcttctaataaacttgcctttttcaccatgctctgtgacttgccttgaattccttcctgtgtgagatccaagaaccctcttttggggtttggatcaagacccttttctggcaacgctttcatttgcctgctctttgtcccactcattctgggcatatggtcagcctccccaccccccactgcctgggggacctttagtggactcactgagcaagctcaccccagttgtccatgggtgagcagccagagggtaagctttgcttggtcatttctgggcctagaggactgacccgctctccagcggggatcagcctccagcttagaggttcgggcatgagtggagccaacctgcagcagtggcatccagcttcggggatgccactgttctgtcactctagcctgggtgacagagtgagacatcatctctaacaaagttaaaaaaaaagaaaaagaaaaatttggaagaaaattccaccaagttccaaaaaccacaacttaaatttgccatgtgtgctgcgtactgtcaaatccgcaagaatgatgtgtaggtactgtactaggtaatgtaagtaatctagagatgatttaaagtatgcctaagcatgtgcatagattatatgcaaatactatgccattttacatgaggcttcagcgtccacaaaatttgataccctggggggtcctaaaacaaatcccccaggaatactgagggaagccttacacacatatacatatacatttcttctacaagtataaagaaacattggtggggcacttcagatcagttacagtggttacgtatgttttgggggtaaaattttggtgaatggtgcacacgtggtgtgaggaagggttttcactgactaccgcttattttcaaatttttgaaattagtttgttattttttatttttaccacttatcctcaagttctaagtaacatattaactctccaaaacttacataaggcattagtttttttgttgttttgttttgtttttgtttttttgaggtggagtctcgctctgtcgcccaggctggagtgcagtggcgcgatctcggctcactgtaacctctgcctcccaggttcaagcaattctcctgcctcagcctctcgagtagctggggttacaggcgcccaccaccaacagaaggcgttagttttaagaaggaaggtcacaggagcgccctcctacgtcgccgcccttctcctcgccgtaccaaccctatcctcgtgtctcacagggcacttggccaggagcggctgtggttcctcagcccgtccaccgcagagcgcacgcgcaagccagccacggcgcatgcgctgctggttttggtcagggcgtggagacgttcagccaggccagggcgtgaggcgtgcgaggtaagttcgctgggcccggggtaggatagcggccggcgagcgggtagcccagccaggggcctgggcggggctggggccccagtggacttgagggcgcaagaggcatccagcgcggggcagcgcgcggcttcgtgaggaagactccgcggcgggccctactggggccttgtggtggaaaagccaccccagaggcgagggctgcgtctgactgccctaaaatcggtgcccctgcagggagggacccaggacggctctgcgctggtgggcctggagcccaccccaaggccggaggctgaggcttgagaatcacttgagcccaggaggcaggggttgcagtgagccaagattgcgccactgcactccagcctgggcgactgagcgagactctgcctcaaaaaaagaaaaaaaagaaaagaaaaaaaagaaacaccccaatgtaaagaagcacaaagggcgtgaacaatttataattggcttgtaaatctgaaacaaagagaaagccgtattattaatcaaaagaaatgtaaaattaaagaataaaatgatatatttttcaatctgtctaattgacaacagattttgagggatgataatgctcttgattggcagaaccagttacataatttgcagggcctagggcaaaatgaaaatgtggggctccttgtccaaaaaattgtgaaaaatttcaagagagtgacagtaaagcattaaactaggcctgtgggctttatgagaatggggctcttgtgactgccctgattacaagcccatgaagatggcactattggcttgtaaggtggactgagtgagacatgtaatcttatacattgagtttggaagaagaagttggtagccgttgaaaggaaaatttggcagattgtgtcaagaacttttaaaaacagtttatcccttttgtctatgtaatttgggagcaaatacttagtttcagtgatgttcattacgttatgatttctaatggaaaacaaaaataaatgctttcaaatggaaaaactgttaaattatagaaataaaaggcgtaagttttagtggggataagaaaagaaaaaaatgttttccccaagtggcatctttgttcatggtttcttagagtgagtgtagcctttatggaaggtatgttttatttctgtgattacagaagaaatgaaggtttgttgtagaacatcttgaagctagaaaatagttttgagagaaagtacaaaatcacctataaaaatcacttataatattaccgttcgtacttaacccactggcacagtattttggtttaccaccttttctctgctttatatgggtaagcatatattgttatgtacaggtttcctttttccgcttgatattatgactagatgttttcctacaactataatacagctaataaatgtttagcaaaatatacatatggaaaagggcacaaaccacaaatgtgtagctcagttttcagaaagtgaatacactgtgtccacatcattcctagctttccagaagccctaatgcctggttccagtcattaccacccttccccccaacagcagccactattctgacttcaaacactttaggtttattttgcctgtttttgacctttatataaatggaatcatataatacagaccttttttttttgagcctggtttctttcattcaacagcaacttaacattcatattttctgtttagcattccaatatacaaatatatcatcctactgtggctctattatccttgtcaacacttggtattgtctgactttttcattttggacattttggagggtgcatagtgttatcctattggggttttaattcctatatctctgataactaatgaagtttagccttgttttatgttgattggctatttatagctgtcatcttttgtgtaatacttgttcagatcaccttcactccactgtccaatcataactatgcaggctagttgtaagtctgtatgtaatttctgcaggtcctgaggtttctgtatcctttcagctgatacagccctgcctaccgtcttccacaacattgtgtactggagcagcctgcctttaagagtagctctgtcctgtaaagggccaaggtgtagagatgctggatgtgacaggggtttcagatatcttgaggaatccctacatcttttgtgtgtgtggtcaagagaagaaactagaaacagagacactgaaagtttctcatcaaaagtttggggattttcagtacctgtcagtgaatgggcctcatcaagctgtgagccaaatccaggagctctgtttgcaatggctgcagccagagatcctcaccaaggagcagatgatagagcaactagtgctgacacagtttctgagcaccctgccagaggagattcagacatgggtgaggtcaaaacagcccaagaacagcaaagaggcaggaaccatggtggcaaactttattcaggcatgtgagaaggaaggtgagaaggaggaagcaactggctgcttctgtttattgaatatctgctgtatgcctggcacgtaataggagctaaatagaaattttgttgagtgaatgaatgaaagaatgcattttatacattcagtctgatctgcctaatctcatgtgagatgaaagaaatttggtgtttgggttattttaaaatttttattttaagttcaggggtgcatttgcaagtttattacatgggtatattggatgctgctgaagtttgggcttctaatgattctgtcacccaagtagtgaacatagtactggataggcagtttttcaacctttgccctccttcctcattacccccttttggaattttccgtgtttattgttcccgtcttagagtccatgtatacccagtgtttagctcccacttaaaggcggaaacatgtagtatttggttttctctttttttttttttttttttttttttttgagacagagtcttgctctgtcgcccagggtagagtgcagtggcatgatctcagctcactgcaacctccacctcccgggttcaagcaattctcctgcctcagcctcccgagtagctagaattccaggggcccaccaccacgcctggctaatttttgtatttttagtaaagacggggtttcaccatgttggtagggctggtctcgaactcctgaccttgtgatccgggtggatcacctcagcctcccaaaatgctggaattatagacaagagccaccgcagattctgtgttaatttgcttaggttaatggcttcagctgcacccatgttgctgcagaggacatgatttcattcctttttatgcctatgtgggtttggcttttgcttttaacatatactatttctctgagtgtatcagctttgttcaccttgcctcacatttcttatccagtgtaaaccttagttgcaacataaaacaagacagacacactacaaaaaaaaaaaaaaaactcctgggattgcttgtggcattaatatattaagtgtaaatttgggaaaattggtctttacattatttagtctttctattcaagaacaagaatgattagctaaattttagatgcaagggggcataaaatgtgggagatacaaagactggaagttcaacttctgccaaaatttgactggtatcttagaaactcaagttattagattagagctaaggaggcatttcaagaatgagagaagaaagccactgggtccttatagtgctttgaaacaaataatactaactaaaagcaaagtattgtttggggcatatatatagcaagggaacaatgaatactaacaccagacctcagggcatacttatctctagagggaaggctcgagtatggacatgaaagaagcacacaggcagatgtaagttattgggaatgttatacttttgggttggatagtacattcacaggccttaattatacttaaaaatataaacaaatgaatttaaaataaccatgagagccatgcatggctcaataaagatagcatatcatgaactaaggattatgattaatcccattctgtgctcccacattacttaaaagaatttttaaaatgctaatagtgaacacttgagcacttagaatgttttaatgtattatcataggtgttctttcatgttaattcattttcttctattaatagctctgtgaaataggtattaccttcatttcgtagaccaggagacagaggcataaagaggttgagtaacttgaccatggttccacaacttatattaataattggcagtcaggattcagacttaggctgctggcttcagcatctgtactcttaatcaccgtgttacatgagtgcctcatatggatatagtggatgttgtcccagaggctaaaaacttggccagaggcactgagttattgatgaagctagagttcagtgagaaggaaagagagttccctagggtaccagaaagaaaaaacagattaatgaagggtttaccgagaaaagagaatatataggcaaggaaggccatcaaggttaaggctcctggagggaaaggggtggttgtcttttagatcaacgagtgaaaaatatgtaggaaaggcttaatcataagagctgccatttaccaaaaaaatacctactgtgtgccttacatatgtaatgtttaattctcacaagagcccttagaggtatagtatactccccttatctgaggggcatacattctaacacacttgaaagtgtggatattatcaaaccctatatatactatgtcttttcctctacatacatatctgtgacgaagtttattaattaggcacagtacgatattaacaactagttataaaatggaacaattataacagtaggttagcatcactactcatgtgctttgggggcattattaagtaaaataaggtctacatgaacacaagcactgtgataccgtgatagttgatctgatgaccaagacagctaataagtgactaaggggtagtgtatacagagtggatacactggacaaagggatgattcatgtcccaggtgggacagagcaggaaagtgtgagatttcatcaccagaatggcacacaatttataacatatgaattatttatttctggaattttccattaaatatttttgacccccaattgaccatgggtaactgaaactgcagaaaacaaaacctcagataagtggggactactgtataggtattgtcattatttctgctttacagttgagaaacagaggttctgtggtgatcttgactggacagtgaggcccgaaatgactgatatggagggaactttcactttatttggaaggcagtgggagccattgaagcatttagagctgggaaataaccagagctctcttttggaacttgttattttgagttgagaaatgatatctgactttctcaccataggaactctagagctgctgttccttcccatggcaggacagggtggcatgagggtggctggccactgtgtctgtcagtgctaccagacaggactcaattccatggtattcctctctcccttctaggtttccttgctcaggactctgtccctgcagaaaagaggaacacagagatgttagacaatctgccatctgctgggtcccaggtgagtcaggctttcctctgacatggttatcaaatatggggatcttatcttcctaatttgtggacttccttatttaattaaaccacatactcatttccattaagtttttatataaatatcactttactgagccttttttctgactaatctgacatttgcttatgattcttttttttcttatttctccaagaaaaatccttctgactcttttatcctccttccgtgctttacttttctctgttgtacttatcaccatcccacatactatatatttaatatttttcctttttttctgtcttttgaattaattgtttacttatttttttagtattctattttattcagaaaaacccttgtgtggtttgcattattattgttcccctttttatatatgagggagtggaggcagaaagactaaataatatgctgaagggtaacacagctgttaaataatacgattgagatatgaacccaggcagtctggctttagagtccacattcataaccacttagttattgctgcctaaggtagtgcagttactgcaacttcggctggccggatttagcaagtaaatatacacaacatccaaattaaatttgaattttagatgaactacaaataaatttttagcataagtataaataaatttttagcataactatgaagtttgaatttcagatagacaattttttgcataaggatgcaatgtttcatatttaagacatacttatgtaaaaaactgttgtttatccaaactcctccaagctaaaggagcatgttttaacccaatgcaaggaagctaagaaccttgaaaaaaggttagaggaattgctaactagaataaccagtttagagacgaacataaatgacctgatggagctgaaaaacacagcatgagaacttcatgaagcatacataagtatcaatagcgaatcgatcaagcagaagaaaggatatcagagactggagatcaatttaatgaaataaagcatgaaaacaagattagagagaaaagaatgaaaagaaatgaacaaagcctccaagaaatatgggactatgtgaaaagaccaaaacctacgtttgattggtgtacctgaaagtgacggggagaataaaacaagttggaaaacactcttcaggatattatccaggagaacttccccaacctagcaagacaggccaacatgcaaattcaggaaatacagagaccaccacaaaaatactccttgagaagagcaactccaagacacatataatcatcagattcaccaaggttaaaatgaaggaaaaaatgttaagtgcagtcagagagaaaggtcgggttacccacaaagggaagcccatcagactaacagcagatctctctgcagaaaccctacaagccagaagagagtggaggtcaatatcaacattcttaaggaaaagaatttagaactcaggattaagaaactcactcaaaaccgcacgattatatggaaactgaacaacctgctcccgaatgactcagtaaataacgaaattaaggcagaaataaataaattctttgaaaccaatgagaacaaagacacaacgtaccagaatctctgggacacagctaaagcagtgtttacagggaaatttatagcactaaatgcccacaggagaaagcaggaaagatctaaaattgacaccctaacatcacaattaaaataactagagaagcaagagcaaacaaattcaaaagttaacagaagacaagaaataactaagatcagagcagaactgaaggagatacagacaaaaaaaaaaacccttcaaaaaaaatcaatgactccaggagctggttttttgaaaagatcagcaaaacagatagactgcttaccagactaataaaggagaaaagagagaagaatcaaatagacacaataaaaaatcaaaaagacacaataaaaaatgatatcatcactgatcccacagaaatacaaactaccatgagagaatactataaacacctctacacaaataaactagaaaatctagaagaaatggataaattcctggacacatacaccctcccaagactaaaccaggaagaagtcgaatccctgaatagaccaataacaagttctgaaattgaggcagtaattaatagcctaccaaccaaaaaaaaaaaaaaaaaaacccaggaccagacagattgacagccgaattctaccagaggtacaaagaggagcttgtaccattccttctgaaactattccaaacaatagaaaaagaggctcattttatgaggccagcatcatcctgatagcaaaacctggcagagacaacaaaaaaagaaaatttcaggccaatatccctcccaaggtgggaggatcacctgaggtcaggagttcgagaccagcctgaccaacatggtgaaaccccgtctctactaaaaatacaaaaattagctgggcgtggtggcacatgcctgtaatcccagctacttgggaggctgaggtgggagactcacttgaacctgggaggcagaggttgcagtgagccaagatcatgtcgctgcactccagcctgagtgagagtgagactccatctcaaaaaacaaaaacaaaaccaaaaaagatttttaatagacacataacaaaatttgttcttcacaaaaccctatgatacaaaaagtacaatgaccatttatagatcaaggtccagatcagagatgttacctgtcttgtccaatgaaattaaataacagtacagaccgggtgcagtggctcatacctgtaaccccagcactttgggaggccaaggcaggcggatcaccttaggtcaggagttgaagacgagcctggccaacatgcgaaaccgcatctctactaaaaatacaaaaattagctgggcgtggtgacacacacctgtaatcccagctacttgggaggctgaggcacgagaattgcttgaacccaggaggtggaggttgcagggagctgagattgcaccactgcactccagcctgggcaacagagtgagactctatctcaaaaaacaaacaagaaaaacaaaacaaaacaaaaaacaataaaacagtacagtacttgaacccaggtctctgaactgccagcccagtgctcttcccacccaacacactatccatgaatgaaattgtcaaagatttaaaaaaactcagccccttaaaacttagtgaaattcaaatttaactgggcatgctgaattttatctggccgtcctatttcaactaaatttttggatttggggatttgagacaatggggtccactgggaagcatggataggctagaatagtccagaattttaaaaaaaggaaaggtagttatgtcctaccatgtatttcctccaaaataatgaataatagtttaatgaaatcatcaaacataaaacttttttcaggttgtacaagattatacaaatgattctggtagtgtcatcatctgtttgtttattcaccaacgtctaccggtgtcaggctctgtttgagggaaaaaagtgttcttagaaccatatgggggtgccaaaaagtcacagagcaattgaaaagggccttttccttgaaagtcatgtcctggaacacgcattcttaaggaggatattgccttcaaggggaagaaaattggttcttgagggtgaacacatactattcttcttatgtgtacagcacagacatacatacagtacatacacagtatatttgcgatattaaaatgtatggggtaccgtgcgattccatttttatgaaatatccagaatcagcaaatccatggagacataaagtatgttagtggttgcctagggcttggggtagggcgtgggaagatgttggagggaaatggagagtgactgctagaaggtgcagggtttcttttggggcgatgaaatgttctgaaatttattggggtgatggttgcacaactctgtgaatatgcttaaaaactcattaaattgtatactttaggtgacttttataatacgtaaattaaatctcaataaagctgttatttaaaaaaatagacatacagcatctgtggccccacttccaccaactgaattagaatctgtgtttaacaagatccccaggtgatttgtgtgcacattaaaattggaaccatccaatacctgtgtatgtgaatcaatgctaatttataattgtttgaaaaagtatatccatgtcaagggctggaatgtactttgcaacaatgaaaatagtgtaaatgaagacaaccccttctacccacacaaagggtgtggcttattgtaggcctttaacaaatggcagctcttatagggacatgatactgttatgaggttttctgattttttgtttcaaaaatgttctccagtgttcttgttaagtcatgttttagaaacctaaaagacaataatgaaattaatatactctgctttctttagaaccagaaaaaaattcatgggggttgtgattagaaaaaatgacgtataaagattactggggtggggggagcgaggtaaggaaaaaaggttgagaaacactgttctagaatatctgctcctgagagtagccctctgtccctaccttgtctgtgccagggattccaagcaaagatgccctggagggactaccaagggaatataaataaggaattggtctgggtggattatgagaaacagggggagtgcctgtcccatatataggggcagctgtgactcagcttttgctgatggtgccatgtgagaatgtggacccagtccccagattttctaatgcttttaatcagaagccacaaaaccagttaagaatgacatttcctaatttttttttttggtattggcagctaatacaaatttttaaaaaacaataggaccacgtgagccaaataaacccatctgaaggagctgggcagccagtatatgatccctaatttaatccagtgtttgttgatttgcataaaaagttttagaaagtttcacttaaaacacaaaagatgtatattaataaaatggatatcagagtcttatgtaatgttctggtatctgcctttttatttttatagtatcaagggatcttatgtgttttattataaaattttagagtgtaaatgactttagagataatgtaatggatctctttattttaaagatgagacaatgagaatcaaagagattaattaacccatgccttacaactagctaatagcagaactcaaaactccttattccagtgtaggtttgttcccatgattttctctaatagttacagagtatgagatggaaaaaagaaaggagggtcaatggacagttaacagtaggaaaacatttgggaacagtaagatagcagtcttaaaaatgctctgactaccacatgaccaccatcgtttaaatatgacactgtgactgagaaatcatgacctaccatacagtgattcttacttgaaatagataccttttctacaactaaattcaattttcttatactgaatcaggtaacatttctcttttaacaatctttttttaatataataatattgattatccattatattcaaggtattgtagcatattaactgtattaagtaaaataaagcacaagaaaaaaggttatgaaaaactgagattgctctctatgctaaatattttgagtcacagactcctttgagaaacggaatttttatcttccagaaaggtgcacatgcactacaaagctcagccttaagaatctgtgattgccaggttaagacctcagcctaacaacaatgtacctttggttttgaatcattttttttattgccaaagtatgactggaaacagacagaaaaatcattaactgctacaacattttgagcaaaatggctagtaagttttaattttcaatttttgtcattaactgtttataaagacttattggattagcatatttgagtggggagatcctatgcattttcttacacgtgttacaattttctatattcagatttgctaaggaaggtaagtatcctattgcctcaggataatgttagatttgaagaggtcagtctatctttttttttcacttttattttagaatcagggcacacatgtgcaggtttgttacaaaggtgtattgcacaatgctaagatttggagcatgaatgagtatgtcacctcagatagtaagcatagtacccaataaatggccttttccaatccttattctcctccctccctgcctcctcttgtattccctagtgtctgttgtcccattttaatgaccatgtatacccagtgtttagctcccactaataagtgagaacacgtggtatttggttttctgtttctgcgttagttcgcttaggataatggtttcccgttgcatctgaggtttccggttgcattccggttgctgcagaggacacgattttgttctttttttggctgcatagtattcaatggtgtatacacacctcattttctttatccagttcactgtagatgggcacttgggttgattccatgtctttgcttctgtgaacagtgctgtgatgaacatatgagtgcatgtgtctttttggtaggacagcttattttcctttgggtatatggtatctgccttttaaattcaaccttaggctactaagattgttgtatataactgtagttaattgatttctattgctagaatactatttcattgtatggctatactatatttatctcttctactgttaatgaatgtttgggttatttccagattttggatgttccaaacatgctataataaacatgcccatccatgtctttaagtacacatgagtaaatatacctaggaatagaattttggggtcaaatagagattagaagggtggttctcagaggctgggaagggtagttggggggctggagggaggtggagatggttagcaagtacaaaaaaaaagtagaaagaatgaataagacctactattgatagcacaatagggagtctatagtcaataataacttaattgtacattttaaaataaagagtgtaactctttattatcctttgtaactcaaaggataaatgcctaaggggatggataccccattccccacgatgtgcttattccacattgcctgcctgtatcaaagcatctcatgtaccccgtaagtatatacaagtactatgtacccacaaaaatttttaaaaattaaaaaaagaatttctggatcaaaagtgattttctaatttacatttcccttagcatcgccagtggatccatgttttatataatagttggtattgtcccacttcttaattttcactcaattacttaatttttacccaatacttaattgaatgggtataaaatggtattttgtcattttgattttcatctccttgtttattaacaagattgaatatttcttcatgttatgagcactttgttttacaggtgggaccctgaggcttaacctacccaaactcacaaagaaccagagccaggactctgattcctgaggctgaggtatactgctgagcttttaagtatttgcatgcttgcattctgtctttataaagtggcttaaaaggatatttccccctcaacccaaatctgtagtaattagcaataggaactgtttcagtaatgttcccacttctctcagactcgataagacaaagaaagatgcaatgccaggtgcctgtggctctggattagagcacgtggaagctctctgctggtctgaatgcctgcatcatgttcagtcctctctaatcacgtcccttctcctctctctgggatagttcccggacttcaaacacttaggaacatttctggtgtttgaggagttggtgaccttcgaggatgtgcttgtggacttcagcccagaggaacttagttcccttagtgctgctcagagaaacctctacagggaggtgatgctggagaattaccggaacctggtctccctgggtaagtatgccttctccacaggacttggtttcttcccactagggcagtagctctcaactccttcgtgtcctctcatcagtaatggtggttcaccatgtcagtgagtctcaacccaggtcagaggcaatattttaatatttgaatatcaaattcactgttaattataacatagctaacatttcttgagcacgacatatgtgtcaggcacttgtgtaagtgtttagcatatttcaactcctttaatcctcacactaggcctgtgagggggaggtatacttattgttgttgttattattgacatttttaactttgaggaacctgagtcattgaaaggctaaagtacttgtcgaaagctgggatttaaccccaagcagactccagaatctgctcttttaaactctgatgtgctaccagacaggggtttgctccaccagttctcagcacaatggaaggctcaaaatgatgtttactgaatgagcgaaggaattgctaaaaattccaggagctccaaagacttctactggcttgagtttgaagaaacagagattgccaatctctctttacgtgcggaggcaaaattgttttacctgttctcacaggtaaagttgaaagtgaaaagtgaaaagtttacgttgccagtgccaagctcctttttcagtggcttttttgggggcttgaggtctcctgaaaaacagaatccaaaacaaacactgttccactggcaagtcagggacctagtgggaaaacacacatcctaccccaaacctagcacagggatgcatatgtttaactctggttcttatcggttacaaggaagtacattttccagcatattttacactcttctctagcttaccacattttatgacttaaaatagagggaatagtatcaaaatagaggaaataaattaattgtatcattccagctctcatgcagtgacctggagcatttctatcttgtgagcccttggcttctttaacactgaaggttttgtgttaatagagatcttatatatcacctgggacattgtcttcctaagtgtggaatgagtacagtgggctaaatagaagattattttaggcagtacatggacagcatgacataatccttcaatctgttggtgaaaaagaagttcttcaattttcctttaagccttctgatggtatcacgtagagaatatcagtttggtgttagcatgtctatcttgttattcttccattttagtaaagtgagagcagacatcaaaccctgaatgttagataggcaacagaagctagctagcactcaataaccttagtttctgttatatttatcatgatgttaccttccatttttgtgtgtgtgtgtgagtgacattggtttccatttatagggttgatataaagcttccattgaaaataagcgtattggccaggcgcagtggctcacgcctgtaatcccaacactttgggaggctgaggcaggtggttcatttgaggtcaggagtttgagaccagcctggccaacatggtgaaaccccgtctctactaaaactacgaaaaattagctgggtatggtggcgggcgcctgtattcccagctactcaggaggctgaggcagaagaatcacttgcatctgggaggcagaggctgcagtaagccaagatcgtgccactgcactctagcctgggagacagagtgagactctgtctcaaaaaaaaaaaaaaagaaaaaagaaaataagcatatctaagttaaaaagaaaggtgatctaaagaaaaacattaaataaatactgaatatgactataaatggcacgtagaaatgccaaaatgcaagggtcattcattaactcgtcagtgaattcagacatacaaggcctggtataggcattttggttacaaaatagatgacatttccccttctcatggatgttacatttcagtggagtcagacagtaaacaaatagataataatttggtatgcaaatgataaaagtttgggaaacaaggaactaagggagggggaggagcagcacttcaagacaaaggggcagtggacgttatcccaggagggaaaagaaccataatgttgactttttgagcagctatgtcagattcttggtgctgaagtgtagagctcagcacactgccctcatgccccctttttagtcttcatagcagggttgttcaaccttggcactcttgacatggaaccagatcgtcccgggttgtggggctgtcttgcagaatgttgagcagtgtccctgcctccagccatactagacactaggaacccctccctctgctcccacagttatgacaaccaaagatatctccatacattttagatgtcccttagggggtaaaatctctgtaggctggaaacaggcttcattttactcctgcgagagtttgttccttccttattattccagagtctttgggacctaaggttgggagttactgaaaccctgagttctcagtcttcctctccaacagggcaccagttctctaaacctgacattatctcacgcctggaagaggaggaatcatatgcaatggagacagacagcagacatacagtgatttgtcaaggtgagtagtgagggggaagcccggggtgtaggagggggaaccagtaaatgctagtcagagagctttcctcaaagtcccctgggccaggagaagtctggtaggtgccctttctcctcagtactccccttggtctcctttctgaagcccatctcttcatgcagcatgagctcctctcctgcttagctccagggaggccagtgtcctttcaccctcgtgttccagcccttccgtccactcatgcctttctccttgcagctaaacatcatacatctctcctctttaactgagacaaacaaaaaatcctggcctgataccacttgtctttctcactgccctcccactttccctcacatcagctcctcagacttgttgacacctagacgctcccttcccttttcttcttaatccccaccctctggtttccatccccctacttatgccaactcagacacacatatacgctcttttctgaaacttccacaaaaggttcccactagcgtccttatagttctggaaccatagacttcacctcctccaaactctatggctacagtctaataacgcttaccatcttcatgaaatgggtcaccatgtgcagcggctggatcactgttgtccttcagttgtagttaacagaaaacccacacccaaactggctaaagtcatagagggattattagcctataatactgatcagctgggctgtattcagggacccagtgaagtcatcgaagacctagtttcattttctccttctactctgccttcgactctgacaataaatcctagatgcatttttttgttcctgtacaaaaaaggagcaagaaagagctggtgtgtccaagaagcattctcaagagagaggaagcatcttttccagctctcctgatttttcattgttccatatcgggttatatccctttcctgaactagcagctgtgtccagtacagtgctgattgacacagccctcctccacgtttgtctgtgtgagtggaaaagtggatgtccaaacaaaattcaagaagttaccaggaagactcctctctgtttctttcattgtcttcttttctttccctactctggtttcttcattattcagtcatctcatagatatttatcaggcttctgtggtgggccagatactgtcctagtatctgtggatacaataatgaataagacagacaaatctcttccttcatagagcttgcattctaatgggggcagtagttttaaaaaatagacaaataataacggagcgtaaagtggatagagaatgagatatgggaggttgcttgagatggaatagtcagagaaggcctcactgtggaagacttgaatgagatggggggctgaccaatgtagaaatcttgaggaagagtgttacaggcagagcgaacagcaagtgccagggccctgagattggaatgagcttgggtgttccaaaaacagtaggaagggcaatatggtctgagttaagtggaagatagaagatgagatcacagagatagtcaagggccagcccgcttaggaatatgttaaagaattttattataagtgagatgcaaagatggggggaggttttgagcaggggcatgaagtagtgttattgatattttagaactttgctgtccaatatgctagacagtaggcacatgtggctacttacatttacactagtaagaattacataaaatttaaaatttagttcctcagtcacacaagccacattgcaagtatttgatagcaacatgtggctaatggctactgtgctggacagcaaaaatgtagaccatttccatcatcactgggagttctactgggcagtgctattctagaaagatccatctggctgtcctatggagaacgggctttaagaggaaaagccagagaaaccagttcaagaggccattgaagtccaccaggctaaagatgatggaggctgaggccgtggttgtagaggggtcaggttggaggtattccctgaaagaagaactgacagaacatgctgaaatattggatatacagcagggtaaggaaaacagaagagccagtgaggactaggtgttctcttactcttccgttcttgagtgttctcttcaaagaccacttcctaaaagagtcaatccattgtgatgggcccagctatccctcttttcctgatgacttcctaagccatgttctggctctgctgttttacctgtactctgttcacatacttcaagtgtctgccaggatgcaaccactgtgttcatcacctctcttccaaaccacagtcttatacttgacttccttggcttcagtatttttccaaccagagagttgcctttataaagcacagactttttatcagcttcttacctccgtcaagataaaattcaaacttttagcaaaacactgaagttcctcccattctggcctgaaatttgcatcccagcctcatctacagatcttgcaactaagatcctgtgtttctagctccccaggactgtatattttcacagttctatagcttaactcaggctgttttatataaactcgccccccttccccgtttactgacgccaaatgctgtcccctccactaatcattttctgttcctaagtggagtcagttcccccatctctgctcctgtcgtcacttacagtctgattagagtcccttttacagacctctgacccatctggttagataatgccttgcacaaaacaggcatttaataaatattgaattaaagaggattggttgacagtgtagattggggtaaaacaagagattcagagctaagaaaggagaatctttgtttaattctgaacaagaggttgttgacctgtttgctccagtgtttcctcagtagtcctgaagaaccatagtaatagatgttctaaaaaaaatgtttcatagcaagatcactttaagaaatgccacattctgtaccttccctctttagggttcaaggtgcatattaaaagttctgaatcctacaggaatgaaacctgcttgatttgtgtcatacaacatttcccaaattaacttgacagtggagcccccttcatggtaacagctatttgtttttcagaatattagcgatctgccaaacatggtttggaaaatgctgacaaaccccaaccccagctctttctctgatttctgctcattctactctgtacaattgtggcatctttttgacacgccatcctcctagatgatattttttctgtttcttcctcactcttccttgcttactgtcttttccttttttttttttttttttttttgagacagagtctcactctgtcatccaggctgcagtgcagtggtgcgatctctgctcactgcaacctccacctcccgggttcaagcgattctcctgcctcatcctcctgagtagttgggactacaggcacgcgccaccatgcccagttaattttttgtatttttagtagagacagggtttcaccatgttggccagaatgatctcaatctcttgaccttgtgatccgcccatctcggcctcccaaggtgctgggattacaggtatgagccactgtgcccggccacttactgtcctttctatcctttttccattttctctttaggttttcagaaaactctctcaacctccataagatctgtttgttatccttggtctctttatttctattatattggtatgtctctctgagtaaaaagaatagaggaatttttactttttttttttcagattaggaaaagagacctgaaaccaaagcactaactccagggcaaagcctgcctatagaaatatcattattggggggcaggattggataattgggcggtaggtaacttctggcattgtctctgcaggagagtctcatgatgatccattggaaccacaccagggcaaccaagagaaacttttgactcctataacaatgaatgaccccaagaccctcactccggaaagaagctatggcagtgatgaatttgagagaagctctaatcttagtaaacaatcaaaggatcctctaggaaaggatccccaggaaggcactgctcctggaatatgtacgagtccccagtcagcatcccaagagaacaaacacaacagatgtgaattttgcaaacgaacctttagtacgcaagtagcccttaggagacacgaacggatccatactgggaagaaaccctatgaatgtaaacagtgtgctgaagccttctatctcatgccacacctcaacagacatcagaagacccattctggtaggaagacttctggctgcaatgaaggtagaaagccttccgtccagtgtgcgaatctctgtgaacgtgtaagaattcacagtcaggaggactactttgaatgttttcagtgcggcaaagcttttctccagaatgtgcatcttcttcaacatctcaaagcccatgaggcagcaagagtccttcctcctgggttgtcccacagcaagacatacttaattcgttatcagcggaaacatgactacgttggagagagagcctgccagtgttgtgactgtggcagagtcttcagtcggaattcatatctcattcagcattatagaactcacactcaagagaggccttaccagtgtcagctatgtgggaaatgtttcggccgaccctcatacctcactcaacattatcaactccattctcaagagaaaactgttgagtgcgatcactgttgagaaacctttagtcacagcacacacttttctcaacattattggcttcctcctagagtgttgtgagtgtgagaaggcctttcactagccccaccttgttaacaacttgaacattcatcaaagtgtggta

SEQ ID NO: 37182 - DNA, 8252 bp, Homo sapiens
actacttctcccccggactccttggtagtctgttagtgggagatccttgttgccgtcccttcgcctccttcaccgccgcagaccccttcaagttctagtcatggtgagtggggttccctcggggctggggaagagtgcgcgtcccaggggacggcgggcccggaaactactgcctgcacctcgggccgcgcccaggacagctccagactaccccgggcccctccggttaacctggcttgtggcggccgggctggaaggtcgagttcacttggcagacaccagttcgggccggaaaacctggcccgggtgcggccatcagtggaaatggaaagccctcttgatcctagtgagggctttccccgcagggcccgctactgccctagggaggaaggtcagggagcctgctcattggcctccaagaacttaaactaaaaatccctccccacgttttctcaagcgacctctccttcctactgccttacaaactgggccccggaggccctcgtgcgctcccgcaccgacggtgcagcacttcctggctccccctctccagcgcccagtgactcgctgctgagtcacctgtggccctgccctggggagagcttccaactgcgccagtccacttgagaatggaggcaggcacctccttggaagggaataattaactttcacgttgcctaatcctgcatttctggtgttaatctagtggtaggtttatagctgaagctttctacttaagccgggtttaaaaacacgtccacaaaaggatattttcttataaaaccagagttggcccggcgcagtggctcacgcctgtaatcccagcacttgttcgagacaaacctggcgaacatggtgaaaccccgtctctactttaaaaaaaaaaaaaaacaaaaaaaaacgctgggcgtggtggcgcgcgccggtaatcccagctactcgggaggctgaggcaggaaaatcgcttgaacccaggaggcgtaggtttccctgagccgagatcgcgctactgcactccagtctggacgacagagcgaaactgtctcaaaaaaacgcaaacccggcccggcgcggtggctcacgcctgtaatcccagcactttgggaggctgaggctggtggatcacgagatcaggaaatcgagaccatcctggctaacacggtgaaaccccgtctctactaaaaaaaaaaaaaaaaaaattagctgggcgtggtggcaggcgcttgtagtctcagctactcgggaggctgaggcaggagaatggcgtgaacccgggaggcggagcttgcagtgagccgagatcgcgccactgcactccagcctgggcgacagagcaagactccgtccaaaaacaaaaaaaaacccgcaaaccccagagtaaactagtaccacgtgttcttagttcagttttcaagaaacgtgaaattatacgtaacttgagtgttttctataaagcttccagaagtattgaaaacaactatcttaggccgggcgcgatggcttatggttgtaatcccagcactttgggagtccgaggcgggaggaccgcttgagctcaggaggtcgagaccagcctgggcaacacggtgaaactccgtctatactaaaaatacaaaaattatctgggcgtcgtggtgcgtgcctgtagtcccagcttctcgggaggcaggggtgggaggatcttttgatcccgggaggtggaagctgcagtgagcccagatcgcaccactgcactccagcgagaccttatctcaaaaatacgtacatgaatttaaatataaaaatcaaatgtaaatacatgtatatgtcgcactgtaacaacttattgcttcttttcaagcagtaccaaaaagatactggtaaaagtgggattcacaaagtagtgagaccctttaaaaagcaggagagcggcagcggactggtttaggtgaacactggttaaattttcttgttttttaacgagaggtaagagctgcttatccagttaacactagaccaattgactccacctgtgcctcactttctcccacgtggccaggggagagtggagggtaagtcagtggccgctgactgcctgctaagcttcaagaaggcagtttagactgagcaatgaaagaaaaattgcgggcgcaaaatagaaacggcatttaaacagaagaagcatttgttagaatgagtggatcttctcagatactttatctccttgggcctgggggccatcatgatcaggtatctggttatctccagctttttggggcttgggcgtttccaaagtccagttaaaggtaaacatgatgccgggcgtggtggctcccgcctataatcccagcactttgggaggccgaggtgagtagatcacccgaggtcaggagttcaagaccagcctggccaacatggtgaaaccccatctctactaaaaatacgaaaataaggcaggcatggtggtgggcacctgtaatcccagctacttgggaggctgaggcaggaaaatcgcttgaacctggaaggcggagtttccactgcactccagcctgggcgacagagcgagactttttctcaaaaaggtaaacatgatgcaatggtaaatagtcatgggctaattagaacaaactactcctgttctcccacacccctggagctgggtgagtagacccaggtgatactgagcttgctgatgtggttaagagaccttgattgtttcatggggagtgtaggtgggaaggaggtcaaaggttgtgagtaattagggtttttattatctcttggcttatgagaccaggtcctttgagaacttagtgctctgccagtctccaaagtggctaatctgacttatgatgaaatgccaaacaccctttttgttttcctgttaagtctgtgtgtacagattctatgtttattcccttattttacttagcaggtgtgggtttggtaatttctaaccatattctgctttggcccctctggcctttctaaattaacttggtccacctcataaatatatatctatgagagagagacacacacacacagacacagacacagagtcttgcctctgttgcccaggctggagtgcagtggcgagatctctgcaaccgccacctcctgggtttgggttcaagtgattctcatgcctcagtcttccgagtagctgggactacaggcgcgcaccaccatgcctggctaattcttgtatttttagtagagatggggtttcagcatattggccaggctgttcttgaactcctgacctcagatgatccacccacctcggtctcccaaagtcctgggattacaggcatgagccactgtgctctaccataattttttttttttttgtatttttaatagagacagtttcaccatgttggccaggctgatttcaaactcctgacctcaagtgatctgctcaccttggcctcccaaagtgctgggattacaggtgtgagccagaaacaactaatttcttaacctatcagtaaagtcttggtaacatttctagcctttattattatggtcttccctcttccggagatgttttgacggtgaaggaaaaacgttcttcctatagattagattcttccacttggttaaaaagctgcctctgaccacagtttttaaaatacagctaactgctgcttatccagcattttcttcatgagtcatggctatagtttgctggtttaagctggttttaaaggagggagagagaagcttttgtctcctaaagaataggattaaagcgggaccagaatgagctcagtagttacacaatcattcagagaatgaatcagagctggaaaggggaattttgccttagtttaaggaatcatatctactgtggctacaaagcaactgtctggtcttgccgagtagttcatgaacacatctttggttttccaaggcacttttgctgaattaggtcttcaaagatttttgcttttgaaattatagtccctgagcaggagtggcctgctgaaagatggttatctttttttgtttgagatggaatatcttgtcactcaggctggagggcagtggtgtgatctcagctcactgcaacctccacctcctgagttcaagtgattctcctccctcagcctcccaagtagctgggactacaggtgtgcgccatcatgcctggctaattttttttgtatttttagtagagatgcagttttgccatgttggccaagcagatctcaaactcctgacctcaggtgatccacctgcctcagcctcccaaagtactgggattacaggtgtgagtcactgcgcccagccagttatctgtcttgaaggttaatcagtcattaggtgtgaatcattcctaaatgtcccatctgatgtattataccctgacattttcctttcttcctcccacagcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgaaacgggtgctggcaagcatgtgccccgggcagtgtttgtagacttggaacccacagtcattggtgagttgacctcagtaacccaagtgagatcccagggtgctgggacaggaggtctgtcctgggggggctccgctggtcactcacccactctccctccccgctccttgtccctcctcctcctcccccatcatgttctccagatgaagttcgcactggcacttaccgccagctcttccaccctgagcaactcatcacaggcaaggaagatgctgccaataactatgcccgagggcactacaccattggcaaggagatcattgacctcgtgttggaccgaattcgcaagctggtaagtatagtactttaaataaagtgggatgagagtttcttttgcagttctgagaccaaactacagaaatcattctttgcaactaaaatgagactatttgcattgcaactaaaatgtatctgttcactaaattaattggatttctgaaccagatgatcttggatttatgggacaactatggggtagaagtaagtgctctttagcctattttgcttcaagctgagacaccccttttgaggtcatcttagtcatactgagtgagtaggtagctgacttctacatgtaactaattgatcagagtcattttttaaaaatctgggatggttccttcatgtcaatacagaaagttcagagaacaagaagccagtgtcacactgacaagaaacagccaatactggaaacttccagtactgctgaaagtggagtcgggagcttccttatgaagtgtgctgtttggatcactttaattaagagcctggcaatcagatgactctttgctccttaggcatgtgggcagcttgtaagtaattaaccagagatcaagcatgatggtctgggcagagtaacttgtcaagaaaatcacattgtattaagcccagccatgactgctccattctaaaatagaatagcctcatcattcatggcttcatactttctcagatgtttacgtagtcttcccagcaaaactggactgatgtttccgatgcttaaaaactaagctttaggctgggcacggtggctgacatctgtaatcccagcactgggaggccaaggtgggcggatcatgaggtcaggagatcgagaccatcctggctaacatggtgaaaccctctctactaaaaatacaaaaaaattagccgggcgtggtggtgggcgcctgtagtcctagctactagggaggctgaggcaggagaatggcgtgaacacgggaggcggagcttgcagtgagccgagatcgtgccactgcactccagcctgggcgacagagtgagactccatctcaaaaaaacaaacaaacaaaaaaaaccctaagctttagttataagcactgacttggaaaatcagggacctgcctttaggacaaataaacctagtagctatttagggttctggaacgtgaggtttattgcctaccaaaacaattgcatttgtccttgtcattactgtgctcacaggaggcttaactggtgtaattggtaggcgagagtctgccctgtgcattgatctcatgtagttgatggacccacaggctataagggagctgagtagagaatgttcacaaatctgaggcccatcacttggagaagcaagagtttacaacagaatactttatttggaaggtcaaaatcattccttcgtaaagtagcagtttgctaaccaaaatagcccagttaggtggaggaaatccccaacaacctgaggtctcatggaattgtggttgtgtcactttacccaaaataaatgggcttcttggtacctagtgtcatatattggcttactgggccaatactgtgcttactgtgccaagcactatgctgagtacttacttaattctcaacctaaggtgattactattctcacttaatcagtggaagaactgagaaatgaatgtggtcatacagtaaggaactggtacagccggatcctgacacagcctgactccagtaccagggtgttagaactttggctattctgttgttccacctcagaaagcagctgccaaatctttacaagacatccactgtaccaggctggtggtcctgggcctgccccttaggacctctccaactaagaaactgccctgttctgtggccacagcaagagaaccagaggctgccttcccagttaccaaaacttgagccctgtatgcaagcccaggccttgtgattcctctgcctaaggcaatagttcatcttaaaatagtcttagcaaaggtttttctgctcaaggacttgattgtgaaaagttgttctgaatcacttagcacttaaaagcttttttttttttttggagacagggtctgctctgtcatccaggctggagtgcagtggcctgatcatcagtcttgaacccctgggctcaaatgcaaatggtcctcccaccttggacccccaaagtgttgattacaggcgtgagccactgcgcctggcccagaagagttttaaaattgcaattggagtagccatagatttatagaagtcctctgtaggtttcaccaaatgtgaacactaaatgaaactttcgcaacactaaaatgaaacttttttattttgcaggctgaccagtgcaccggtcttcagggcttcttggttttccacagctttggtgggggaactggttctgggttcacctcgctgctcatggaacgtctctcagttgattatggcaagaagtccaagctggagttctccatttacccggcgccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctacccccgcatccacttccctctggccacatatgcccctgtcatctctgctgagaaagcctaccacgaacagcttactgtagcagagatcaccaatgcttgctttgagccagccaaccagatggtgaaatgtgaccctcgccatggtaaatacatggcttgctgcctgttataccgtggtgacgtggttcccaaagatgtcaatgctgccattgccaccatcaaaaccaagcgtaccatccagtttgtggattggtgccccactggcttcaaggttggcattaattaccagcctcccactgtggtgcctggcggagacctggccaaggtacagagagctgtgtgcatgctgagcaataccacagctgttgccgaggcctgggctcgcctggaccacaagtttgacctgatgtatgccaagcgtgcctttgttcactggtacgtgggtgaggggatggaggaaggcgagttttcagaggcccgtgaggacatggctgcccttgagaaggattatgaggaggttggagcagatagtgctgacggagaggatgagggtgaagagtattaacctgtgtgctgtacttttacactcctttgtcttggaactgtcttatttttgttctgtaaatgtctattgccgtaaattgttaataaaattgaagtttccattttaa

SEQ ID NO: 37183 - DNA, 24286 bp, Homo sapiens
aaagctgcggcggcggttcgcgtttctcgtgtccgcttgactgacagctgcgcggcgggagcgggcggcgcgagcgggaggcggcggcgcaggtactgcgcctgggggttgtgggggcgtgcggccagggtcccgtggccggaggtgtccgaccgggagcggctggagccggacgcgagcggggcgcgcgagttcgagcccagagccgacacgcagcaacaagtggggtccggcgcgggggctcggggagagggcgggcgggggccggggcgggtcttcctgccgcccctcctggccgcgccgagtagtgggttcctccgcctcggcctctgcccgcggggtgtccggggctctcggcgctgagttcgggggtcccattctggacgcggcccagcccctaggggcgccgccctggcctcagctgcgcaattacagcccccgccggcagctccccgccccgggctcctgtccgcgttctttccgctctttcccgggaatggggtcggggtgcgccctcccgggtcccggctctgctggctgctcgccgtcccgagctcccgacgctcagacgcgcctctgagcacggggagaggggacccgggagggaggtcggggagggagtcgtggaagaggtgctttttgagctgaacctggaagaccccggcacaggggatccctgggcagactcccggaggctgcactggcaggaccccctgaaggcctcagctctggcttgccctggagctcagggcctacggacgacgagggacgaggagcccgtgtctctcggatggagtgcgggggggctggcaccagcacccttcttgctgtgcccctggggtgggggtgaggaaatggggggtcggtgtgcagtgagaggcaaagaaggctccttggaggtgcgaggtgggctgtgggggtgggtgggccgcaaagcggcacccatggggggctctgggctggtttgccggcctggggcttctggctggggtgggacctgtgttgggttccaggcatcagctgccgctttctcagggcaatgctgcgtctgccttagttgcagaggaggaggacgaagggttttctgggtccggagtggtgctagccagatccactgcacgcttggggtttccgctcccaccctggccagggccctgggcagcttccccagtggcatttgccataccccacccagccacgtgcggagccacgagccgaggccacttcccttccctgaccccctccccccaggatgagtggacgcacatcctgctctgggcagaagggcaggacaggggccctgagtaacggtggcctggggtcagagccaggttcagctgcgaggctgctggtggctgtggaggtgaggggggcaggggggtcccggatgttagcagggtgggccctggggagtgggtgggggcctggaggcttcttggaggagggtccagggcctgtcccgcccctgttcctgcctgcaggagttgtttactcagagcaaggggtggtggggagtgagctgctctccaaatcctggcttgggccaagctgacattcttggaattccgagtgtgtgcgcttcctatccctccatttcccagcagagcccctgagatctggagactgccccagcctcaggctctgtgcatctcccccgagcccccaccacatatgtgcggaggcccctgggggcccaggcctgtcctcagtcccgactgggctctacctgaggaccctggggagcctgggcctggccctcctcaggcaagcgggggtgggagggagcctggtggcggggcagggcactgtgcccgccagcaggggcgggtgggggcccctctctcctgggtgtggagtgttggcgcagactcggcctggcttctgggggggggggtctgggatggggccaggagggtgaggcgctggttttatagaagggggcgttgtggagcctcctgtggtcagggcagggcacagggagcagagggtgggctcccccggctgcttcctgctagaggagggatcacttcagggcaaaggaccaggggaaacccatgattgaagttttagctgctgacccctcccaccctgggtgttgccctggaaacaggccagccacgggaccaggagggctgggagggggagcacgggctgagccctggctgggattcagctgaacttgcactctggtctgggatcccagcccacgtttccctgtctgtaaagctcaggtgggatcagaaactgcccgcccggagggctgcatccctcctgccgctgaggctgggcatgaccttgactgggagagggtgttgaaggtgtctgtccccagcctcgcccccacacctgtgctctctggccctgtccatgcctgggacagatgtgtgctcacccccagggtgctgtgggatggggtgggtgcacacggcgccacgagcacacgtgcccgacacctcagcggtgcacacagccaaggccactgcccaccgtacccacgccgtccgtgtcctctctacggtcctgggagactggcgttgtgagcagtggggcctgtagatggggccgggtcctctctacggtcctgggagaccggcgctgtgagcggtggggcctgtagatggggccgagactgaactgaccctagcctcaccactcatatgtcggggctggtgatatttgggaatgtcactgcctgccatgcagctgcccaggcctgatgtgcccccccagactgttctataggggtctaggttgcaggggccagggccagggctgtggtgggatggcacctgaggtgcggctgctcctggagcctggggggtgtgggaaggtgccccccacccagggtcctaagtctgttgccttcacccccgactcccagcagataaatacccaacagtgcaggaaaggattacagggaaggcctggagtgtggggttagcctcggtggtcccaggaggaaagactgggggacctctggactatctgtccctcccctggggctgctgggggtatcagagtggtgtctccagcctccagggctcaggtttgggtgggaggggcctggtcccacccagactctgtatgtagcccccagtccctgctcctctgtgtgcatgagggagtgccagcttgcttgggaccccccagggtgagggcttgggacgggcactggggccccgcaggggctgaggcagccaggaagcccacagcataggctgtttgtgttggcgggcctccctacctcctcaaagctgcctcagagcccgtgggcctggggggccagggtgtgtgggcttggctctgctgtctgtcctgagctgcccctgctgagctgtgtggagaccccgaggtctgggctgggccaggactgagctgctgccctgctgctggggctcagagaggctgctccacgggcatggcacccaggctgctgcagacaggctgctttatcatgtgggcaggcccctctttgggttggacctccgtctggccttgtgggtgtctgagatctccttgcagctcagtccccagggcttttccaacctgcagagctctggatgtctcttttggggctctcgctcagccagggttggggtggaggctctatggttccctcctgcccttgggctactggaaggacagttacctcactccagagagctagttctgaggggcgaggtgttgcggggttgagccagcagggcagggagtagtgggcactgcgtttggctgcccaggtgggtttggggcctctccctggccagaaatccctgagtgccaggaggaggacagactccccagcctggcacccatggtggaggagggccttgcgggtcattgctggcagctccatagggagggcgtgaggccccttcctgagcctgggtgtctgctcagagcccaaggcagggtggggtaggggtgcttgtgcctggtaggaagcagacagcaggctggtccaggggtccaggaccccagggaggaggcactgctgcgtgtctgtgtgggtgcaagcatgtgtcttggcctgtgtctctgcatgtccgtgctgtgagtacgtctttgaacatgtgttctctgcacaccgtgtctctgtgagtgtgagtctgtgtccctgcctggctgtctcagagccctgaaggagcagaatttggtgactcagtcattgattcagagctttcctggttggggctactcctcagtggtcttcttctccgagtctggtggtgtatcccctgcccaccccgactgcccctctgccctgtagggacctggccccaggtgggggttccctgcccttctctgggagcatctctggctgtacagctgagggtggaagccagggctccactctgcccatctttccttttgcagagcttggggcttccttggtcgcacccaccacctgcctgcccactggtcagccttcagggaccctgagcaccgcctggtctctttcctgtggccagcccaggtatgtcagggcccggctgggctggatggttgtggtgggcagcagtgggcttgcctctgggtctcactttgccagcccaggggccttgccagcggacactttgacaccacacctgagtatctaattggagctcccgtggggaggggctggactttggagacagggtcccagaacaccccgactggggtgttgaaggaccctccccgactgagctctgacactgtgccttgcccgggcccctgactgcgtctgggcaacccagtgtgaatcttgaacttggcaacagaagcaagcccagctccccgcccccacccccccccaaccccgctcctcctgaccctcggtggccttgtgaggtttttgatttcttcttgaataggcttcatctgctcacctgggcgatgtgtgcagagctttgtagatgggaaagggggtgggaggggtcttaggggacactgggactgcatcctgggcgctgggctcagtgcaggcacccagaccagctctcccttcgccctcccacccgcctgggaccctcgagccttgcctgccacttccccttccacccccagccacagagggacgcaggggagatggggcaggggtgccactggctagcctggcggcggatgctctccttggggtggctcgggtggtgtttttgactgcaggtggggtctggcttctcccagtcagcctggggtcctcccgggtccccgtggcacctgcccttgcctggcccacgagtaggtgctctgagcgctgcccaggtcacatgtgagctccctggaggcgctgcacacggctgagtgtctgccctcaggttgcacctgcgtggccaggggaagggggccgggcgccatctgctctctgggcagagctgcgggtgagggtttctgtcagggttggggtcccagggctcctggggtctctgctgggccccgatgcgtggccgccgttctgacccattcctggggcccagacccaccaaagaacccccaggggaaggacagggtaggggccatgggaagccccaggatggccttgtgggccttcaggggacctccaggccagcctcctgttctctgggggccccctgtccccttcccccagcgaggacctgggcatggggtgctgccctggggcttgggctgcagttctctacagagcccttggggggcagcagaggcttggggcacccagcccaggtcgtcaggggtgggcagagctgcgggacctccctgggcacccggggcttccacggcagccctccccagacctgccacctcccacatcagtcactccaggaggacccaggcctccagagctggtcagccctgccatggagcacccccttcccctcccttagcttcctctccctcctcttcctcctgcccttcctcattccccacctctgggcttcaggtcatctgccaggaatctgggccacgtgctgatatcttcccaacaccgcagggcccttgtgccctgtggtggggctggggcttcagaggcgtggggtaggctgcagggcacagctgggggcctctgtccccatctccggctgtgggaggtgtgtgcgcatccggcgtgatgacacccaggagtgcaggcacatctgcgcacggggccggtatgtctgtacctgtcaaggggtggggtggggtcttttacaggctgacttccagcctgggctggagcaaaatgaaattctgggccccttgtttaaaaattaccaagaatttcaagacgggaacagcagagcatcaagccagctggggtgggtgcgcgcgactgcccttgaagccggccccgctcccgcattggggacagcacggggcggaggccgagccgggcccacctggagcgctctgggtctgtcctggggctgccagcctcctgcggggctgcctggtggagggggggtgggtatctcaggaatcacacctgcgcttttctgtgttctggaacctcccatatagtcaaagactcaacgacacctgctccatgcagtgcaggctgacccagccccccacccgccgccggcactcagggcttccccaagggcgcccggggcggagccgcttcaagttgccaccagacagcaacggggtcaccctccatttgcgtagtgctttgagtatcgttctcgtggttggaggtctccaagcccggcccggggccagagtccgggcgaggtaccgtggggggaagggctgggggtgtcggtcgcgggctaagagctgcccaggtttcatccccaggccccggccccggcctccagtcccctcaggcgcccttcgcgagcatcttcctcccgcgcgcgaaggtgggggggctggggcgccggcgcgggcgaaggggccggggtcgcggctggtgcgttgccgggggctgcgattggtccgcccaggcggagcgctggggtttgccgggcggtgcggcgaggaggggaggggtccgcgcgggggcggagccgccggggattggccgggagggcgcggggcggggcgcgcggggtcgggggcgcgggggccgcagcgcgcgggccgggcagatgtttgggttccgccgccggggtccgagcggatccgcgcgacccgctgccaccgcgggggccagagcgggagcaggagcggggccggagcaggcgccggccggcgggatggggcgttccggggcggcgggtgcggggcgctgagcggcggccccggcacacccgggcgcgatgcgccgctccagcacggacgagtccacgtaccggcgcagcccctctccggagggcaaggagccggacttcgcgcgcggcggccccttccggcgctacagcagcctatacgggcgcgcgggcggcggggacgccgggggctccttcttcggcctgcacgcgaaccccggccccaaggcggcccaggcgcgctacacgtcgcccaagggcaacaagtacgtggttttctacctggacctctccttcatcttcctcctagaactgaagcgctgcggcatggcgcgcgcctgcctccaggccgtcaagtacctcatgttcgccttcaacctgctcttctgggtgagtccgggggccggggtgggggcccgggaaagacccggggtccctcccgcggcgggtcgcggggtctggggagtcggagtcgctgccccggccaggcgttgggtgcggttgtggggatggtcccgggaggacccaagaccgctgctccggctaggagcctggactgggcgggtggggaaggtttgcaccatcgcggggtccgccccctgcactcagagcggctgccccacgccctggtcccctctcctctcctctcctctcctcacttgatgagacgggacacgttgcacacgtgcgcgccggacagggccacccgggcactgcgcctctcctagggtcggggttcgagtccgggtcgtggccagttttgcgcggggccccggtgcctcctctgcgcccgctccctcctcggtgcagccgttatccttgcctcggccccgcccctccaggcaggcgacctgtcgggcccagggactcacttccgagggtttgagccggctgccgccaaggtcccccagtcgccgggaggcgctgcggaagggaatcctggacactgagcagggccgtgggccatcagtgttcgcgggagacactggctttcccgcgcctccggcagcagaggcttccctaacttttgcggaggtggggtcaggtgtgctcagacctgcagtggtgtccgggggggccctgtgtgctggatggagcagagctgaggtagagggcggacagggttccaccccaccccagccccatgtcagcaagaggtggggcaggattcccacctggccaggttggagcaagcctcatggagccgcgaccctgtcctgtccctggctcctgtggagggcagctgcagttgggggtggccgaggatgacctggaccgggcctggggctttgctggctgggctgggggaggtgaagtgataccaaggtcattctgtgccctattcttaattcctgaaccagctcctgcagctgggagtcgggggtgtggcctcagctcctgcctaggctctgggcttcagaaggaggctgtccatctgcataaggtccagctgggccaagtgcccagaagcctgggtctgccttcccacctctcccctcctgagcccaggctccttctctagccagcttggggtggaggcaggggggtccctgggagggacagccagcctgggttgcctgctgagtgtgacccaaggaggctcttggcccagacatccacctccagaaggggtcacccaagggtttgttttctgcaagaggctctggaggggtgaggcccaggcctgaggggcgccttggaggtaggggtggtgggaggtgtgggtgtggtctggagctggtgggtgtggggggtgggctgcaggtggctgagtgaccagagtgtttctgtgacggggggacggggcagaatgactgaagggcagtgggtgtgggggcccggcaggcaggcaggcaggtcctgggaggggaagccctctctcctctccaccctcctcctgtcctccgtggcctggacacctgccttcagggagaaagaagagggtcctttcccagggggggtctctctgctctgagagcagcccgccctcatggaggacccccaggtggacctctctttgctctgtgaaccccagagaagcctccattcctaccgcatggcagacacactcccccatcctcaacctgggaaagaacacacaaggaacccccttgggaccctattctgggctggaaaatgcaattctctcttttttatctttgttttttgagatagagtcttgctctgtcgcctggagtgcagtggcgtgatcttggctcactgcaaccttccatctctggggttcaagcgattctcatgcctcagcttcccgaattgctgggattacaggcgcgcatcaccacgcctgtctaatttttgtatttttagtagagacagggtttcaccatgttggtcaggttggtctcgaactcctgacctcgtgatccgcctgcctcgacctcccaaagtgctgggattacaggcggccccaattattttttattaatcaatcaccaccttcccgccagtccagcaaactggagccccgctggcttcatacaccagccttggccccccccaaccctgggctggtgcccagtgggggtctaagggtgggggcggggcaggggaaataagaatgagtgggggttttgccaggagagtctgtcccgggctgatgtccacgcctgctgtgccctgagtcactgtgagctaagccctctcctcctggcgtgaggctatttcaggagtcaggcctagcgctccccttccccagggctcctttccttttgggggtgccagccccctgttgtcggggcttttgccgcccactccatttcctactcgttgggagaccaggggatacaacctggcctcctcctcctcctcctccgtcttctcaggggcgaagttcaggggttaaggtggtgggagggacgtccccccggcgggacctcaagatccccgcgtgtgtctgtcctgaccccccgctgccggagtcctgctgggcctgtggggagggcatgggggagccccagtgggcagccagtgaccagagccgtgggcagtggtgggagccggggtggggtgaggaaagttgtgtgtgactggggggctgtgcccgtcctgggtgtggctgtgggtgtgggggcaggggctgagccctgtaagtggtacaggtgcggccagggcactgggaggggttggggggctgggagtggggtcccatgcctggctcgtgtgcggtggtcagggtgcagcttccctctgcccccagcttgcctggctgccccttagctttgctctcctgtgcccttaaccccagcctggcacccctctctcccacctttgcctccatgttctcctcaaagccccccttcttccaaatgcagaccctccaaggccctcacagtactcctggcttccaaggtctctttgggtccaggcctgagcccccctccacacccatggtcaggctagggcccctggtcactgacggcctggggcagcctgggggcctacctgggaggggaagggaggggctcgctccagaaggctgattgacgtatttctttacagcgttggttcggatttcccaggcaggcatctttgctggggtctgggagggtggggctgctggcaagagtctgtgctcagagcctccagctttgggtggagtggggagggttcctggggcagccagggtggggaggtaggatgtgtcctggcctggtggtgggggacccggtggggccttcagagttcagagcactggtgccaactcctaaccccatggacatctggggacatgctacctgccttcagcaaatagaggccctcacccggtgatggcagctccgctggggcacagccactgagccttcctttgagccctccctgcagaggttggggagtgggaagcaggctgcctgtggtggggccggggtgtctcctgggagcctcattccgggggaggctgggtgcagggcccgtgagcctgagcgaggtgtcctggtccaaggcaggtgccgacacagacacaggttagcaatggtgagggcgtggggggctctgctgccctgggacccccaccttcaggcctctgtgctgcctggtcagctcagctgctgccagcgacactcttcccctaatggaagtggaggtcccggggcggaggggagaggacggggcctgctcttcccgcctgtcagggatggaggcagccgagctatttagcaaggtgccaccacgaagggctgtcctcccgccctcctggcctcggctccttccagacgctgctccccagggtgggtgctgctcccctttctcttcacccgcagcaccaggagcttggtggaagctccggccgtctccgcactgtatggttagggcctggctgggggaccgggtgggggttggagtcccacctgccagtgcgggacgccgggcaggttctgccctccttgaggcctcattttcccatctgcaccatgtggggcggtagagggtgaggtccccatatactggcctggctcgggggttgaatggaaatgtgggaggcctctcagttccccaccacctgcgctgatccccggggagaccccccaggtgggcagtgtgagtctcggagccaggtggtccagggccccagcctggaggggcacgggggctgtcctggctctgcgctgcctgggctgtcaaccctggaggtgtgggggcccctcagcctcactgcccactctctgttgttccaaaggaaagtcctggctgcgcttgaggcctctgctctaagatcagcagtgagcctggtggagggggtgcagtgggggccagccttggcttcccctcccctgggatgagctgagacgatgtctggcagatggcatggccggcctgcctggcgctggcctctgggcagcacagtgtccccaagggtggcagagggctctgccttcagctcccaggcctctctttgaggagtttaacatcccaggccagcctttggatcaattgttcggaaacaatccgtttctgaacaaaggccctgacgctggcaaccacagcgtgtctgagccttggggagtgtgtggctccctgtgggtggggagcagcagcggtcggtcgggggacactgcctacccagctgtgggctccaggcagctctggtgctgttgggggtaggtcagacttgtccacccagtgacacaggcctggctccacggggcctctgcaggttccaggtcccagctggcggcagggcaggcaggccgggcctctgtgtggagagggctgtctctgggggcagagatgtggcattggcagcccagggctgcagggggcaggcagagaagtcaggaggcccacgcagggggacgggagtgagcgtgggggacctgggcttccagccgcgcttgtgcgatgtgagccgtggtcctggcctgatgacggcaggccacctccttgctgttcccacgcagccctgctgcacccacagccccgctgggtcacagtctcctcctggattcctgtgcctccagcaaactcctacccaccctgcaggagccagcattggcaccctgggcaggtgcccactgacgagggctgttctgctctccctgctttggacactggcctcagggtgggccttggtcactgggtggggctggtctcctcatctctgggccctggggtcccttggagagctcctagggtcaggggtgagggaacggaggacagatggggatgtggaaacaggacgtcgctcagggcccacagctttaaggaaacaaatcacagcgagccacacagattgtaagtggacagacttgtcatccctggaaaccagcatcccagccatgacggggacgttcccgccagcccagagggtcctgaggctgtgctggctgctagcatccctgtgtctggacagagccctggcccctgcagggacccagccccccatcctattccaaggacgtggctggcagcccagccatctgccacaaagccgcatggccagaggggcagtgggctgagggctgagagctggccagcgtggcccccgtgggcccggagggagcatactcgatggactccagtgactgcacccctgcccaaggcctacaggaggctcaagggggccgtcccgcagcacctgcccaagaggctcaggtgggctgtccagactggaaaagaagggcagagcagagaatgcatgggcctcagcagcacctgcacacgcccagcgctgggggacggccccccgagcctcttgggtgggtgctgagggacggccctccaagccttttgggctcctaatcttgggcagagccatcagttgctgctgaagatcagggtgagcgagtgtctgatggactgagcctggggcctggtatgctggacggacattggccagagatggtctcacgcaggtcctggggacaggttctgggcagtggacagtgtgagctgatgtctgggagaaggacaggccccaggcaccgctgactggaggtgaagaggtctgggacggagcccctctcctgggctgttcccccagctgccatcattcctagggttcctctccccagctgtcatggggcggggtcaacctcccacctgagcttgtgtctggcctgcggcggggcagcagtgagggagggaggctttcagcctattcctatttgtattgagcgtgtggggagggagctcctctggtttccgggtccaggcccagatgctgggtgggaccctgggagggtgcgcaggctgccagccacacccctagctgctccccatctggctgcatttgaccagagggacctggccctcctggcctcagccctgctcatcctgcttttgattttctgtctccaagctaatggggcccattttctcttgcgctttgaggctataattttcctgccaaaatgttttaaaagctgcatatgcagaaacactttcaaaattgcaggtaattttattaaccacgtgcacgcattttatctgtgtgggtctgccagcacgctggggcctcggggcccgggggacgccaggttgcagggcggtaacgcgcgcgtgtggccacgtgtgatggtgtgaggcgtctgtggcaacgtgggctgttgtctgtcacagtgtgtgtgaccgagcccgtctggtgacagtgggtgtctctttcctgccgtctccggtggaggtgaggatgtttcgtggagtgttaattagggaaatcagttcccaccagggctggggcagttgtgggaggggcccagggctggaggtgtagggttccttcctgcccagcccccatggaacggggtttcccacacctggcatggcaccagtcactctgcacatgtcctccctgtgtccttcgacacatccccatggggcgaggggagcttggaacagctcattttcctgatgacaggagaggtctgcgtccttggaaggcagaggcagatggagcaggcagtttgggttttttttttttttttttttgagacggagtctcactctgtcgcccaggctggagtgcagtggcatgatgtctgctcactgcaagctccgcctcctgggttcacgccattctcctgcctcagcctcctgagtagctgcgactacaggtgcctgccaccacgcccagctaattttttgtattttttagtagagacggggtttccccgtgttagccaggatggtctccatctcctgacctcgtgatctgcccgcctcggccttccaaagtgctgggattacaggtgtgagccaccacgcccggccccagtttgggttttaaatgacagttttctctgttgtgctagcacctcccctcagttcagggaccttcacccccagcctgggcatttcgtctggaatgagacttgtggggttgcttggcgcttgaggccaggatgtactctgagctgctgatggccatctcctctcctggggcctcgtttccctctgacctcctgccctcatcacctggtgatctggacccagggccatatcccttctctgcccagttcttggggcagtgatggtgtcaggccgtttgtgggtccccctggtgccctgtctgcccctccacaagacctgggaactgcgggaggatatggggacagcccaggggcaggctggggttcctgtgtgctcgggaatgcccctcagttccgcatggccttgtctgtacatggtgtgtgtgaccttgtgcccgacggtctggagggaccattgagtgggccattgcctgtccaggcctctcctgtgctccagaatgttacgagggacacctctccaaaggggtgggtgggggcgccgcgttcacagtcagcaccctggacagcccatcccccagctgctggtgcatcccatagcagggccaggtcccccgggaagtgggggcatctttgtagagctggcagacccctgcccaccctggggctgtgccccaagcccagtgctcccagtgaggacagattctcttaattagggatgtcccctggcacttctgccacggagctggcctctggtcctgcacactccagacacatccaccctggctcacacacaccctggctcacatgcaccccggatcccacccccgctgacactcaccccggttcccatgcaccccaggctcacatgcactcccggctcacacgcacccctgctcacacgcacttcggctcacacgcactccggcccacacgcaccccgctcacacaccctgctcacccagttcccacgcaccccaggctcccacggacctccgctcacatgcaccccggttcccacacaccccaggctcccatgcacctggctcacattcacgcccgctcacacgcaccccggctcacatgcacccccgcttgcatgcacctcgcctcccacccccgctcacacgcacccccggctcgcatcctgggctcccatgcacccccggctcccatgcacccctgggtcacacgcatccccgctcacacgcaccccagctctcacgcacccccgggctcacacccccaacagcttgcacccccggcacacatgcaccccggctcacacgcacccctgggtcacacgcatccccgctcacatgcaccccagctctcacgcacccccgggctcacaccaacagcttgcacccccggcacacatgcaccccggctcacacgcacccccgggctcacacgtgccctggctcacacgcacccctgggctcacatgcaccccggctcacacgcaccccaggtcacacgcatcccctcacatgcacccaggctcacacacccacccccagcccacactcatccccgctcacacacacccccactcacacacaccctggcccacacgcaccttggctcacgtgcaccccggctcacacgcaccccccctttcacacgcaccccgggctcacacgcaccccgggctcacacgcaccccccctttcacacgcaccccgggctcacatgcaccccggctcacacgcaccccctctcacacgcaccccggctcacacgcacccccctcacacgcaccccgggctcacacgcaccccgggctcacacgcaccccgggctcacacgcaccccctcttacacgcaccccgggcccacatgcactccggctcacacacaccctcactcatgcaccccgggcccacacgcaccccagctcccatgtacccctgctcacatgcaccccagctcccatgcatcccgggctcacacacaacttgactcacacgtctcaggttcatgcatccgtcccctggtgcgtctccgggccgccctccaccgggctgtgctggctgccacccccaagcctcttcctggtctcctgggaagcctcccctatcaccctaagctgcttctggggctggctttgctcagaagccacacccaggctgggcactgtgcccaggtctcctattggctccctgcagccacgaggggctgtgtggtcagagccagcaagtcagcccctgcctcggtactcccaatcctggggcccagagcacaggggtgacccctcttcctgcacccagtctgtccagctcccctgtgcgctgtgcctggcctgctggggaggggctctgggcgtgggtgtcagagctcagcaggcaccaggagccaatggctcagcagagcttcccaagataggtcctgcgctggcagcctccggacagcgttctgttttgaactttaagcggagatgctacctctggaaggccggggaaggacagagcctgccttctccccaggatggcctgagcgtgtgtgggacttgtggggccccagcagtggggggaatctgctctgaggggattttaccctgtggagcccagagggaccgaagacaccagtgacaggcctggcctgaatcttggggcaccagcagccatgctggcccttgggcagggagctgtgtcccatctccccagcacagcctcctgcctgccagccagccagtaaaagggtggcggcctccaacctccagcctggcgctggctgatgcactgctcagggaggggcaggtgagcgtgcacacgaggagggggcatctcccacccccaggccccctgaggcaagagtgttggggctcatgggccctccgtgggccctgccagggtggaggccccaggcctgtcttgagctgggctggtgttgcaggtgggggtggggcggctgctggtggccagcagctatcccagccttggtttctgtctggaaagtggggtgtgagtctggccactggggcttgggaggcttttatggggtgacttggggcttctggtagtcccccgggaacccccagagcctggggtctgagcctgtcctcaggcatgtggtctgggtgctccaaggggtttcatcaggttgaggggtggctttgccagcccattcccaagtcctgtccagtccagggtggggcagggatcccccagggctgcgcggcccttccccagaaccagtcaaccgtcggcaccccaggacgtctacccaccacccacctgggcacccacgctgcagaccgggagctggtcagcattttcgggggactgcttgtcccgtgcccaggcctggaacatatctcccgtctcatcctgaaacggcccaagcccgaggcctctgtctgaaggtggggtcctggcggacccctgcttcccttgaggccttgctgggccagcagcctagcaccctctctctgggcgcagcaccccctcgtctccccctgcctcttcctgttttaattgatttttataagaacaagcacttaggaaacacagtaagagctctggcggttacagacactgcaggaggtggccctccgggtggcaggtgctcctgtgggacccgcctgctttgttcccaccagtgcccatgtggctgtaagaaatcataacttggccgggcgcggtggctcatgcctgtaatctcagcactttgggaggccgagacgggctgatcatgaggtcaggagattgagatcaagaccatcctggcggctgggcgtggtggctcacgcctggaatcccagcactttgggaggtcgaggtgggtggatcacgaggttgggagatcaagaccatcctggctaacacggtgaaaccctgtctctactaaaagtacaaaaaattagctgggcgtggtggcgggcgcctgtagtcccagctactcgggaggctgaggcaggagaatggcgtgaacccgggaggcggaggttgcagtgagccgagatcgcgccactgcactccagcctgggtgacagtgcgagactcggtatcaaaaaaaaaacaaaaaagactattgtggctaaaccatctctactaaaaatacaaaaaattaaccgggtgtggtgggggcatgcctgtaatcccagctacttgggaggctgaggcaggagaatcacttgaacctgggaggcggaggaggttgcagtgagcccagatggtgccactgcactccagcctgagcaacagggtgagactccatctccaaaaaaagaaaaaaagaaagaaatcataaccaggagcagagtgtgagggaatcagcgtttctcctgccacgagtgacaggggacagctggggacatcacagagatcttgtcgggagctgggaatcggaatcctgggaccacctgccaggaagccccatcccggagtgagggcagggctgggtctccctgacagcacagtctggaaaggctggagtggcctgtcaggtggggagtgagccttctgccctgcgcagaccagacggtgaagcggggttaggggtgtgcagactgcgtcctggggcctaagatcccgtccctttggctccaggccaggggttgggcggatccctcctagagggagtggttcagaggcacaagggagcctccccgactgtggccatggagtgtgggtttggggatggggtgccagcccagggtgtcgggaaagactggcctgccctggacacccccccgggctgccgtgggatctagcaggactctgggtggttctggctcaggctggcaggcggcatggctttgggcttgtgggccgggctctgccctggggtccagagcttgcattggggcctcaccctgtctgtgtctctcctgttgctgtgccccagctgggaggctgtggcgtgctgggtgtcggcatctggctggccgccacacaggggagcttcgccacgctgtcctcttccttcccgtccctgtcggctgccaacttgctcatcatcaccggcgcctttgtcatggccatcggcttcgtgggctgcctgggtgccatcaaggagaacaagtgcctcctgctcactgtgagtgccggggcccaagcgatgctccgggtgggaccacgcagggtggggctccggtggcccccaggccttggctgccgcagtgaccccccagacgtgggcaccacctctggggccggacctccaggctggcagtgtggcccggggccctggccactgttgggtcttccaggccacactggggctggggggtgatttgcagagcggtgtgggggtcactcaagagaacgtgctgtaccttgtcaggggcctcccctgacgggacactggccctggtgagtgcaggcacagccccgcacacacgtacacacgcatgcgcagcctttcacgggcttgcggtctccgtgactcattcctgaccaccccacccccactgtggccccttccccagcttcttgttgggggcctggtctctcagctccctgggaccggctgctgggacgatcccagcccccacctcgcctcggggatggacttacaggcagggatatgtttatcctccttagaaatgttaatcacagataattaaaaaggaaaagggctcctagatggaaacacaggcttgctactgattaacatgcctggccgaggccgtgggccctgcggagggtgtgcagcctgctgaggtcctaaatcacgaggcttccgatcactcctttgtctgggaagccctggatgggttggggcctcccttaggtcgcctcagccagtccactcccctccgtaccccttcctgggggcaagccccaagtctatcagcctccctggcatcaggttggggcccagagacccctggaggcagtcggtgggggtctgtggcagccctactggggcttggagctcctcagttgaggaagctgctgtgtgtgggccccaccaggcctgcagggaccgaagcccaaccccctttcccatgggtgacttgggaccagaaccctgggtacctcctgggggtgaaggactcctgtgtccttagcccagcaccctgtctgccccactcacgcccactctgcctgggccccccagctcctggacacatgctgtccatgcctgccctcctcttttgtgggtgtcactgacccccgcatggaggagcagcagggctggggtcaggctgagctttggggctgccgccaggcgggggaagcttgcatggtcagaggtggggcttgcagcctgtggtcttgctggagggggcatcagccacgctggctgccctgaggactgtgacgtgtgggcagaaggggcctctgcagcccagctgtggcccctgctgggacatcttcccaccatgaagacaggcacccagcgaggcacctgccagacactcagaggcccctggatggaggtgtcctgaaggcagctgacaggggctggggcctcaggaacagggatttgtgcccacttgggggtgtctgggttgccccagggatgggggcaggggaggggagcccaggccagcccagggccccacactcaggggctgagcaggacacaacagccacagtccctggacctggggccaagggttctgaggtgggggcggcgttctgggctctctgggagtgggggcctggcagaggtttcctggcagcaccaggtatccatgaggtacgtggccctggcccctggcatgctgtggggcggaggctgtgcggcctttcgggtccctgtctgagcctgccccctccacagttcttcctgctgctgctgctggtgttcctgctggaggccaccatcgccatcctcttcttcgcctacacggacaaggtacggctgccttggccgcaggcccaactgcagggctgggggctccatcctcactcccagggagcactgtgggcccggtgtggacagagtggccctgcatgtgccctcacgggcagccaggacagcgggtgtggatttaccaggcctggaggggcagcgccagcgaccctgggaggctgtgctgtggctctatagcgactggggcacaagggcactgctaccccacccggagggtgcgccccaggttgtcccccgccctctgacgcagcgtcctgagccgtctgctcccagcgccccatccgggccgcgcaccgtggggttctcctctgtagagcggcctcttcttggtcactcactcatatattcagccatttgtttatactgggatgaagtcctggctattgaggttgcactccgagctagaacacactactttgttttgtgaatcacactgtccgtccttggccctggggagcttctgccgtctgctgctgggtcccctgacgtgcccccatcaacagacttttcattttggggcacgtcctgacttcctggcactgcagggcgctccaggctccttcattccctgccctggcccaggaatcagccccttctccagggtgctctgggtcctcactgaatattggggaccgaggccagggtgctgggtgggctcagcgctcatagcccctggctttcagctcacagagcatggctgcacgtgtcccgatacgtggaggcacctgtgtccctgtcctctgtccccccaggacccatggtcctcccccagcctggggaggaagcccagaggtgggggccctgggcctcagggctgctgggaggacatggggccggtgtgtctgcagcttggtgggctaggaggcgcgggggacacaagaccaggcgcaggaggggcccagcttaggggccggcgagggggtctggatgagggaggcggggtacagtgggaggggccctgctgaccccccccgcacccccagattgacaggtatgcccagcaagacctgaagaaaggcttgcacctgtacggcacgcagggcaacgtgggcctcaccaacgcctggagcatcatccagaccgacgtgaggcgtgggcaggtgggcggggtcggcgggtgccccctcccctcctgcctcagcccgacctgagcttgccccccagttccgctgctgtggcgtctccaactacactgactggttcgaggtgtacaacgccacgcgggtacctgactcctgctgcttggagttcagtgagagctgtgggctgcacgcccccggcacctggtggaaggcggtgagtgagacccccaccctgggggctggtaggggcctagagggcgggaccagcaggccctgccgtgacacgcatgacatccctccctgcagccgtgctacgagacggtgaaggtgtggcttcaggagaacctgctggctgtgggcatctttgggctgtgcacggcgctggtgcaggtatggcctgggggcctgcgggctccctgcccccactttgttaggaccttctgagcccagggaacaaagtagcaaagaccttgcccccaggaacccacgatcgggggaggccggggcaaaagcaggagggcgagttcagggggatgggcagggacggcctgtggggacagtgggctccctcttagtggacagaggcagaggctggtgtggggtggaggccggtggtcgtccatgttggtcggtggcccaggactggccagtgcacagagggtggcagctggggccctggtgccagtggcccctggtttccaaactccacagccctcaggaagttctgggtgtcctcatgcctgcaaggctcaggggagggtgctgtggctcgagccacaggggttgggtggggcgtgcaagccaccaggaagctgaagggctctgccactgtgtcgcccaccctggggtcggggtcagggccagggcacctgctgaggacagggactgctctgggcttgaggcctgagcctgtggagctgccatgcccagtcctcctcccctacctacagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctagctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagc

SEQ ID NO: 37184 - DNA, 24286 bp, Homo sapiens; identical to SEQ ID NO: 37183

SEQ ID NO: 37185 - DNA, 13175 bp, Homo sapiens
ccgcgtgagaattggctatatcctggagcgagtgctgggaggtgctagtccgccgcgccttattcgagaggtgtcagggctgggagactaggatgtcggacacgtggagctctatccaggcccacaagaagcagctggactctctgcgggagaggctgcagcggaggcggaagcaggactcggggcacttgggtgaggcactgggctgttggggccgaggctcaaccggggaggacgggcgggatccctagagaaaaagctccagagtcactgccctttaccaaacggccatttctataaagcctcgtacattggtactccctctccaccttcagcagcagacgttcgcccttctgcaagtagttcgcggttcctcctcacgctgggcctcggttcttccagctcacttttaccggacggacgcttgagccccaccctcgtccgccttgcccactcctcttcagactgcgaggacgtcgcctttgtgaggctgctcagccccctatcccgcgaagcagcaagaacccctttttgttgctgctttggcgctttgttccctcagttataacgactcttttgtagtggtcatttcttggcagctgtgggtacagtaagcgaggaatgaacctttatatccgcagtgcccaatttagtggcccgtacagagtggcactgggtgtttctgaatgagtacccctaccggcattgacttagccatttacatacctagcaggaatctgaaaacatttgtgtttggtttccaaactttttctcttctcctgttgcccccgtgtcacgatcataaaacttgaaggaaatttaaaagattaaattcactgttatccactccctaccctcaggacaaactctgaattatttaaggcaaactagtaacaaagctctgcaaaaatagtgactcagtatcacctttgtggtagattgttccaatatttgtcagtatcttcaactgcatctctaaatcttgtctagatcatgttaggttcatgtgctcgtattctggcccctagaaatagaagatgcactggcaggatcctcccacctaattaattacctttcttgagtatctacagtgttcatgggtctaattagacaaaaataaggaagaaattgcccctgtcctcaagaagtttaaaaagcataggattcaaggggagacgcttacaaaaagtgaggaatatgataagatatatgtacgaaaccaaatgaatgaatctacagtctgtacaatgaagagaagtaacaagagctggtgtaggtagtgaagccatcaaaaccatcatagtggaattggcacttgaatttggcctttatggctatataggacctagataattaaagaggtaagaggggaggatagtggagtaagaagtgcaagtcatatggtcaggcaataattagtagtcaagtctcagagtagttcctgaattacctaagagggagaattttttttcccttgctctagaaacttcattgatttatttatagatacaattttttgttttgttatgttttttcccctattctttggtttcctgttttgaaactttttaaaaatgtgcataaatgatgccaacgactttttttgcttttgtttttgagatagcgtctctcaccgttgcccaggctggagtgtagcagtcctcccggctcatcctcctgagtagctaggactacaggtgcatgccaccatgcctggctaatttttaactttttaatagagatatggtctcattatgttgcccaaatttgtcttgaacacctgggctcaagctgtcctcttgcctaagcctcccaaagtgtttgaattacaggtgagagccaccatatccagcctatttaattttcctgtggagtcttttcccattcagcaatggcagttgcaaaaggggacctgaggatcaggtagttgtttgtttcaacaaagtgatctgcaaaattatttagttagttagttagagacagggtctccctctgtcacccaggctggagtgctgtggcatgatcatggctcactgctgccttgacttcccgggctccagcgatcctcccacttcagcctctcaagtagctggggccacaggcgtgtgctaccatgcccagctattttttgtatttttggtagagaaggggtttcaccatgttgcccaggctgatctctaactcctgagctcaagcaatccactcacgttggcctcccaaagtgctgggattacaggcgtgagccaccatgcctggcctacaaaattaacttttaaaaagccgctatattggtgtactacatcattgactactttgtgttcacctttctgtcgtttttgtgacaggccatcctctatctgtggtggtgtttgttgtttcttggttttaattgttcctcatcatacttatttatttatttttgagatggagtttcgctcttgttgcccaggctagagtgcaatggcgcgatcttggctcaccgcaacctccgcctcccaggttcaagtgattctcctgcctcagcttcctgagtagctgggattacaggcatgtgccaccactcctggctaattttgtatttttagtagagacggggtttctccatgttggtcaggctggtctcaaactcccaacctctgctgatctgcccgcctcagtttcccaaagtgctgggattacaggtgtgagccactgtgcccggcatcatacttctttatacttttccatttctaaattcatactctttcaatgaatgattctaattgctcttggtcattttaagtttcatttcatttttctatgacattaactacattttggtattaaccaaactttctgctgtatgcagacctaactactagagccttgatactttgatccaggtccttgctaaacatgtttaatatttttgacaataagactgtattctccctgcatgtacatatccttttttatttttatttattttttcttttttagatatgaatatctcttgatttgtatatttagctagtaatatagctaagacccttttctgtgtgtgtgtgtgtgtaagacaagaatctcgttctgttacccaggctggaattcagtggcgtgaacacagcttactgcagtctcgacctcagggctcaagtgatcctcctgcctcagcctcctcctgagtggctagcaccacaggtgtaccctaccatgcctgcctactttttaatttttatttctttgtagaaacagggccttgccatgttgcccaggctggtcttggactcttgggctcaagctatcctcccaccctggcctcccaaagtgctgggattacagatgtaatcccagtctagttaagactcttataaaagtatttttggggttgtaattaaatgtatcttgtcttctgaccgagagcttgatctgacccatcatttggtactgtggtaataggtaaagatgaaacatacaaattaaaccagaatgtcactgttctttctgtgttattttgattatttcaaagaatgtattttgttgagctttaggattcttaggaaacccttgtgaaacactgtattgtaagtttatgaatcatgttgtcatgtaagatataactcaagacttgataaaagttcagattattccattcgtttctcaccggaaataaaaatttgcctaccacatctgttgcccaggctggaatgcagtggcgcgatctcggctcactgcaagctccgactgccaggttcacgccattctcctgcctcagcctcccaagtagctgggactaaaggtgcccaccaccatgcctggctgatttttttgtatcgtttttagtagagacggggtttcacagtgttagccaggatggtctcgatctcctgacctcgtgatccgcccatctcggcctctcaaattgctgggattacaggtgtgagccaccgcgcccggccacaccttgttttttacagcattactgaaatctgataattaccgactactgaactgagtgtcaaaagacaaggatataaaatgaactaaaatgtacccaccacatcgttaatagtggaaaataatatgggcaaaatattgggagacctttgttagattggcatttttattatttatttatttatttatttattttttgagacagagtttcgctcttgttgcccaggctggagtgcagtggtgccatctcacctcactgcaacctctgcctcctgggttcaagcaattctcctgcctcagcctcccgagtagttgtgactacaggtgtccacagcctttggaaggctaaggcgggtggatcacctgaggtcaggagttcaagaccagcctggccaacatggtgaaactctgtctctactaaaaatataaaaattagccaggtgtggtggcaggtgcttgttgtatgtactacaggcacatacaaccttgcctggctaatttttagtattttttgggcaaaacgcccaacagggttttgccatgttgcttaggttggtcttggactcctgagctcaagtgatcctccatcctcagcctcccaaagtgctgggattacaggcataagcctccatgcctggcctccttccttttgaaggataaataatattccactgtatgtatataacacattttgttcattcatccatgggtgggcgtttgggttacttctaccttttggctattgtaaataatgctgctatgaacctgggtgtatgaatatctctttgagaccctgctttaattcttttttgttttgttttttcttgagacggagtctcgctctgtcacccaggctggagtgcagtagcgcgatctcggctcactgcaagctccacctcctgggttcaccccattctcctgccttagcctcctgagtagctgggactacaggtgcctgccaccacgtccggctaatttttttgtatttttagtagagacggggtttcaccgtgttagccaggatggtctcgatctcctgacctcgtgatctgcccgcctctgcctcccaaagtgctaggattacaggtgtgagccaaccacgcccgaccgagaccccgctttaatgcttttgggcatatacccaaaagtggaattgctagatcatatggtaattctatttttgatttttgaggaagcgccatcctaatgggtgttatatatctcatgttggtaaagtatatttttttaaaaagaaaaatattacttaaaaaaatctttattttggccttggcaacagagcaagactccgtctcaaaaaaaaaaactttattttaatggaaacaaactatatttggccaggtttagcacatagtaaatatgtgaagtgctccagtatatttcttgagattgaagatgtgcatatagatgttgacacgtttaaggattcagcaaatttgtaatcagaccatattaatttcagtggttctcttaattaaagggtgaatcaagtgttatgtattattttgctaaaccgaacacattattttcgttagattagaagcagaatgtcagtgtagttgcagcagagcggaggcattgagtaaatgtgttgaataaataaatgaataaataccttatgaaggatttggaacccagggattcttatcattttctggacagtaaccggttttagggatgataaaacttttccccaaatgtctgtatacatacaaaactttgcacgtgaaaagtttagggaatttcacctgaataacaattgtattaaccagcagttaagttttatccaccacattaaacataagctccctcctcctgataaccttaaaaaaggtattttcagctctaatattctgaatgtaatgttggggaaaaaaaacctcccaggaggtgttattaatacaaggattcataaccagaattacatcaccagatattggaatgagcagtattaaatcagtcagattaccaatgagaaaagtcaataccaacttgtaaggactgaaatatttatgttaacatggttctttttatagatttctcacttaaaaattttctcactcacttaattactcaaagaacatcttcagttactaactggagaaactgaaaatgaaagaagaaatgggtgagagtggaatcctcccacctcagcctccccagcagctgggactacaggcacaggccaccttgtgtggctaatttttaaaaaaattttctttagagacactgggttcaccatgttcccctggctggtctggaactcctgggctcaagtgatcctcccaccttggcctctcacagtgctgggattacagagataaggcaccacaccaagccctgagtcagattttaataaattcagtttccattagagtggaaaattttcaaattaatgaattatttatttatatattttttgagacagagtcttgctctgtcgcccagtctggagtgcagtggcatgatgttggctcactgcagcctctgcctcgtgggttcaagcaattctcctccttcagcctccccagtagctgggattataaccttgcatcaccacccccagctaaattttttttttttttgtattttagtagagatggggtttcaccatgttggccaggctggtctcgaactcctcacctcaagtgatccacccaccttggcctcccagagtgctgggattacaggcgtgagccccagtgccttaccagaatggaaatatttaagtaaacaaaatatttctaaatgtaaactaatggcctacttatttagcaatttcagttcagttcttaggagtttaatatttcatctatattttaattaaccacagatattaggctttctcaaagataacattttgtcctaattttagtttctcaaatcgttattaaggttatgatggcaacccagcttgtgaagtaatagatgataataatatagtcaggaaatatcatttggtaaccaaggcttcagcaaagtattaagatttttgtgtttgtgagtgttataggtaacactgttggcccccaacattgtcattttgtacactttgttgatcagtggcctgaattcattaaaattcacactacatgcctcaaaaagaatattggatcccagcctaggttgttgagtatattcctgtcctttattaaaatgtaggttgatagaaaggtggtagggatatttaaatctatcatgctaatttactttctttgtatcacagcaaggatagggaattaggaaaagattactcactcaatagagaaaaggtagatagaaaatccagtattatcttgacaaagcagtgaatgttttagtatgattgaggataggtaatctagtgctaaagttggtcacagaatttcctgcacaaaatgaaagatctgtgtatgggaatgctagagaatttgacttctcagaaatatatagaccaacagtggttgccttttttcattttcacttctcttcattcttagatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacggtaatgacctgacagagttaggatttaccacttattttcagttcacggtcagtgtcttattgcccatacctcccctcgttctctagccagatgctcctgccactcaagatggggtagaaagcctcctgcagaagtttgcagctcaggagttgattgaggtaaagcgaggtctcctacaagatgatgcacatcctactcttgtaacctatgctgaccattccaagctctctgccatgatgggtgctgtggcagaaaagaagggccctggggaggtagcagggactgtcacagggcagaagcggcgtgcagaacaggactcgactacagtagctgcctttgccagttcgttagtctctggtctgaactcttcagcatcggaaccagcaaaggagccagccaagaaatcaaggaaacatgctgcctcagatgttgatctggagatagagagccttctgaaccaacagtccactaaggaacaacagagcaagaaggtaggggtcatgtgaaaatactctcacaatatgctcttaattatagctttgtttgacagggatttacccctagggcaaggaactgtttacagcagtggttctcaactggggatgattccctactgcccaactcccaggggatctggtaatgtccggagacatttttattgtcacacacatgggggagtgctattggcatctagtgggggtagaggccagggatgttgtcaaacatcctacagtgcatagtgggacaaacccccacaacaaacagttgtctgtcccaaagtgtcaacaatgccaatgtcgacaaattcttatttagataatctgtcactgaatctgaaagaattggatcaagagaagaggaatccaaatatatagaaatatagggagatgaatggagaggaatactagaccaattatggaaattgactaaataatgtgaattggttctgagtataagtattggcctgacatgagttcttatctgtttggtacttctagtgcgtgagtttgaacaagttaattaacttctcttgagccttagtcttctcatctgtaacatgaagataataccagcgtatcctgccttatagaattgaatagactctgagctaaaaagtaaagtgtttagcactatactttttagttcagcacccagtaaatatgttttttgtagaaggaatgccttcctggggaggggatgttaacataatgcttagcggtaggaaccaggcctcttccattttaatttcatcccaaatgcatatttgtgaggaaggactgaacccctaacaaatctcttatctgaaggctccaattttccaatattaagttagctaatttaggtctaggcacaatggctcattcctgtaatctcaacactttgggaggccaaggcgtgaggatcacctgaggcgaggagttcaagactggcctgggcaacatagaccctatccctatagaaagtaaagtaattaaaacattagctggcatggtgtcacgcacctatattcccagctacaattgaaggctgagctgggaggatcacttgagcctgggagttcagtgggagaaacagtgagttatgattacacaactacactctggcctgggtgacagcaagatcccatctcttaaaaaaaaaaaaaaaaaaaagttgatttatctcttagaagacattaatgtcaaaaagaatttgcggagttggtctaagagccagtttgatctataagacattttaagtccaaggctacttctgtcacaggtcagtcaggagatcctagagctattaaatactacaacagccaaggaacaatccattgttgaaaaatttcgctctcgaggtcgggcccaagtgcaagaattctgtgactatggaaccaaggaggagtgcatgaaagccagtgatgctgatcgaccctgtcgcaagctgcacttcaggtctcttggaagggaatgaggtgggatgggtttgtcagaagcagccattccttttcagcatattccttccagtcattggggttctgtctgtaatcttatttagtttatggtttgtgtaagtcctccagaccctgaaggtgtactttcagaagtgcattgtgtgggaagaatacaggctgtactcccaaataactgagtttttttttttaaaagctccctccctcttagaatagcaaagtatgtctgtctctgagccacagtgaaagttaaagtactctgaaaggaggataatcttaggagaaaaggaacctaaactcttaggtcagtgttttattctgttctacccaagtctcctgcactgcttgccttccagtggtaaaacaggaaaccaagtctttactcagagaggaattacaattgttctgtagtatgaattatggatttccatgctacctgcctcccttaaaactcttgaaggaagctctaatgatagaattaggggagggtaataaaatagacattttgaaatcatttggaatttgaactgttggatctacatctggagcaccatcttgattctccctttttattttcccagacgaattatcaataaacacactgatgagtctttaggtgactgctctttccttaatacatgtttccacatggatacctgcaagtatgttcactatgaaattgatgcttgcatggattctgaggcccctggcagcaaagaccacacgccaagccaggagcttgctcttacacagagtgtcggaggtgattccagtgcagaccgactcttcccacctcaggtacctgtctgctcagaaaactcgtctcaacttacggacttatgtttgatagggcagccatacacgttaagaaagcagagcataattcagcaatcttgtcttgcttattgggaatggagggggatagataagcttttaagggaataggaaaaatcaaatggaaaagagggactcgggccatgaatctcagagttaaagtagggaagatgaccaaataccactttatgcagtggatctgttgtgatatccgctacctggacgtcagtatcttgggcaagtttgcagttgtgatggctgacccaccctgggatattcacatggaactgccctatgggaccctgacagatgatgagatgcgcaggctcaacatacccgtactacaggatgatggctttctcttcctctgggtcacaggcaggtaatgcaattcagttatgtaggtatggacagatacagtacaagagtgaatactgaatgggagataaaatcctgggttttcctagccccactattaaatgtatgactgatttagtctttttttctttttttgagagagtctcactgtgttgcttaggctggagtgcagtagtgtgatctcagctcactgcaacctccacctcccaggttcaagcaattctcctgcctcagcctcctgagtagctgggattacaggcacgtgccaccagcccagctaattttttctttttgtatttttagtagagactggatttcaccatgttagccaggatggtctctatctcctgaccttgtgatccactcacctcgagctcctaaagtgctgggattacaggcgtgagctaccatgcccagccagtctttttttctactgagtcctaatgcctgtttacaatgcaaattttaccccgaatatatatttaactctacatttgttctttgagaaaggtaaggttgttgagcatagttttatcttttcgttcttagatccaccatgcttttggtggtgtgcatgtaaatgttcactgagcgtctactgaaaaagtgtttatagtgtttttaacacatcacatattttgaagggaaaaaaaatatgggcatacaaatagttgtttaactcatttctttctagggccatggagttggggagagaatgtctaaatctctgggggtaagtagtggttgtgttgctttcttttgagggtaatactgttacagtgagatacatgttctcttctcccagactattctgtgattccttgcttctataaatggtactacccctaaactgtaaaagtttggctaaaattctagttcttttttatgccccacaggtatgaacgggtagatgaaattatttgggtgaagacaaatcaactgcaacgcatcattcggacaggccgtacaggtcactggttgaaccatgggaaggaacactgcttggtgagcagcagtggggcccaattcaataggtggagcacaaagaagaatcatttgatttcttactgagaaaaagttcaaaggtgtggtttcataaggtaatctgttatctgtggtgagcaggttggtgtcaaaggaaatccccaaggcttcaaccagggtctggattgtgatgtgatcgtagctgaggtatgtgcttcccaggcctccaaagcttccacatttttgttggtatcagttattcatgttgggtgtattctcatcccagatttttctcatttagatcataaacataatagaaagggctagaattgcaatcttgtgtaacttaaaaagcagctagtttttatttcctaggttcgttccaccagtcataaaccagatgaaatctatggcatgattgaaagactatctcctggcactcgcaagattgagttatttggacgaccacacaatgtgcaacccaactggtaaggtgaccagagaacaggctagtcctcaaggggctattatttatgattaaggacagaacttagtagagcttcacattgttttacactagtccataaatgagcttcacaggattcataagccacttaagcttgtatttaaactgttttatgagattctacaaatattcattagaaactcaacaggttctaggacccaaaagcactgctccctagggtttctactctcttcacaacccaaggatcttcctcagccattctgtgatgtattgaatctgccccctggtggttacgaagttatctatttaatctgtcaataattacatctttcaccccttaacagagcttaaaacacatgctgctagcattttgcttatccaaagaatactccctggtagcaactctgtgaagcaggcctggctaagcattagttactaaccctcagataatacagatccagtctattttaacaccagaatctatgccaattctgaactagtaattctaccatatactattctaatgttaagctctttttagaattggcatatttgatatgatgataggcagtcttcatttggtatgcattttttaacaatattaaaccctctaattccaggatttctggtttgcccctccttttacactgtttcaggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttcttctttatttaaataaacatttgtattgtagttggg

SEQ ID NO: 37186 - DNA, 18029 bp, Homo sapiens
aggactgagggcgccgtgcgccgaagcttgtggcgtcaatgcgcccgccgtgtccatggagagaagctgaggcggccgaccttcggcccgaggcaccggggcgccgggacggcgaagatgtcggcttccttagtccgggcaactgtccgggctgtgagcaagaggaagctgcagcccacccgggcagccctcaccctggtgagtgctcgcggcgcgcggcggggcccgtgacattgctcgtgtccgccccgtgcaaggggaggtcacggcggccgggagtggggccgcagggacgcggacacgtcagacctcggcgtcgctccgacccgccgcacagcctcgccgcctccttcgcctccggcccctctttgcaacgataaacaagtcccgggcggggctgctctcttggccccggaaactacgtttcccgtcaggccgcgcggcaaccgcgtgcgggccggaggggatcccgggggtgggcgtccccgggggccgatcgcctccacactcctgccggcctgcgctgttcggccgttccggttaagcagaggctgaacgtgcccggtggcgggggttcccggtggtggcccggagtcctagcctggaggtgcgtggggtggggagggaccaggctgtccgaaggaccgctgtgtcggggcgacagcgttcgcagagggcgagcacagcgacaacaaagcccccggctcctgccgaggtcacggccgcggcgcgcaaagcgttacttgccggtgtcctgggtgattgaggcctttgaaactccctctgtgcctctagcaagcctaggctcttaggacaaaagatgatttcccagagtgagtttacagccttttctgggtgaaaggtcaaacactcagagggcaccagagtgcaaccattgattacttagagaattcactgagctcagtgttccggccgcaccgttcagttttttagtggaaggaaaatccacataacataaaattagtccttttaaagggtacaattcagtgccatttaagacattcacagtgtcgtgcaaccatcacctctatctagttccaaaatactttcaccccaaaagaaaaatttatgatcacgttcctacatacactccccttttagtgaaggagacgactttatgcaaccattcgcttagagactgggaaaaaaaacgatttaaattgactcatcgattctgttgcatctaatgccaaaagggcctattaccagaaaataagtttgtagcaaagtagaagaaaattgtgatcaggtgagagaatttatttttataatcaattttttaggcctttgatattaccctgattatatatggtactactagtgtactgattatgtatcattctatattacctcttttctgtaggagcaagcttattttcatacaccgtgggatgtagaattaaacaaggttttaagaactagagggcacaactcattctttgtgtctctttcaatctcagtaagaattattcagaattcttccactggtaatggtagatccaggaagagccagaaggttcaggaacagtttttgccttttcttttttgctttttagcaaccctattaactgggttttttgttttttgttttttgtttgtttgtttgtttttgtttgttttgtttttggagacagggtctcactctatctcccaggctgtagttcagtggtgcaatcatggcacactgcagcgtcaacctcctgggcccaagcgatcctcccacctcaggctcccaagtcgctgggaccaccggtgtgcaccgtcatgcatgcacctagggtctccctgggttgcccaggctggtctcgaactcctgggctcaagcagtccactgcctcaggctcccagtgtgcagggattacaggtgtgagccaccatgcctggtccctgatgtctttctccatcaccatttgacatgttacctcttccttcagaatttcttttttttttttttttttttgagacagggtttcgctgggttgcccaggctggagtgcagtggcgtgatctcagctcactgcagcctctgcctactgagttcaagcaactctctgcctcagcctcctgagtagctgggattacagacgcccaccaccatgcccagcttatttatttatttatttttgtatttttagtagagatggggtttcaccatcttcaccaggctggtcttggactcctgacctcgtgatccactcgtctcagcctcccaaagtgctgggatcacaggcatgagccaccgtgccttgcccttccttcagaatttctatgtcagtccctttctctccattcctagtcattcagcagacatttatcaagatctgctgtgtttcaagacaaatgaatgagttatacagttcccagcctacggggcacagtcgcaggccaagcctttgccacctcttactaggagtaatagcactgcacattctcaggcttggtctctctccacacttgctcccctctgcttcagtacatgttatcatagcagttctcaaggtatccatgttgcctgactcagctgttttgattaacttgcaggagtctactgtctgtactctgttgtcctacttaagtatggctgactttagaagcttctcagaagctgtaccagagagaaggcacatcaatgctgttttccacacagcctgtgttggtgggcttgcagtcattttagttccagcattcgtgccctagtcaggacactatggcatgtattgctctttgtgcttagtttatcatcagcatgtatcgtcaagtgcaaaagtagtgatgccgtcaaaggcctaatgaatggagacagataagagagcaaacaaaagtatacgtaattcagtaaaactgattggaagaggtaaatgttacttgggtctaataagtagagacagataagagcaaacacaagtatacctaattcagtaaaactgattggaagggataaatgttacctggatatataaattttgatgttaggaatttgacatgttgcaacatttgaaaagtgctatatgtgtggagtctaccagatgtcaacaaaaggctaggaaaagtaactgataatataacacagttcaatgctgtcattatcagattatctacatcttccctatttccctacatatctagaaattgacaagtggaattgaacttgcaggagccagatgtgattaaagaatctgaagagtaaatagtgccctgcttgcagacagatttatttccatcattgtacaagtcagagcaactctaatttgtaggactggggtggatcacagctgtgcattaaaactcaaccaagttctatgagagaatgatggtgcacagccactatcattcttgatgaattcattgtgtacggaaggtgccttagggcttaactttctattggagtccagttgagaagctaggaaatgcttaatgctcagtaaggaactgtgtgttagttcattggactagaaccagaagtccttttgaacagtgaccaagcactaagatttctatacgaaggcagtttaggaaatactacacaagaagcactggaagtagcctagcagtctaacagtgaaagaacggttaagtacgtgagagtagatcctgttggtgaaggatgtagtcattgtaaattatggttttttttaagtttcagcgttataaatcttcattctttgacttatgctgtgcaaattatttaatctttaatacctaaatcacaatggcaggaataaaaagatgttacgtttaaaccattaaacacttagaaggtgctcagtaaatggtgaatatatgtttattaccatgtatcaaatgaaaaaataatttgttaaattgtttcaatggaggctgcaaaattatgtatatatgccatgattacaaacctttttctttttagagacaggatcttcctctgtcacccaggctcatatgcagtggcatgatcatggcttactgcagcttcaaactcctgggctcaagcaatcctttcacctcagcctcccaagtaactgggactacaggcacatgtcaccttgactgctaattttttttttttaatttattgtagagacagggtcttgctctgttgcacaggctggtctcaaactcctggcctcaagccgtcctcccaccttggcctcccaaagtgctggcattacaggcatgagccaccacacctggcctacaaatatatatttgtatattatatgtattttggatgtgtatatacacatatacacaaataagaaaagacaaaagagaatgcttttgtcttttcttattttgacactctaatgccagccatggctgttaaagaatgattttaataaaatacactgtacttgttcactggctctatttatttaccatcttttgttcccccagaaaattgatatgttgacattaaaatgccatgtttgtagagaaattaagttgtagttgttggcacatgtttagtatgcataatcacagagttaactttagctttgaatttaatttaattttcttaaacagcaaaaaatgaaaattgcctggggagttacttaaagaaatacaggattgagaatgaaaagtttctcctacaaggattagaaagcgtgttgctatgaagtagtgataaaacattcatctacaatgccttttcccttaattttaacagcggaaacatcttggaaatatatttatttttcaattaggccaaaataccttacctcaaagataacctctcactttaaaagtcatattcctgtgatttgcatgtgagtaaaaaccatcatattttagtgggcttcaggaagctcttaaattttaaaacatgggccaaatctcaggtaagctatattcattaatagtacataaatttcttgagaattacatgtttcttagttgttctgggaagtgcactggtactggcaggctgctaggccctgcagcatgctgtgtagttgaagattttatgctgtttctcacatgaattttacctaagcacaaagttgccagagtatgtagacttaaagcagggtaggattcttagcctctccctggtactgagacacaaaaagtacctcttatagctcgattttttttaagtcccaactcttcccttttaaccactctcccttgttctgaaaatcagatcagtcactttgaaagttctaagaaccttttcccttggttgagtactgacctgggttgtccatcattagtaacaccctcccagtggagtaggtttggttttggcctggcacaggaaaattaagacatattttagttcctgtaacagcagcttcccaggcacacaggttcctgttgaatgttacttttcccttaaagagtccttcagtatgagatgtgaacatcagcaacttggtgataagtagaccaatccccacgaattgctttcatttactgtatttaagtgtttcctgctaaaagttgagaaaataagaaaatagatgactttgtaaaaccaaattagataatttagaaaaccacttggagataaaaaaaattatatatttggggctggtaaacggagtagtgtgacagacacatttgttttgtttagatcatgcagtggtgtgcccatctgtgcctttgatccactcagattaaaccaagaccacgtttcagattttagttcccgcggatattttccatggctatgccttttttttttttttttttttttttttgagacagagtctcactctgtttcccaggctggagtgcagtggcatgatctcggcttactgcagcctccgcctcctgggttcaagcgattctcatgcgtcagcctccggagtagctgggattacaggcgcatgccatcatcctcagctaatgtttgtatttttaatagagacggggtttcaccatgttggccaggctggtctcaaactcctgacttcaagtgatccttccaccttggctgacctcaagtgatacttccacctcggcctcccaaagtgttgggaatataggcatgaggcaccaggcccagccaggctatgcctttttaaaataaacttacagaaagctatttttatttgacagtaagtgattaatttcttcagcatgcacataggaaaatatggtgaaaatttacatgtggttgataagaaagctagcttttattgacaatcacttagaacaggggtccccagtccctgcgctacagactggtactggtccatggcctgttaggaacagggcctcacagcaggaggtgagagcagcaggcaagccaagcattaccacctaagcgagctccacctcctgtcagatcatcaggggcattagattctcataggagcacaaaccctagtctgaactgcaggtgtgaggggctagtttgtgcactccttatgagaatgatgcctgatgatctgtcactgtctctcatcacccctagatggggccatctagttgcagaaaaacaagctcagggctcccactgattgtatattttgatgagttatataattatttcattatatattacaatgtaataatagaaataaagtgcacaataaatgtaatgcatttgaatcattcagaaaccattccccttatccgtggaaaaattgtcttccacgaaaccagtccttgatgccaaaaacatttgggaccactgctttagaagggtaatgagcactttaaaaaataataactatttctgtaactatttaaagttggtattctgtgactcaaaaaacaaaaacaaaaccataatcctgctcttccctgttttctccttccaccctgtgtgctacttcctgcgttggaggactgcatgcctccttttctgacagaaccatgggaaaccatgggcctttagaggcccacctactggtagtggtttgtttttttacagtgacatgtaataagaaatgtatatacacagatactatatattaataactgaattaaaagttttactaaacaacattcacgtttttaagtgcagtgcattgttttctatttaaaatgtttaagacatgttggtcttcacattccaaattgctttcatgcccttctaaactgggtctgtactgtgtttaagcatgctcatctagctgagccccaaccccgacagggcaggagagcacactctagggccatccattgggctggctcttccaggtgtcagtcctggcctcagtttactaccaagtcttaggtcgtaatatccagactttgagacttcacaagcagtctcaaagactttactgtacagtaaaatgtcagtacaagggactggagggcctgcagagcactgccagctagaggagctgataaagtaggaaggacgcacataatgtcttcattatgatgtactctcataatcataataatacttggtatttttgtgcctggcactgtcctgaatgctttccatgagtttaaatatttaatcctcacaagaatcaggaggaggaggaactgttatccctgtttcaccagtaagggaatagaagtcagagaagccacttagggtgactgccctggaggcacagctaggaagtgggccaggaatgtcggggaacagtctccttcccaaagaagtggggttggcaacaccgacctatttcacacaaactgtgatgtttttctcattttgaggcccgctgagctatgttaaaacagcatttctctgggaaacagctcctccttgttcttatttctgtcattgactagcttagttttgttcatctagatctcctgagatgttggtttaatccacgttgaaaaaaatctatgtgagcatttggtgggactggtgcaagaagcacaccctgggttattttatgctggtaacactgtttcctcaagctatgcattttgatggattagaaatggattgtgagtaagaaaaaaaaaagcagtaggattaataatcaacaggaaaaacacctgaaggttggccttcccagtgagatacttgattccttcattggctctttgtcgtaggcaacatgctggttcctgggcatagagttggtgcacaaaatagatgctgcccagaaaaatagcatttgtaatgtgagtgaatagcaccatagagagaaggacagggaaccaacctggactgaggagcaagattaaaaggatgttgctagcagattttttttttaaataaagaggatattttgaattaggtatagtttatgtgtttctatataaagtccataaggtaccctggcaagaatggaacataaatttgtcacatgaatttgctaaagacagacttacgaagactgataaatatgaggctttgaataacaagttttgtagctaaaaacatcattttcttttttcagacaccttcagcagtaaacaagataaaacaacttcttaaagataagcctgagcatgtaagtaaaaccagttaattattcagtaaaaaactgaagctgcattttcagaatgaatttatcccatgatatacagtattatttcatttaggggtttttatttaaaatgtaaaatatactcaggatttttaaaaaattcaaataatacaaaagggtatttaactaaaaggaagtcattctttcaacctgactcttcgtcgtcattcttccttccaagaagcaatctctttggtatccttccagggataatgtatacatttgaagcggctagacctgattttctcagcctcctcacagttgacactttagggcagattgtagaatgtttgacagcatctgtggcctctgtccattagataccagtagtaccccctctttgcctcaaccaaagaatccacatatgtggaacccaccgatacggagaggtgactgtatagagtaaaagtatggtgagtactatttcaccagcagttcctgattccacaaagctttggttgtcacaaccaaaaatgtctccctgagggcaaccactggcctagactgggcttgttattcctgtgtatatctcttcctaccataaatttttttgttacactttgctttttacccttaataatggcttgaagatctttccatgtcattatgtaatgatctgcctccctttcttggctgcatgtagagtatattccattgaacaagtttgagttctttaaccagtccccatattaaagggtcgttttcattcagtgctgccgcaaacaccattcagcaactatttagtgtctgcagtgtgccaggctcattgttctagaactgtaagcatggcttagtccacctacataggatccattcctagatacagaattgttgagttagggatgtgtgtatcatcttaattgtacattgttagttgccgatggaatgctgtaaatcatttcaagtaatggattgcaatatttaataattagacggtggggtgatttctggtttctgttgttaacctactacattacaatgtaatggaagttctcaaacctaccttttaaaattattaaatttcaaaggatatcagtgttctgattcaatttggatagaccgatgagtagactacaaattggcctaatgaaacaagaattcggctttgtagaatcaggaactgctggtgaaatagtacttatgatacttttgctgtatacagtcacctctccgtatctgtgggttccgcatacgtggattcaatcaaccataggtcagaaatatttgggaaaaaaatagaaggttgcatctgtattaaacatgtacagactttcattctctaaacaatacagtataacaactgtttatgtagcattacattgttacaggtattcaagtcctccagaagttatttaaagtacaggggaagatgtatataggttatatacaaatgcagtgccatttgcataagggacttgagtatctgcagatttttgtatactcagttagtcctggaaccaatttcccatgcatactaagggatgactgtatttaaatgaaaaatcagctcagctctaagacagagaacttaggtagatactgtttgaaaattgcattaatgtaaacattgatacttttaaagtgctgtttggtcacttttttaaacttcttttgtctgtattgactgcagtcttttgctttctggtatttgagactgtacacaagtctgcactataattcagatcccatgtagaggtaggattgccagatggtggactatgaaccctggtgaatcctaaccataaggaaacattcagaggatatctcacagaacaaggtagagcaaagacattttaaataaagtcccaggctggacggggtggctcctgccttgtaatcccaatgctttgagaggccgaggtggaagcgttatttgagtccacgagtttgagaccagtctgggctacatagtgagaccctgtcctacaaaaaataagagaaagtccattttggtacgaggaggctactgtcactttattagtataattgtttaatctgtactactttaaaaccaagtttatattttcacttctttttcaggtaggtgtaaaagttggtgtccgaaccaggggctgtaatggcctttcttatactctagaatatacaaagacaaaaggagattctgatgaagaagttattcaagatggtgagtttttaacaaacattttttgggcacattgttttgcctaaaattattagccttgcacagcacaaagtaaaaaataaggatagtagcaggaattatgtaaataatgctcactgtgtgtgtaggtgttgtttgatggaatttcatgtattaactgatttatacacaatgctgaatgtgggtggtaccatattatccctgtttttctgatgaagaaactgaggcacagaggggttaaatagtttaaggtcataataagtggcctagtaaaattctttccagagactgctcttagtaactaattgataaattattatataagcttgttttaactatgaaagatcatcgttgtgtccaaaaagtgaaccagccttaaacctcacagtgaaccaacagtttttgtgtaagcagtagttttatatctgtgtcaaataagtacgagttgagcattccaatccaaaaatctgaaatctgaaatgctcccaaattcaaaactttaaaagtgggtgctgacatgacactcagaggaaatgctcattggagctttttggatttgggatgctcaagcagtaagtataatgcagatacagtcatacatcacttaacattggagatacattctgagaaatgtgacgttagacaaatatcctggggtgtacttagacaaacctagacggtctgagaaatgtgacattggacaaatatcctggggtgtacttacacaaacctagatggtagagcctaccatatgcctcagctagataatataacctgttgctcctaggctacaaacctgtactgcacgtgactgtgctgaatactgtgcacagttctgacacaatggtaagtatttgtgtaaacgtacctaaacaaagaaaaagtatagtgaaatttcttttattattattattattattatactttaagttttagggtacatgtgcacaatgtgcagcttagttacatatgtatacatgtgccatgctggtgtgctgcacccattaactcatcatttagcattaggtatatctcctaatgctatccctcccccctccccccgccccacaacagtccccagagtgtgatgttcccttcctgtgtccatgtgttctcattgttcaattcccatctatgagtgagaacatgtggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcactgttggacatttgggttggttccaagtctttgctattgtgaatagtgccacagtaaacatacgtgtgcatgtgtctttatagcagcatgatttgtagtcctttgggtatatacccagtaatgggatggctgggtcaaatggtatttctagttctagatccctgaggaatcgccacactgacttccacaatggttgaactagtttacagtcccaccaccagtgtaaaagtgttcctatttctccacatcctctccagcacctgttgtttcctgactttttaatgattgccattctaactggtgtgagatggtatctcattgtggttttgatttgcatttctctgatggccagtgatgacgagcattttttcatgtgtcttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttctgttgccattgcttttggtgttttagacatgaagtcctttcccatgcctatgtcctgaatggtaatgcctaggttttcttctagggtttttatggttttaggtctaacgtttaagtctttaatccatcttgaattaattttggtataaggtgtaaggaagggatccactttcagctttctgcatatggctagccagttttcccagcaccatttattaaatagagaatcctttccccattgcttgtttttgtcaggtttgtcaaagatcagatagttgtagatatgcggcgttatttctgagggctctgttctgttccattgatctatatctctgttttggtaccagtaccatgctgttttggttactgtagccttgtagtatagtttgaagtcaagtagcgtgatgcctccagctttgttcttttggcttaggattgacttggcgatgcgggttttttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatccttttttatttcattgagcagtggtttgtagttctccttgaagaggtccttcacgtcctttttaagttggattcctaagtattttattctctttgaagcaattgtgaatgggagttcactcatgatttgactctctgtttgtctgttattggtgtataagaatgcttgtgatttttgtgcattgattttgtatcctgagactttgctgaagttgcttatcagcttaagaaaattttgtaaaagatcaaatgtggtcgggtgtgttaacacaagcctgttgtcccagctactcaggagactgaggcaggaggattccttgagtgtaggagttcaagaatgtagtgcactggccaggcgtggtggctcacctgtgtaatcccagcactttgggaggccgaggtgggtggatcatgaggtcaggagttcacgaccagcctggccaacatggtgaaaccccatctctactaaaaatacaaaaaattaactgggtgtggtggcacacgcctgtagtcccagctactgggaggctgaggcaggagaatcgcttgaaccccaggaggcggaggttgcagtgagccgagaccatgccattgcactccaacctgggtgaaaaagtgagactctgtctcaaaaaagaaaaaaagacatcatagtgcactgtgttcttacctgtgaatagccactgcccttaagcctgggcaacatagcgagacctccatctcttaaaaaaaagaaaaaaaaaggaagaagaagaagaaaataaaacatggtacacctgtttgtggcagttaccatgcatggaacttgcaggactggaagttgtccgcgtgagtcagtgagtgagtagggagtgataagtgaatgtgaaagcctaggacgttcctccgtagtactatagaccttataaaccttgtacacttagtcttcaataataaattaaccttagtttactgaaacttttttactttgtaagctttggggtttttttttttttttttgactcttttgtgataacattagctttgaaacacattgtacaaataacaaaaattttttacgttcttattctataagcttttctctatttttaattttttctttataaacattttaattaaaaactaagacaaaaacacacgtattaacttaggcctccacagggtcaggttcatcaatatccctgtcttccaccacctcccctcatcccattggaaggccgtcaggggcagtaacactcatggagttgtcatcttctgtgataatgatgccttcttctggatacctcctgaagaacctgcctcaggctgtttcacggttaacttttttttttataagtagaagtacactctaaaattttaaacaataaaaagtatagtaaatacataaagcagtaacataaccatttattatcattatcaagtattatgtagtgtacataattgaacatgcttagacttttatatgactggcagtataggtttgtttacaccagcatcaccacaaacacctgagtaatgggttgtcttgtgatattatggtggctacagcattgctaggcaatgggaattttcagctccattataatcctttttttttttttttttttaatttgagatggtctcgctctctcacccaggctggagtgcagtggtgtgatctcggcttgctgcaacctccacctccctggttcaagcgatcctcccacctcagcctcccaagtagctgggattataggcgcccaccaccatgcctggttcatttttgtatttttagtggagctgtattatcaactcatgtttttgaggaatcctgtatttccaatttttattcaaagctatttattataatttaatttataattaaaattaattatatttgctgctgcccccttcttccaccctataatctgttaaaacctatctaaaataaataatttatcttgtcattggaagtatgcacttagcttgcagttcttacctacatgggagaatgaggcctagattcctaagtgtgctttcttattaaactaaagttataactatcaataaagaccttttaaaaatgtattattttaaaaattataacacattataaaccttaagattttcatcttaaagaagaggtgacttaattatatattgtttatatttagctaatggctcaatttcttgtaaggaagaaagtttttttgttgtttcgttgttttgtttgtttgttgagacagagtcttgctctcttacccaggctggagtgcagtggcacaatcatggttcactgtagcctctgtctcccgggctcaagcagtcctcccacctcagcctcccgagtagctgggactacaggtgcccaccactgtgcccggctaatttttgtatttttagtggagccagggttttgccctgtttcccagactagaaagctttcttaaattgattgtatttgttggctgggcactgtggctcacacctgtaatcccagcactttgggaggccgaggtgggaggatcacttgagcccaggaatgcaagaccagcttgggccacgtggtgaaaccctgactctaaaaaaattagttggtcctggtggtatgtgcctgtaatcctgtgggaggatcgcttgagcctgggaggtggagcttgtggtgagccatgatcataccactgcactccagccggggtgacagagtgagactctgtccaaaaaaaaaaagattgtatttacaaagatgctgacctctacctgtgtaattactagggaatagtacctgttttccgtcctgtaaccagaaaagactattgttgtactgattgatgttattaaaatagccccattgtatcacagtcctttgtacatctttaagcttgaatccgtgtatctagtgtattgcagaattttcataaatttttttttatttcataaaactcatcgagaatatacattttcttcatgttgcaaactggaaaaatgagtgaagtatagtgaaaggtaaattctaattttgcataaaattgtcatggaatttacttgtataaaattctcccctaatgtgattgtgacataaattcatgtgtgggaaagaaggggcagacaggaaactgaatgcttaattccttaaggaaataatttaaaatgttcaaggcttcttgtttgactttcattgatagtcactatttcaagttcacttgtgctttgaatcagcaagttccataaggctgcaggctttccatgacacatgttttcttttctccaaggagtcagagtattcatcgaaaagaaagcacagctaacacttttaggaacagaaatggactatgttgaagacaaattatccagtgagtttgtgttcaataacccaaacatcaaagggacttgtggctgtggagaaagctttaatatttgaaatctcaggactcttctggccgtaggttccaggaaagctcgtggaagctttggggctcactgcagaaatcatgtgactgtcacgtgctggaaaataaagtgatacatcttgaaaatgaatccagtgtgttggattccagaagaaatgatatttatattctctataggggacagaaaatgagaagccatcactctttttggatcatttaggtctcttgtatcctttgttttagaaccagtttcattaaagttgccttcctgggcacctgtttatccatttcctgaactgtgtgcactccttagatcgctattgatggcttgatcatccctcagcatttctcccaaccagatcggtgactcctaaaatctgagacaggacatcgtgactgctggtagtaatatggtggtgcattgttttttccacccaaacttaacatagcctttttatacatttttatgaaaaatttcattgtcagctgcctcactgcatactctttaatagtaccaggcaaagattttcttcaactatagtacagattagttctgagtgatggtatcaaaaggtgagaaagacgtcatccgcctttttttaatccatttcttttgccaccctatatgtctgttcagagatgggctctcaagctgactttgattcttttagttgagaagtctcttaaagccatctagcccacctccatcaattccctatgtgaggaagcaaaaccccagggaagccaaagggctcctgtccaccctgacaccacaggccgggggagagtagggactctacccccctctccccttgtaggtgacacatgctctgccctctgaggcagtcagcgaaggcaaatggtctgacttctttatgtggtcaacattttgatagaatttctttataatttgatagagattatattatttttattttattttgagtgggaagaattttaaaacctttttatgtcaattaccatcttgtttctttcacctttgaaacaatggtttgtagcagagatgacattgtagcaacccagaattatgcttttggaatgtggtcctcactgtacaggagaatgtgtaatcttttgttaaaattcccagtgtgcatacattttctggttcctcggtccagttgctaaagttcttagtattttagcctaacatatttatcaccaacttttctttaaaagtgttccttttgtcacttagttactgattttcctgggtttgacataagtattctatgagatgatatatatgctttttttgaaagctgattctcatgaattcaagtagctgagttcctttatgtttcgtttattcactaaagtagctgacacaaaacacaccaaaacctagagcggtagttttatgtaaatgctcatgagtttgtatcaataatataattgttgatccacttataattcgtgcaacactgtatgtatgtagagattgagttgtcaattaaaaaaaatgtggcctctttgtgatcataaa

SEQ ID NO: 37187 - DNA, 3147 bp, Homo sapiens
gaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagaggtgagtctccccacagctaggacgggagagtccttactggaacctcctggaaacttctccatccattttcctttcctaccctgcctaaaccattttaggcacatgtgtgtccaaatgtgaagaaaaatgaggaggttgctagtgccttcctcccccatcacctgtttctatttgatagtcctctgtatcccatttattacattttttcatgcactgtcaagtttatcctccgtcccctaacttctctacaggatacccctttctggtttggttcatgacaatctgcagggaaagagctgccttcaaactcctttgcttatctcttccaacaccttggactcttgaccgattttaccatctcaggtttcagagccaggagagagccctgcctcatcctgagctgttcatccccatgggtattttctgcctttctattccctcttctatgattttctgggtttctcagggctacgacagggcgctggcctgggtccaatcaagccctacgaggaaacaatatagggacgcccatttgtcctaagagggtggaagaacagggtgaacaaataaggttgacagagctgtcacagataacactctggtttaaaaatattcaagtgtgagtaaacaggagctgagtgggcaagggctttggaaggacaagcaggaccagcagaacattccagattgggtgggtggaaaactggcaaagagacctgagccagaagaagaggcctttgtctcacagacaaaccacaaagccaggcattggagtcagagaggcagcagatgccaggcttgcacccatccttgcgactggtcccctgggtgatctgtcttcttctctgtccctgtaaataaagtttgggtctgatcaccatgagccttaggtatcactgtggtggctccctgaagcagacagctatgtttatttaaaaaggagattttttaagcagagaagagaaggatgaattacccggacagaaagcagctctgcagaataagacagcacctgtgtaatcagtatttttgccctctttctcccatcccattcccttaccttgctatttctagatgcgcctggagaaggacaggttctctgtcaacctggatgtgaagcacttctccccagaggaactcaaagttaaggtgttgggagatgtgattgaggtgcatggaaaacatgaagagcgccaggtatgtagcttgtttttttgttttctgctcattcattcagtgcatactgtaatagtccaggtagtgctatcagctttggaggctggctacattccagtcccaagccataacagtcgggatcaggggttacaaatcaatgtctagaagactaagttaggatagacatattgctgttgttactattatggccagagatgtggcctttgatttgatcgccttagatgggatgatgggatgctgatgccccatttaagccagtggttctgaatctgggccacattagaatcaccaggggaactttcaaaaaacctaatgctcgggcatactccagaccaattagcatatgtgctgccgaagcgagcactactccagaccaattaaatcagcatttttaagggtgggacccaggcatcagcaatttttaaggtaattctaatctacagtcaaggttgagaaccactgattaggtatagggctgtcagacacctagttgctttgcataattacattaactacaggtaccctaaaagcacttgagttgtgacttctcttttagctgtgcaagaatccgtgtctcttctttagcccatcttaatgctgaactacttggtttgtctaaatttcagagctgtgctcagtctttaatcccctacagcccatgtggtaatcagttaacgagagcctgtttggctacatgcttgagagtcagcaggcatacgggttaaggtcatctactctttgggggagttctgacaaatggaacagcttgttatgactttataagagggctttaaaattgcttctcaccatttaacgatagctcagaacctgtgcgtcaaccagtacagtttgtcctcagtaatgtcctcaggctgtttcaattttgcttatatgatttaggtttgggtcatagtctccttggatggagtcatttttttttttttttaatttcagcagcagtcctattgttctggaaccttctgggacattcctgaagagtcaggacaatttcagggcttcctcagggactcagattctaaatgagattccaaattctgtaggcccagccaacattgatctaaacctttgggaaatacccctaaacatatctatgcctcagggtttgaaaaacaatgaagtgttggactgtttcagacttctcagattctcactggtaggagtgactacctaggcaatttcatcttagctgcaaccctgaaacgaagctctatttatttttcctatgttgtcatggcatttggtctcacctaaggggaaatcaggatgcctgagttctgggcaggtgataatagttcctgttcttatctctctgcctctttcctcattcttttgggttaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacag

SEQ ID NO: 37188 - DNA, 28584 bp, Homo sapiens
cgggctgagagggacctggggagctgcggcctggccggggcggcgcactcaggtggcctcgcttccctgcgggtcaccgcccgccactcgcacagctaggtcggcctgttgggatcgggagaggtgggcgcacgagttttagtgcgggagtccggggtgcgggcggagtcctattgtccccgtgcacccgggcggcagcacctccgggtccctctttaaaccgagcgtccggcgacctttctttgtgcttagggagtcgaaagcggcatcttctccgagagaagtcgcctactggggggtggcgctggggaggtaacaatgggcgcccattgtcctccgagggtccaacggtgacccccccccgcgcgcgcgcccggccaccggttggccccgggccagggcacaggtaccgcggctgggagggtcggccccgctgcccgcgccctccgccccgccccagtgagtccccgcgccgccggccccgccccgcgccgccccgccctccgcaggttcagtcctcgcgtccggccgccccgcgctcagtcgcgcgcaccttctctcgcggccgggggaccgcagcgcggggctagcccggagacccggccaccggcctggggcgccttcacgccgtctcggagcggataatgcggtgagcaggcaccacgccggcagactcggctggatctgcgcacagcggcagggattgcgtgcgcccgcgggaggcccggggcagcggctgggatcctcagcggcggccggtgagtcggggcagcccagggctccttcctctctacctgtctgtgagtctgtcccgcccgcggccgtggccgcttccggcgtgcgctggtgttaggctgggaaaccagcagggagtcgggatacccagggcatcgctttcccatctagtgtccaacggaacgaaggggacataaagcaagccaggagggggtccggcggcacgaccaggactcagagctccaccatttgtgcccactacttttcagggtggggctgcgcggccacattgcaccctccgagctattggcagagccattctgggcgcgtatagcatttttccatctgagaacaagccgcgcttggctaccgcgcccctcgcatcatggattggtaccagggccgcacatgggtgcatcgcacagctctgccgtggcatcgcctgcccggtgccctcctctttcttaatggaggacattgttagtggggcgccaacctgcagatctggatattgacttttttgttttttgacggtgaacagctgagacgtttacaaggttttttgttttttgttttcttccctttctccttgaaactaagtggcttgacacagacaagtatcagacatgtgaggatgaatggatctggccattttttcgttatgaattattatactctatccctctctcgactttgggaggcatgtgtttcatcttataaatagaaagtagcatatttttgggcaggatctcctttatactgtgcagtctaggagaggtcagtttaaaaataaatatgcacttgaatgttacattactgagagccaggctgtggctgggacaagctgcgtggacagcagcatcaaagccgggagcgcagctgtgttgaaaggagtaaaagccccagagtgcagcctaggctgacagtcaagtaattacattttgtttaaaaaaaaaaaaaaaaaaagtgagcgaattaaaatgaggaatgtcaggagggtattgcaacatgaatctttccagccctggcgtatttggaggagtgggctgctgctgtgtgctgaggttgtaggggggctctagggagggaactgatgaatgtgttagggagacaaagattccatccccatctcccagctcttaattctcacaatatccaagagtttcttgggagtactgccttttaaaaggaacaaaaattaggagagcagcagatgtctgtattttaatagcaaagccagttttagggacttcctgttaacatcacagggagaaaaaagactcaccaggaaccagcgatgatgccccaaaggtatccctaagacaatttaaaaggctcctgtaatgttctaatttacacaagctctttcatcttaaaaccaggaaatgtaccttctcttcttttctggacagttccagaagtctactctttcataccccctgcaatttgtgtgagctcttattggtagttaataagctacacaggtatgtgtgtgatgcatacccttttcagaatagatttagacactcagaaataagttggagtagttgtgaaatatttagcattttcatatgtgaaataaatgataaaggccctttctatagtcaaggaatggttgaaattcttcataaagtctcccaaagaatgcgggtttcccaatgggcctcacccatttgaataaaacagcaccagcctctgggctcacagataagaactttagaggagaaatttggaagcatttctggatccatggcagtttctgttttccaatggcatcatctgctagagatttacatgatgaattctatgattagaacatggtgctgaggctgtggcagcagctacaggcttgaaatgagatgagctcctctttccctcaatctgagcagtgaaattgtttcacgtatctctatggaacaagtaaaagcagctagagtaataagtgttgcacactttttgctttttattgcacatttaagtgcggtgcaagatgaataaatacaaagccgtaacagtgattgcagaagggctcacatgagttcatttgccctgtctgcgctccagcctttcctttaatgtggtgttttgttttatgtccaacatgctcacaaaagctgtgcttttttcatgtataaagttcctggtattcaacagtgttggggataaaattgctttcacctgtatcacccaaagatttttttttttttttttttttagccaggccatagatttttcacaaattctttgaccattaactgtaacatttatccagtgggtggaatataattcgtaacctaaaaacctccaagaagactgctctgatcgtattattattattattattgttattcagattcttgctttcagtcagattttatctaggcccagtctcatttcttactaaccagaatcctgtgaacctgtatttcttttcattgattgaatgagaaatctatttttaaatgcagtatgtttgccagagaacaaggatagccatttgaaaatactggattcagccagccacaaaatcttgtgtgcctcaccaagccatagaagaccaagaattttcctaatatattgcattgttcattactttggatgttaaaagcacttcctaagtggagcccgtcctatgtgtcaagcactcttctcagccttttgtcttgattatcttacttgtttctagcaatcatctaatgaaagaaccgttgtatccccattttgctggtgtagagactgaggatagaccagttatataacttacccaaagttgtgcagtaagcaaaacctaaacatgcgtgtgcagtttaacaacacaatatgtgcaggcatgagtggctaatcctatgtgaaagtcagcagctctttgggttaaggggatgggaaaaaaaactgaacttctgaagcctccgagtcaggctgcctgggcacatgtcctagttctggcacttaacacctgtgtgactttgggcaagttacctcacctttacctcagtttatcctttgtaaaatggagataatattatttccctgaggattaaaggagttaaaaaagattatgtactcagaacagtgcctggcccagagtagccacaataaaaggttgaggttttcaatgttgcttttgtttttttcctaggtacttaatactggttctgtcatgtaatattcataactattctttgagagagatagtacagtggtccccaattacccgtggttttcttttccagggtttcagttacccatagtcaaccatggtctgaaaataggtgaatatggggcattttaagaaagaaagagaccatattcatgtaatttttattacattgttataattattctattgttaatctcttactgtgcctactttacaaattaaactttataacaggtatgtatgtataaaaaacaacatagtatatatggggttcagtactgtccaaggttcaggcacccactgggggtcttggaacatatccgtggaggataaggcagactattatattgctcttcttttccagatgagaacacaggctcagaaaggtttagtaacgtggccaaggtcacacagctaaatagcagaagcagggtttgaactcaggtctttttgaccttatactaaataccacacccccaccaatggggaggaggggcagagaagttgttaaatctgatttttgttatgacttttggcctctggcaaggaaataatttcatatcaccctgtatctcacagttgaagatgacagtaattgccagccttgaggaacactatgtaaattattttattattaaagatgattcaatcccacatatgtggcatgaaagtggatctagcatgaacactgctagggttaacataagcagtttaatttatgccataaacgaagagatttactaggtgaaaatgtgggactatatggtgagaaagcaagccaagccacagccagggacaaggacttctggtggctggggatgaagtgaagctctagcatagactgtgtgctcgcttcaaaattctggggagcccggggttgcagagtccagtaaccacctgtggacaatcccctccttgaaggcaggaaccacactacctgggccttcagtcccggcactcagtggacgttttagtccatgtttgttgatgatgttgctgcaagaactcagcagaagaggagctacaggtaaagtgaacagaaaggcactgggctgtgtccatggcagaagtcaagccctgttacagttcagcatatcccctgggccctgctagataagaaacacacaacaaggaaacctttgaaaccttgtccttactgcttgccccggaaaacccacagggcctgccttggcctccactgctttgatgctctgggtttgtgattagctgtggggatcagctccagagacttctcagatggaaacagggttctggaaaggacagtccgaagtaactcaggtagcctcaaagccaatggttacagtcttggagctgtccaattccatttgaaatcttctcctgtccccacctcttaaaggctacaaaacaaaacaataccccacaaaccagaataagtagccatgtagttctaaagcaatagtcaggtgtgtttctttccttaaaaaaaaaaaaaagctttctccttgatatacttcagtgccaagtttcatcagaatcacatgatgatggactgaatttgacagtacctctggtagaaaagcagttttcaaattttaaccatacagttttataatacaaagcatgatgctgagatttaaaagattactatttctaaatagccaagtaaactgtgtgaaagctgatgagttccaaactagtgtttgcttagtccttactgcttgcctaagtcatgaattaatagaattctagaatcccaaatttaaaactttttaaaaaggattttcagtggattgggttttatttccatattggataaagttattattagccttctagcctttggccctttgttaaaccatgttgcagagatcacacacctgcaattaggtaacagggtaccgcctaaagtgtacctcgagccatgaatgtcataaaagtattctgtgggaccccagtttgatgaaggtccctttctgcaggacttctcagaacatttaaaaagccagtgtatatagtgaatctccacagggaggtcgtgtccagagtttctcaaatggttttgcccactgagcagctgcaggaccagcctggcaggaaacacactctgggaaacacagaacagaagctacataaccgcagtatgtcctacagagccgaagcaacccagggacattttagttagagaaccacaggcgttacaggaagagagcgatgaggatgtaccaggagatcctggcaaacgctgataaaactaatggagaattaagtgagggcaatcaaaaggggtgtctgtgtgtagaaatagagattaaaaaaataccaattctggtcttagctctgacccaaattgtataaccttgacctcttggggttttcttgttctcatccctaaaacgtagcatttggtgagagatgatctcagataatctctggctccagaacagtgagccaggatcagtggcacctattagcatagctatcttactactaataatgtaagactctgggttgaaaaacagacccgtgcagatctctggcagagcagcctgagcaagcgtggaaggcagggaacttccaagtcaggcctctatttagacagcttccacatttgggaatccgtcatgttctggtgacaacctgaaggtcctatttgtagacacatcatgccaatgatagatcgttgtcatgagtttagttgaaaaagagcttttctgtccaaatacatcataatcatttaggctacatacattttttaaaacaagcagaggcatttttggtgaaatgtggctttgccattcagaatgtgtttgatttctcaacctttttatttattttttaaacttttgttttgccaagggtcagttcagacttaaaacattgattttaacacagcgggagatgaggctctaagcctttggctgaccagctagtcagaaaacaaatccttccccttctctgggcaggctccatcccatcacctgtgaaaaaaaatggcagagtgggagggtggggatgggaagggaggccagagaagtgtgtggatgttccccaggccctctcctggccctaaactgtgattctgttcctcttttttcttgtatcagaggcatttccatagtgtcttgtatcttctcctattgtaacacttactacatttaagttatctttatatatatataaaggggagtttattaaggaatgttgactcacatgatcataaggtgaaatccagtaataggcctaacttttaggtccggggctacatgtgcaggtttgttacggaggtaaactcatgtcacggggttttgatgtacagatcatttcatcacctaggtactaagcatagtacctgatcattagtctttctgatcctctccctcctcccgcccttccccctcaattaggccccagtgtctgttgtttccctctttgtgtccatttgttctcatttagctcccacttacaagtgagcacatgcggtatttggttttctgctcctgcgtcagtttgctaagactaatggcctccaactccatccatgttcctgattgacgcaagtgcctgcctaattagactaccggctcctcaaggatagggactgaatctcatttatcttgtcattcatctttgctgcagtaggacttaatgacaaagtgggcagtatagcccttgctatactatctgattctttctgtagcatatctcctcagttgttgtcaggtcagaaatctttgtcgcttacttgctgtattagtcagggttctctagagggacaagactaacaggatagatgtatatataaaggggagtttattaaggagtgttgactcacatgatcataaggtgaaatcccataataggctgtctgcaagctgaggaacaaggaagttagtccaagtcccaaaacctcaaaaatagggaagccaacagtgcagccttcagtctgtgaccaaaggcctgagagccttctggcaaaccactggtgtaagtccaggtccaaaaactgaagaacttggagtctgatgtgtgagggcaggaagcatccagcacgggagaaaaatgaaggccagaagactcagaaagtctagtccttccacgttcctctgcctgcttgttttgttttgttttgttttgagatggagtctcactctgtcgcccaggctggagtgcagtggcgcagtctcggctcactgcaagctccgcctcccaggttcacgccattctcctgcctcagcctcccaagtagctgggactacaggcaccctccacaacgaccggctaattttttgtatgtttaatagagacggggcttcaccgccttagccaggatggtttccatctcctgatctcatgatctgcccgcctcagcctcccaaagtgctgggattacaggcatgagccaccgcgcccggcctcctctgcctgcttttatcctagccacgctggcagctgattagatggtgcccacccagattgaggatgggtctgtgtctcccaattcaccgactcaaatgttaatctcctttggcaacaccctcacagacacacccaggaacaatactttgcatccttccatcaagtcgacactcagtattaaccaccacactagcttatttttaagtcctgctgtagtaaagttactccttcccaggctacagaacattcaaatgcaaggggagtcaccccagtcatttggttgtggtgatagagatcatctgcgggccctgtggaaataggtcaagcccctgctggaaccttctcaagatctccgcggagagattggcaacccccaccaatgctttctcgtgccctgggagtgactgaggcaacttggcacccatgtgtccacttagagcacagagtaagggtccttgtatttcctattgctgcctagacctctcgccagccattaacgaataaataaacatgagccatttatttatttgttatattagcgtcagtctctccacagtggagtgcatcattgctgcggcctcaacttctagaatagtgcctggcacttagtaggccctccatggatgtttgttgttgaacacatgagggaccagccaggggctggggaggcacatggaaggttggtttgttttttttgttttgttttgttttgttttgtttttgagaccgagtttcactcactcagttgcccaggccagagtgcagtggcacagtcttggcttactacaacctctgcctcccgggttcaagagattctcctgcctcagcctcatgagtagctgggattacaggcacccgccaccacacccagctaatttttgtatctttagtagagactggctttcaccgtgttggccagactggtcacgaactcctaacctcaggcgatccgcccgcctcggcctcccaaagtgctgggatcacaggtgtgagccaccgcacctgactgtgaaaggctttctaaagctggcttcccatgggttgaactggcgagaggcacatggctcactctgtgcatgtcgcagcaccaactagagcctgttttcttgctctcagacggcttcagaatgaaatgtcttcctaaagagtgttgatttttggccttctattaagtttagtgtaagtttatgctggtgatggggatttgttttatattccttgtgggctcaccctgggatggtggtgctttacttgccagcctgggggagtgaggttcagagagaggtctctcagggtggtgcagggagtaaagcagggacttctttcaaattccgttcttttttcagaatggggaattagactattgaacccagaacatttgggagtttttcacactgtatttaaaacaatcagtttaggtggccagatcccaaggtctaaaaggagtaaggttaaaaggaatccccaccatgagcttccagctcatcttcttccttatgcagctccagctttttggggtaatttataatgaacattaccccttccattgatatgggctcattgcctgccaggtgctttgccaagcactttatgctcgttgttacccaggaagactcccacctttgccatttgcacttcacagatggggacactgaagctcccaaagggagtcactacatggctcaggacccttaatttaataccaggaaggatgggaaagggtgatgaaaattgtattcgctggtaaaaagtattttgattctaaggctagtcttactttccttaaaaacattactttttttttttcttttttggaaacttcctagacgctagatgtttctgcaaatagaatcacagagccctaccatttgacagatggaagggaccttatctcagccccagtctcattctgacatgataaaaccaaggccttaagtgtttaagtgacacagagcatgaatcttcctcctaggcccagctctgtcgaacttttttttaagccaaggaaaagaaaatcttaagcctgatatataaacagataataacataatttctttggttaaaaaggagagagattggccctacttatcacgtatttaagaaaataacaacatgcccttttgttttttctcttctctcatacatcactaattctggtggggtctgtccagagtccgtcagatggctatgactttttcagccacctcctcgtgctgtcagctcccggtagccttgccgtccagtttataacgccagcagccagagcctgcaccattctgcgcaaatgggattatataattaatgttaacccaaaagcaggacttctattcatcatcattcagttcattcctgtgggcttcatccagccccggctctcggtccaggtaattctggaccccagttagccactggcacaatgaagctccctctacgtctcctgtttatctttagatttgataagtgcatctcctgtgtcttccaagtcacttgccctattaataagatccctttaaggcttggctaaaattggcagattacaagtaattgacccatctagcaactgtgtcatgtatgtaagcaagtgaggtgccagtgaactttttatcagtgcctactgagcatatatcccctaagtgttcaaaacccagacctttactgaagatacatgtgatagtagtcacaagtaattgtctcttctttttggaaaatcaaatcatttgcctgtgtgtgtatatatatatacacacactatacacacacgcacacacacacacacacactgtacacacacactatatatagtatacatacatatgcatacatacatactactccctatagtttttcacaaggttttcataaatggtttcatgatcaaaaggaaataagtgatttcaggaccttaggctcttccttactcatcaagcctggaaatctggactcccatatggtatgaagtcccttccaatgattactggtccactctggccttccatttccctttgacagggttagttgtgcacactccctaaccctacaccctccagatcccatcatttccaggtctgctactttgaggttcattccattttttttttttttaaccttaaggtagacgcaaaatagaagttgaataaatcagagaaggtaacattcccctttggtctcagcttcctttttccttaaaaagtaaaaccaaatgaacaaaagtaaaaccaaagtaacttaaaatgaaatttaaatggaagtaaaaggattttcctcttaaaatcatccataagataaagtaagtgggtcaacagagaatttaggagaaaaaaaatgttagattgtttgtatttatttatgtcttaaggtcaggggctactgtaagagatcccaagttggtatgaaaacaccacttttatctgacctatatagcagttgttgtaattttcccaactccgggacgtttcatttgttcctaaggctggaagagccccaactgaagataaccgatgcatgtaggtgtgaatgagaagatagccccagccctatgtcccattgacaggggaattaacttctaatcaagctggtggtaggaatcccttccaactgtggagactgtccacaggatcaataggaaccattttagcctcatctgcaacaattttattaatgagtggtacaggcgaaatttaaggagaaaatagaagtgtttattttggcaatgagaatagtttcccctccactctgtatttcagtagatagtctggtctcatttggggaaaagataatgccttgtgtttacatagcactgtagattttaacactcagctctaacacctgtggttattataaagtttgggatgattatctccattttacatgaaggtaactggtacccagtgtatcagggcttctgcgtcttacagggctggctcatagttttggtccagctcttcccccgctcaggccaggaacagcagtgagatagcagtttcgttggcccgtacagtcggtgtttcatttggtttggtttggcaaatgttttgataggtttatttttccccacatatctgatctgtgccagtcacacattgatcttccaaacaacccttttctatagactgtccattgtagtttcttgaggtttccttgtacattttaggccaaatgagccaagttctcccttaacacatctccttttgaaaagagaaaagagcaagttcattgtttctccagggcctcattctttaagtttgatttaagtagagtcactgagtttgaattcagaggactgtattgtcaaattttctttgagtcttacctaagacactatttgcacattgcattcagggataggagtcatatctctttcaaacagcatgtccacaaatatttgccttaagatctatattttttatctgtatatttgccaaagatctgtatggtcctgtagaattactctggcttgcattgatacactgttaaattattaccctgcatggataggggaaggttaaaatggcttacagatggaaaaatgaaagcctttgccacaagaaaagaggagacagcttcttgttacatgtttgttttcttctgtaagaatcatagattccatcttgcattttcaatagagcaggcagggttaaagaggaagaggcacagcaatgtctttcaagctttctcatttgtttatccattcaacatttttttcaatacctgctatgaataagatctccgttctctctcccagattatagcctgattggggaagagttaaataagtagtggtaataatccagtgtgatagttgctaggtttgaggtgtacacaggacgctatgggagcttaggatgccatggggaactggcaggagattcagttgcaagtgtggcaggccccccagattgctgaagtgggcttcacaagctattttatcttatctccaagctgtagccttaaaacccttgaaaggttttaaagcagagagtgataaggttacatgaggattctaggtacctcactctggtgtagattggaagataaggtggaaggaccggggaggcagggaggtaggtgaaaggcaaatgtccttgtgcaggagaaagatcatgggggccaggagtaaggctgatggagcagggatgaatgaggagagacagtccagacagactgataggactataggacttgatgtagagatggaggcggggagaagtgctgggatgatagctgggttttggaattgagtgacttctgccatttaccaggaaagcatagtttggaaggcagatgcctaaggcaggcagggggaagaaagatggcaaatcccatttggggcaaggtttatgagtattatatgggacaagggaagcaaagtagagaagtctggaatataagggaagggaaaggccaatcaatgcttttcaaactctctgggaagggccactgtctttttgtttgtttccatttccaatccattgtacaatactactgtgcacaaggaatatggagcttgggccacacacaaccgccatgcaagctcaacagcatacagctcccaaacttgtcaatagcctattcagtaagaaaaaaatctgttggtcacatgcttgatgttaaggcaatgtcaaaaagatcttgcttccaacttctgttcttatctcatcatggactgtatgaacccactttgagtagcactggtctggacttaagtagatgcatgtgggttgaaggtactgacttggaagttatccctagaggtggtatgtgattgccgggggaattgttgaggagtgggggatgggcagcagccatccaaccctatgaaaatgccaacatttaagacaggggttcagacttcttctgtaagggctcagttaatactttgggctttgagagcaacatacagtctctgtcacaggctactcaactctgacctgatagagcaaaagcacctttactgggatttctcaacttcagcactactgagatttgaggccagataattctttgctttggggagttgtcctgtacactgtaggatgtttagcagcattcctggcttctacccactagatgccaggagcacaccacccccagtcacgaaaacccacaatattcccagacattgccaaatatcgcatagggaacaaatatcaccctcagttgagaaccccactgagctgtagacagtacataaatgaataggcataggtgtgttctaataaaactttatctataaaaacaggcagggggccggatttggccggcctgtagcttgtagacccttgacttaagggatggtcagaaagaaaactagaagagcttattcagtaagatttgagggccttctgtgtccccagctcaagaggaggctctgtaagtgattcagcataaaaaggaggagagttttcccaacaggaacactcatgtatagcccttttgcttactttattctttttgagctcaccagccacctggaaatatcaggcattaaaaccacaaaacaggaaaacaacaaatcacataatacaagccctccacaacccctaagaaaacccctaagcaaagcagtagcaaggttggattacgtgaggtgcattcgagtagacttcctccaggaaggaagtgcatctggagcaggtctcagaggatgttgtgaatagaggctgatggtaagaaggtgggagagctttccatgtagggaacacaaggttcttagtttcaggttaggagggaaatgaagtgtcagttaggaagctagggagctattgtccccagtgaaagcctgtgattgttcactgtcgcatgcaatgggcttcctctgggaaaagaatgaacagcacttaacacgattttctaagaacaggatgtttgtttttctcctcgaggatggcggggggcggggggtggggggggggctttgttactttacaattcaaatcttttgacgtttaccacaagtcaaattccttttgagattcttgttgacaatagcaaaaatactgaaaagtcctagtgagttagagatggagggaccagtgtctaggacccttcttctcatttttggcttctgacaaggtcaggttagcatctccacctctcatccgtgttgcgctcttggtgtgtcatttcctcttggtgctgtcagacttcaagatacatagtcttcaggttggcagtccttgagttatcaaatcggcagtggctacagaatgcagctatggctggaatcctagctcctccacattttgggtgattgactggagacacaggcttcatctaagactgcttcctaagaggtatgctctgagcattacatgcctgcctggcccacagaaagcactcatgctagctagtactcttcacaggtgtaaattatttagagaacaaagcatttcagatttgtcactttccagagagcctctgtagacttgctctagggtttggcccccgggagcaagtcaacctggctctcatgatggaaagtctagcaggggttatggatttaacacttgtgaatttgaagttcactgtgggccatgtgttgtgggaggcaaaagatgaataagctcatgcccacagaagagctttcagcctagttagagggaaatcattcaacaaatatatttgtagtaacacatatacaaataacgcaaggatgttggtagtggaagtagattgagagtagaatgacgactaccagattccacatatagccagtgctggtatcatacagaaaagccatgtttcagcccatccaaggaacgtggattattgtagacagccctagcagggtggcagaatagcatggaagtcctgtatttgtccctttaccccatcagagaacttgagaatgtggcctaaaggcaaatggctaggaactttgccctccaaggtagtatgggttaaatgaccataatctgaatttctggacagtgtcagcttattatttgggatcatttgaaattaccattaccagaactggagtactgcatagaataattgctgacttaaatattaatattttgtgagcaactgagagcaagttccttgcttttgagcagagattagaatgaatatcctggctgaatactgctgaaaacttcagagtcaagttctcttcctgtattgatattgtccttgcagcatcacagaccaagtcagatccattagttatggaaacacgtgagcagttcacagcaatggccttatcagagattcacatccatgaaactagagtgcctgcctgggtgcttctgaccagccctggtgccatgtacaacacgtcctgataaatgaaccaggcatgagaggacttgccctcctcctgccttgttgtaactgccagagttctatgtccacattgagtcttccccagtaactcatttttataggaaaaaaggtcctaatggcctctgttcaaaagtgcagacttggtgctatgtgaggtggaccttctgtcttccaattttgcttctaagagatctttcaaattagatcccataaaaatgagacgtgtacacaaattagcactgagtctcacatatggtatttgtgggtctgtatataatcagggttgtaaaagaacaataaattcaagctgtagctgaatcacaaatgaaagtcctttaaaataatggaaggtgagatgtatcagactttgaatgggtctttaaaataccgcctgctcgttctggctaagttcatttgcataacagagctcagcagctggggagccagctaatagagtttcatagtcttgaagcttagagctatgtcctcagtttagatgatatggggagagggtaagaatctaaaaatagaaaaggcatcttcttatcttctcaaatgggtggagttaaacagactgaaaatatgaaaagcatccccttcgggttactgggtgcttctggttacactgatttccgccttagaaattcagcattgaacttaaatgaaaatctaacactatggggtttttttccccttcaattttaaaattattcagagaagcactcctacagaggtttgtaaaaggattgacatgagcgtccacattgtagtaatattttagtgtttctgatcccaaagattggctggtcatttctatattagtaagaagactgccgtgttcaaagagaaagcttcttcaagggaaagtccgtgtgcgtttttctatggaaaagtgacatgggactacaaggaaattggcagtgatcgtgttcccatacaggaaactcagaataaatgggaacgtgaacacctcccttcacgcactgtcagggaggcgcagggtaaccgccctcccctctgtgagagcttcatcccatggccatacttgctgtcccctccccaccccagcccattccatcttttgagaaacctgagctgttacttggaggagccaaaatctttccttgtagtttctgcttggtagctctagggcctcccagaacaagttaattccttttcattacaattaaatgaatccttcagatcccttaagattagttttctctttctatgagttctctttaagctgctctattccttcagcctcttctcacatgtcctaatcgagctccttcacttcctcccatttgcctccctctgaacatgcggggacatgttccaggtagcctttatcccttctaaatgtggagcctaggatcatgttctgggcgcttggcacagtggaattattatcttctggttggcagcagagagacatagcccacagatggttgggggtagggaggcggcggagggtacttggccgagtcatcatcctcccctaggactgttggttccaacatgcaggaggagtcgctggatactctggcatggggctcagatggtgcagtagtgcagtggtgccgtgactggccgcatagtgcgactgtgctgaggcaaagcgaaaagtgatcagaagctggaatgtccctgaaggatgtgacaaccgagccagaaaggggaagtcggatgcaggctcacttcctgcaaggaggagaaaagaacagagccgcaggtccctgggggcagtagcacccctcaacccacctgcccatttttatacatgtgtgttttaaattaacactgcaacctgttttgcaggatgcaatttttttttttttttactttttctctccactaagaattaatctaaaaacaattagtaggcaaaccaaacattcctttaaaataaatggaattttaaaaatatcccaactccttggttcttttcagagtcctgtaagttgccagtgcatcaactctaagtaacttaggagctgatttttctgtctgtcattttttaaaaccgcttgattttcccttcctcctggctgctgccctgttttgatattttcagcatcattctgtttgccaaaaagatggtaagaaatgaagcaaagcaccgcttcagtttttttcttaaccaaattatttattactgctgtgattatttctatcattatcactgtcatttacgcttcagtcagtcacaagaaactagaattgtctagcctagtgcaacccggctctcttccttccttataaaaaccagggccgtagcttcctctccggtccttttgtgtattgaaactcttggatttctcacacaacctgtaagggagcatgtccgttctcagcagcactgtgcccacctgtctgcctgccacatgtgttctctctgacctgccacatgactgactggcaagctggacccttttgttggcaaatcttttctctctagtgccccaggaactagagcatttgtttttaaaggaatctaacttctgagatgaatgttatctccagtgttatctatgaagggaaagaggaacaaaccatgatccaagaactaggagaaagtttgtggaactagaaagaaaccaggaataattgtgggaagttcaaatttcagggtcaaggtttttgagaaagggctaactataagaacctttgtctgtcttttaagatttaggtaagatagtgggagtagagaaatgcaagaaaactagagagccaggcatggtgaggctcatctgtaagcctagctgctcgggaagctgaggcaggaggatcacttgaggccaggagttcaagaccagcctgggcaacatggcaagaccccttgttctaaaaaaaaaaaaaattgtttttaattagctgggaatggtgttgtgcacctgtagtctcagctactcaggatgctggggcaggaggatggcttgagcccagggtttcgatgctgcagtgagctgtgatcatgccactgcactccagcctgggtgaccacatgacttgacccttggttgcaggaaaggggttcaagatgaggaaaggacagacacgagtgaatgtgctcagcaccctcagatggctcagtgcccacaggttaatgctggtgttgagagttttgactgagacagaaagctaaaattctctcatctgggttgtggaacacccaggagggcccgctccctagttgtagtctggtaattcgcttccggcctgtaagcctttcctgtttagctcctccttttctcttttcccagcatcccttcctccaagcagatccttcttccttctgggcagaacgcaaagccctggggttcccctgactcatgctgactgttctgatgtgttggtcattcaccagcagtctcctggaacccaggtgtcttctattttctttttttttttttttttttttttttttgagagggagtcttgctctgtcacccaggctggagtgcagtggcacgatcttggctcactgcaagctccgcctcccgggttcatgccattctcctgcctcagcctcccaagtagctgggactacaggcgcctgccaccaggcccggctaattttttgtatttttagtagagacggggtttcaccgtgttagccaggatggtctttatctcctgatcttgtgatctgcccgcctcggcctcccaaagtgctgggattacaggcttgagccaccatgcccggccccaggtgtcttcttaaaatgatgaggagggatgggatttcaagtcatggcatataggcccattccatcatcaaaggttatctgtgtgtgtcactagtcacccttgcacaagttgctgtcctcacgggcccaggcgattccacctgcctgcacttccctcctcgctcatgccctggccagcagctcctcctgcatcctctcccacctgttgaattttctcactttcctttccgactacaaatgtttctcttctgagatctcttcccttttacaaagtacagatccatgctgcctctttggtgaaggcctgatcacagaagcaaaaagtgatctgtcccatagccagggtcaggggagacgtggctcaggccttttgtgaagtcttcatatacccacacactgccattgcagatgctgcttttagacacattttcctgatgtttgtgttatgatcagtaactcatagtaggcttttcaggacctaacagccatgtataaaattggctctccaggaaagcctaatctgagccctgcatacacatttatatatttgtgatttaaaaaaaaatagccagttcattaacatgatttgaaaatccaaaatcataaaaggatagtgaaatttctttgccaccctgttccccttccatctacttcccctctctgtggacagtcactattattacttgtgtgtttccagaaatactctatagataagccagtacaaatataaatacacgcatttgcacctctttttttttcctttgatgatgtacatctttgggctcttctcggatgagcatattaagcacttcttcatcctttgttagatctgagtagtatttatttggaaggatacgcttaactgaaccagtcctccataggtggacaattaggttgtttccaactcttgactgttataaactgtgctggtttgaacagccttgttatttctctgtgagttgggtaaatccctataagtgcaatctgaggtcagagggcatatgatttgcagttttgatagatattgccccactgcctctactgagtttggacctgttcatacttcaactgtcagtgtatgcagggcctgtttcccatcctcatcagcccagcacattgccacacatttgtgttttaaacaggctttggaatgcacccctttcataattagggagcagacagaattcccagggagggtgctcattaaatatcatgtcaagacctcaaagctcagagcccagccatgtggcttcgtgcttggtagccatgcagccttggcagagtggctggatatcagttcgtcagtagtgatccatttgtaaaatgaggatagtcacagtaacagcctcatggcttcctcagctagtccatgtcaagggttggaacaatgctcggtacatagagaagccctcaacaaataccgacttgtatcaagtgctgctggtacccaggagatgctcataccctctccaggagcagccacttcttgctagggaagaaactatcccattaggtttctgcctaagtaagtaattggcaaagattttgaaagagcagtgagcccaggaagcagaaggggaaactgatcaagctgcatggacttagcccagaatgttcagaaaggagagagaaggaagtggtcagttcgagaaattatgggcattggattatcagcgttggattgactctcctgggatcaatcatggttgcccctgagctggggaggaagagaacagatgcaatagaaggactagatcagagctgccagatactttcccagcagcacaaacgtcaacttacctagagttgtaaaactgacattttgcccaaaattcttaactttcagggtatttgggagctgttaggattggcaattcagattcaattcaaattatttttttctatagtcctagaagcctatgccccatcatgcagtaaatatgatgtaaatatttgtagaaagaaagcaaaatgcctctgaaggtatcttctccagtatctcctactcaccagaatctcactacagcttaggtagcctccccaccaacccttttcttgcctttttctttgctgcttccctccaacctttgcctccatgccaccgacatgaagccccacttcaagcaggatgagtgagcctctggttggaggcccctggtgctggtgcctgtggctgggcaaggactgaccaaaggctggggcttgacgagcatcttgctccctggtgggtgcccagcccccaccagcctaccgactgggccctccctcccctgcaccctcagcagcacacactttctccccctttgctcttcctcctcactgtcccaaatccttgtttaattcaagggtgtatgtgaatgatccagtcagagtggcagggaactgctctctggctacattttcatgggatttttttttttttttttttttttttttttttttttttgagacaaggccttgctaggctgtagtgcagtggtacaatcatagctctccgcagccttgaattcctgggctcaaccagtcctcccacctcagcctcccaagtagctaagactgcaggtgtgtgctaccattctcagctaattttttaagaaagtttttgtagagatgaggtcccattatgttgcccaggctggtttcaaactcctggactcagtcagtcctcctgcttcagcctcctgagtagctgggactaccggcgggtgcccccatgcccagctaatttttttttcatagagacagggtcttgctatgttgcccaggctgacctcaaactccaggccttaagtgatcgatttttttttttttttttaaataattggaaccccctgccctgggacctggccttgcataaccctgcctccatcagctgaccccaggcagccctggcatgcccttgagttgtggtggacacgctgtatctttccatggcagctgccttcctggccgtgtgtgctgaggacaccactcctgtgggcagctgttcctcaggccacccagctgctcctgcaggcagtcagccacactgtgcccaaagggcagggaggccacctctgaacagcagggggcccgaggccaggactaggcattgtacactcatacaggaaggaagttctgatgttttaacaggaagaacatgggcttcaacttttgttaccacaacaagacccaaattagagctaaaactatgagaacgagtgtcaggacccacgatcatgtcattgctggcagccccatggtcagcccactctgcatgaatgcaaacctcctcgtactttctctgcctcctccccatacccaaagcccgagtggggctggctctctctagtgcattgttctcagccttctccggcctgggttgctggccagcatgctgacacgctgagctagctgcttcccaaattgagttagctgttactgagccagtgggtggtggagcacagttcttgtcacctgccactggtaaatgaatttaaaactcttgctgaaaggaaagaaatatggggcagatgcagacagcctccagctgctacaagcaaatgtggctcccttcaaaacaccaactaacccacccagcccttggagtatttatttgcaggctctgcagccagtgggaggagcgcctgagggaagaggtcatggcagagccatttgggaagttcctgcagtgggaaagggtttagcttctctgtgtcagcatcagaggtggaggattattttcaagagataagagcatctcattggcaaaagagcacattacaaccccaatgccttgtagctcatccctcctaatcttatcatatagtatgtgcagggaggatgtgttgctttctacactggtaacaaacgaccacaaacttgagggcttacaacatttaccatttcacaggttctgtgggtcaggaatctgggcagggctgagttccagcatctccctgagttatgattcagtgtgggtcagggtggtggtctcatcagaggctcaactggggaaaagatctacttccaagctccccaacattgttggcagatttcatttccataggcccttgcacagtgtaactgctcacctctccacagccagcaaagggagtcagggagtcttctcccttgtcagctcagatgaaatctcctataatgtaacctaatcagggacctattgcctttgccacattcccttgtttagaagccagtcacaggttctactcacaaaggcattaacaccaggaggcagatcatgggggctcccttcgaattctgcctactgcatggaggatatagccttatcagtaatgtttcagaagtgttcccaagtgaaggcccagcctgtaatagagattcacaatgttttctctttgaagtgaagcagttttgttcatttcctcccatctcagaatgacttcaaatcctgacatcctcgacagcccaatactttgccacaacctgattacaactctagctctcttatttactggctatatgttattgagaaaaggtaactttctaggggaagggcttatcctgaatctccgttttcttatctgtaagaatgtattccactaacatttttaggacagtagcatataatagttattgtcacttattaaataattccagcacctttcctttaggactgttcattttattgcattaacttatgtacatatggaactcaacaatgaaatattagtgttgctagtatgcacatcaaagcaaaaggaaaatgtattttaaaacaaatccagttgtatttaaggagctgaaatcactgatcctatgcttacagcaattcttagaggaaaatgactaaaaccatagacatgtccagaagatgtgcccatggctatgtctaaaaagtactggtgtcatagatatggggtttttaggtctttctctttcctgttttctctaagatgaaaatttttatccacttactggagggaaacaataagttcagcattagttgaaactggccctgccattatttacaggctcttgtgaaaagggaggccctagggcacccaaaagggtctttagcttataacctgctttggtttcttctgcaggtttgtcctggttgtggtcaagactggatgatgtaactggctctctaggaagcctcacttggccgtaacctcaggaaggttctctttgaccccatctcatttcgaagccacttctgaagccacttgagaaaaatgatgtgacagttcctatcaaaaaggattcagaaacatataccatctgtgaagaaagtggccctttctcccgcttgcaaaatagacattctcaaattccaaaatgccagccaagaccccaatttacctgaaagcagccaataacaagaaaggaaagaaatttaaactgagggacattctgtctcctgatatgatcagtcccccgcttggagactttcgccacaccatccacattggcaaagagggccagcacgatgtctttggagatatttcctttcttcaagggaactacgagcttttacctggaaaccaggagaaagcacacctgggccagttccctgggcataatgagttcttccgggccaacagcacctcggactctgtgttcacagaaacgccctccccggtgctcaaaaatgccatctccctcccgaccattggaggatcccaagctctcatgttgcccttattgtcaccagtgacatttaattccaaacaggagtccttcgggccagcaaagctgcccaggcttagctgcgagcccgtcatggaggaaaaagctcaggagaaaagcagtctgttggagaatgggacagtccaccagggagacacctcgtggggctccagcggttctgcatctcagtccagccaaggcagagacagccactcctccagcctgtccgaacagtaccccgactggccagccgaggacatgtttgaccatcccaccccatgcgagctcatcaagggaaagactaagtcagaggagtccctctctgaccttacaggttccctcctctccctgcagcttgatcttgggccctcacttttggatgaggtgctgaatgtaatggataaaaataagtaacaagatgccaacttttttcctttggggtaaaaggtacaaaaacaaactaaccacagttgaagagaagggcttccggagctgtatttgcagttttgtgttgggttttctaaaataatattcttacaaagtatttttttacctgttatgccctgtttgcaaaaacaatttagaaaaaaacaacaaagcaaaacctatcttggcaaaaaaaggaagtgagtcagagcccattttcaggaggcattggtgatgttcggctcacatattgtttgcagacacacaagaaatctggcttggccaggattggcactagctatgaagggctgagcgagtcacattaaggaacttcacggaactttatagcactccgacattttctgagcaagaggaagtcaaaatttatttaacacctaagcctttttgtagactcttttctatatattgcttaggctcaccatagcgaattctccagtgttaaaacttttctgttttcacatttgaactttatgggttttggggattttcttgtagttcttatatatccctatatattatatctatattgcaaaattttgactgtcagctacatgttggtaagacacaggcaaagtattactgtaactaagttatttttaaagttaaaatatatttttacgtgcctttggctttttattgcagagtctacattttatagattctacatcagatgttgtcacttatttccattgggattccattgtaagctgtgtatgtgcgtgtttggaaaagtgtattcatacttagtttttttttcttcatctgttatcatacttttaacagcaaccaataacggattgtaaagtgtaaaggcacaggttactcatgatgcttctgcagagactgtgggctacaccacatatgttatttggaaatataggtattttagtacagtacatacttgcattacataggtacttcaagcaacacaataaaaagtaaatgataaagtgaacttgcttgtttatagtaataaacaagaccataagagaataagtatagctagagaaattgcttctctgaaatgtacatgagcccttaaggtaagagatgatttccatctactctcattttgattacttccttatggtttgagaggctagaaactgagcctctctacttttggaaaaatgaacatgtgaggtcagatttttttttttttttttaagtcagcactgatgccaccctctcagtggtcatttctgagcatcttcctgacttgaacaccttctacagcaaactcttgcaagtccagtttcatccctgtaaggcaaatgtcttttcacgcagaaagtgccatatagacgagataaaggcagctaaaacgagggcagtagagagcacttacccgaccccaaggtgccagagatgccctgaggatggtggttaaggaaacaggagcaggaaatgtacacacagattcctgtccctttgccaactactccttccccatcaaagaaaaacacttgcacacagtaactaccagctccttctctcaaacttgtatttctcctggaaatgtatctcagaaatgacctcctctcccaaccacttcaacgattctttctttgggtttggggttcttgcagttctatcatctaaaataacctttggactgcaggtaaaatgcaattaggacaactaaccaagtagacgaaacaagttcccctaggcaggggtgtccaatattttagcttccctggaccgcattggaagaattttcttgggccacatgtaaaacacactaacactaaccatagttgatgagcttaaaaaaataaaaatagaaaattgcaaaaaaaaaaaaaaaaaaaaatctcagactgttttaagaaagtttaaaaatttgtgttggacttcatgcgggccacaggttggacaagcttgccctagggcattgtgtgctttccgtaacttctcagttgtatttcgttatccatgactctccagtgttttttctgttggaccacacccgtcacagttcacagttccaaagagaaatttcccagcctattctaaatcttgttaatgacgaagagtccaatgtatctcattatttgtagccaattttagactcttttcaatacctcccccccattttaattagtattgatcatattcagtctttcattttactcttcatctgtagcgtgacctcaaggtaaagatgaaactatttcatgaaaaggg

SEQ ID NO: 37189 - DNA, 28584 bp, Homo sapiens; identical to SEQ ID NO: 37188

SEQ ID NO: 37190 - DNA, 28584 bp, Homo sapiens; identical to SEQ ID NO: 37188

SEQ ID NO: 37191 - DNA, 3298 bp, Homo sapiens
aggcgcggttgtgagtagtaccgggagtggggtgatcccgggctaggggagcgcggcggccgcgatcgggcttagtcggagctccgaagggagtgactaggacacccgggtgggctacttttcttccggtgcttttgctttttttttcctttgggctcgggctgagtgtcgcccactgagcaaagattccctcgtaaaacccagagcgaccctcccgtcaattgttgggctcgggagtgtcgcggtgccccgagcgcgccgggcgcggaggcaaagggagcggagccggccgcggacggggcccggagcttgcctgcctccctcgctcgccccagcgggttcgctcgcgtagagcgcagggcgcgcgcgatgaaggcggtgagcccggtgcgcccctcgggccgcaaggcgccgtcgggctgcggcggcggggagctggcgctgcgctgcctggccgagcacggccacagcctgggtggctccgcagccgcggcggcggcggcggcggcagcgcgctgtaaggcggccgaggcggcggccgacgagccggcgctgtgcctgcagtgcgatatgaacgactgctatagccgcctgcggaggctggtgcccaccatcccgcccaacaagaaagtcagcaaagtggagatcctgcagcacgttatcgactacatcctggacctgcagctggcgctggagacgcacccggccctgctgaggcagccaccaccgcccgcgccgccacaccacccggccgggacctgtccagccgcgccgccgcggaccccgctcactgcgctcaacaccgacccggtgagaggccgggcgccggccgtgggcggacgccgcgggggatgggaggttggtggcgtggtggcgggacgcgggcgctcaccgtcctccgggcaggggcgggccaggaatgacagccccctccccctgctcctccgggctcccccgggccgccagcagccggccgggctcggcgagcgcgggtccgggagaacgcgcagggcgggactcggggctgtgggcgccctgggctgtcaagtcccgcctgagcccggaggggcccccccggctacaggctggggtgggggcgtcggcgcgccagcctgatttccgaggacaatccaggaccgtgtcgagcgcgttgtttgcgcctgctaacctttcccttggtgttcggttgctgttccaggccggcgcggtgaacaagcagggcgacagcattctgtgccgctgagccgcgctgtccaggtgagcgcgcatttcccgtctcgggtggccggtcaccagagacgcccgtccccgagggcttccggggccaggcaccgcggtgttctttgcccccagcgtttctgagagcaaactcccaaggaagtaaatcccctctctccctgccacctaagtagcaagtaaacccgtacttagccttagaactcgaggttcagtctcggtggagacgggtcagcccttgtccccgccgtccccgtgttttttctggtggtcagcgggctcttctgccttccctagttcccgagggagggcaccctcgtgggcatgggagctgccccggtgtcctcccgtgcagtctgtcacccacaaagggggacgcgggcagggcgccggagtgggtcccctctccgggcttcccgagggccgcagctgcctgctcggcgcctggcccggccgcgggcgggtgttgtctgacctggtggtttgttttgggttgttgatcaagcatgtcttgagtttggtcggtggcgccagttagtctgcagcgagaaggttcacacaccccctctattcattcctcttccacaggtgtgcggccgcctgagcccgagccaggagcactagagagggagggggaagagcagaagttagagaaaaaaagccaccggaggaaaggaaaaaacatcggccaacctagaaacgttttcattcgtcattccaagagagagagaggaaagaaaaatacaactttcattctttctttgcacgttcataaacattctacatacgtattctcttttgtctcttcatttataactgctgtgaattgtacatttctgtgttttttggaggtgcagttaaacttttaagcttaagtgtgacaggactgataaatagaagatcaagagtagatccgactttagaagcctactttgtgaccaaggagctcaatttttgttttgaagctttactaatctaccagagcattgtagatattttttttttacatctattgtttaaaatagatgattataacggggcagagaactttcttttctctgcaagaatgttacatattgtatagataaatgagtgacatttcataccatgtatatatagagatgttctataagtgtgagaaagtatatgctttaatagatactgtaattataagatatttttaattaaatatttttttgtaaatattatgtgtgtgtttttttttaatctatgggaatatttcttttggaaaatcatttttcagctcaattacagagctcttgatatcttgaatgtcttttctgtttggcctggctcttaatttgcttttgttttgcccagtatagactcggaagtaacagttatagctagtggtcttgcatgattgcatgagatgtttaatcacaaattaaacttgttctgagtccattcaaatgtgtttttttaaatgtagattgaaatctttgtatttgaagcatacatgttgaaaatacaccttatcagtttttaagtacagggttttatagtgtaatatatacagagtaagtgtttgtttttgtttttcaactgaggtcaaaatggattctgaatgattttgcatatgggatgaggaaatgcttggatccttaaggagtttacgaaatctgctgttttatcaaagtgaaaaaaaattgcttattactcttcattttacactaaagcttaatgtcactaagtttcatgtctgtacagattatttaaatcatggaaatgaaaaaaatgttctctgcttgctaccaaaggacaaactcttggaaatgaacactttctgctttccttcctccaaagaattaataggcaacagtgggagaaaaaaaaggcataatggcaaatccttcaagcagggataaaagtcgatcttcaaacattaacttaagcagaccaaaaattctgatgaccgcatctagattatttttttataaaaatgattttcactatagctatgttacgctaagctactgtccaatctcttgtgatgtgtaacttttacatgtgaatattaaagtagatttctctgtcttgt

SEQ ID NO: 37192 - DNA, 3298 bp, Homo sapiens; identical to SEQ ID NO: 37191

SEQ ID NO: 37193 - DNA, 49042 bp, Homo sapiens
gcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcctggacacataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggccccgggtccccaagacccttgtgctcgttgtcgccgcggtcctgctgttggtgagtccccgccgcggtccctggctggggaagagcgtgcctggcgcctggagagggcagggagagagggggacacggcgggggtgcgtggcccgggtcgcctgcggccgggcatgtccgggcaagacgcaccagtcgtcggagtcgggggaagagatgggtccccgggttgggcaggagcgacctgggccgccagggaacagagcgcgcgctccacttggtgtaaattcccgaatccagtgggggagggcgacaaggagggaattcccgagtaagctgcgtgaagccacggagaggtcgtcggactttgattttgttttctttccttactttctgtttctttctctttttctctttcttcctttctttccctcccttccttcctcgctcagttcctgccttaatttctttttcttttgcgccttcgaatgaattcctaaaggcgctcattgcagatcgctttgaacctgcggccggcgaagaactcccctgtggtcgctgcggcccagtggttccgttccgtgcgcgggagtcgtcgcgggcgcagctggagaggccccttcccctccttagcggctgcgcccctacgcgtgcggggccgctcatcgccaatgccattgtttggggttccttgggaaaacgagatttaggagaagggagttgtggcacttggggcctgacctgcttgataatagcagctgcattttggcctgggaagagcctttcttgccacctcttggcaagtatccgtgataatggggaagggacaaagagtcggctttgtagggaacagcatggtgtgctcagcgcctggaactgcgcttggggccaggagaggttctgaatcatcacattttacagaggaagagaccgcagctcagagtggggaagtgtgtgggcctagacctaactcaagactgtacagaggggctggaagggagaggaggaacagtgaaaggaaggtcaagagaatgctggtgttgacctagaagaatgtcagtgtgaagcattggagtttcatgggatattgttacacacctcatgttttcactgtttccgccccacaccacagtatgtccttggtctcacctctgagtggagggaggacctaactgtcctagtgaggagagtgtacaggggcctctgcctccccctcctgctgtggtttctgtgggcctaggtccccagggcatcttgcctctctttgggtggtggatctttggtctctggctgcttttaaagatttttcttagcactggtttgcagtgatttggtttgtttgctctgttgtggggttttttttttatctctataaagaattttttggatttttggctttagactttcatgttctttctacttggaagatttttctgtaaagaaagccacaactgggttgtgttgaatttcttggatttggggttttagagtttatgttctccttggagacttttctgtaaagaaagccacaacagccgggtctggtagctcatgcctgtaatcccagcactttgggaggccgaggcgggcagatcacatgaggtcagggattcgagaccagcctgaccaacatggtgaaaccccgtctctactaaaaatacaaaattagctgggtgtggtggtgggcacctgcaatcccagctacttgggaggttgaggcaggagaatcacttgaacctgggaggcagaagttgcagtgagcagagatggcgccactgcactccagcctgggagacaagagcaagactccaactcaaaaaaaagaaagaaagaaagccacaacagagttatgttgaatttcttggatttggggttttagagtttatgtttttgtttgtttgtttgtttgttttgagatggagtcttgcctctgtcgcctaggctggagtgcagtggtgggatctcagctcactgcaacctctgcctcctgggttcacgccattctcctgcctcagcatcccgtgtagctgggactacaggcatgcaccaccacgcccagcgaactttttgtatttttagtagagacggggtttcaccgtgttagccaggatggtctggctcgtgatctgcccgcctcagcctcccaaaatgctgggattacaggggtgagccaccacgcccagccgagtttatgttctacttggaagattttcagccattatttcttcaaatactctgtctcttctggtgactgagatcttattatatttacgttagaatgttagattttgtatcagagctaacttagtatctgttcttttttttcccccatcattttctatgtttcactttggacatttccctgtgagggctcttcaagttcattgatctgcttctgcagaatctaacctgctgttaatctcatctactgtatatcagatatatattttttgaactttagaagttctcttttggcatttttaatatcttccatctatttcctggtcatctttgtgtttttcttttttgagacagggtcttactctgtcacccaggctggagtgcagtggcacagtcagagttcactgcagcctcaacctcttgggctcaagtgatcctcccacctcggcctcccaagtagctgggaccacaggcacttgcaaccacacctggctaatttttgtatttttagtagagacggggtttcaccatgttgcccaggctggtctcaaactcctgcgctcaaggaatcctcccaccttgtcctcccaaagtattgggattacaggcctgagccaccgtgcgcaacctatgattttggtggtggtgttttttgtttttctgttttttaaatattcttgagtatatttgtaagctttagatgacctgttttaagttatttaatctatcaacaccattatatctgttattacggccactgtttctgttgattacattttttttcctgcccatagggactttttttttcatgcatagtaatttcttattgcttgacattgtgaattttgctttcttgggtaccgaacatcactgtgttctttcaaagtctattgggcattattctggtcacagaaaactgaggatcagtttgctcctctgatactagcttttatctacatataactatataccttgtgttcagttgccttattcaggggctcatttagttaactactaaagttatagtggttgacttctgatggtaactcgccagcaccctggcatgcgttctgtccactgtgggaaggggaacatgcagatctcccagccctgagtggtccacaatctagtctctccttccctgggtggcttcttctcaggcacctagagtcagtctcagcagacactggacatgtcttctgcaaggatccagagtcctccaggcagctgcttctcccagtctctgccctgcacttggcctctgggagttcctgcctgtggttctcaacagagactacagagctctacagggtcctctgcccctgctgtagctggaggctgtccttacgcagtgagctgaggccacagctagtctcactgcatgtgcttggcggcggggacaggagtgattcattcatcaggtagaggaggaaccctttactctgggaaaatctgtgcctgggttggggaaggacaaatgagccctgtgtgaatactgactactccctggagcccacagtctggtggagcaggtgacagcagggacctaaataactatcaggaagcatgaggtcccaccactgtcacctcccccacctccagagtggctgtgctggctccagagatgtcatccctccatatttgactgacagagggaggctgtgcagtcccaaggctccaggtcatggtagtttggccaggataatatggtttgcttaaaatcaacattgagggtaatgatcgtactaatcagagcatgtgtttaaagttctgtgttttaagcactttccatacatattaacactttcagttcacacaacaacctatgcaggaactgtgattatcctgggcagttttaaggatgtgggtgactcagagaggaaagaagaggttactcgggttaatttttgacgagaaatattagcaggttttatgctcaaacttggtgtaaagcaaggagcctgaatcacaggtgggtgagtcacaagacagggaaaccccgccaatggctcatgtccgggaggaggcagggtccctagaattcaatgggacaagaactgaaataagccaaacccctgacctcccttcttcttgttttccttctctctcttaaccatgcccatggacacccccatgagcccatttctgtggcccaacacagctgtgcatctctggccacacgcccattctccctcaatcagagaggcccacggacggcacagcctcgtcctgcacagcagaaagagtgaatggtgatgaatggatctatattatttcaactctcctacattttgtaatcatattacaatattaattcagcagtacctctcttgtttttactcccctcccccattacactggattcctgtctgtctgggattctgtctgtgtgcactctttcctctatgtccactactgtccctgccaccgatggcatttgtcacctctgcctgggcagcccctccagactctttgcaagttcatggactttggggttaatgatggctgtgcctcagctcctgtgaatggaaactgtgctaaggaaaggaagggccgtgccatgttcccgatactccacggctccttgcatatgcggtcgccaggcgcctacatgccttccatgaatgaatgaatgagtaacgtggattctaggaagctgcactaacccagacgttgtgtcctcagcctgctcatagagtgtgttaaacgtgagaggtggggagtgtggcaggcaggctgaggacagaacagaggatctgaatagagtacggaggatcacccaagtccagagtcaccaaggccattgtcaagttttccccggggacatccctcatcagatccacccattaaagatcattgttcacccagtggagagtggactaggtgggtgcactcaggtgtggcctggacagcattcgggatgggtcctagtggttagggtgagggtcaggttgcattatcgtgaaggaggcaagtggcagctgaggcagatctgagggaaatgatgataacgcaggccggtgatgcaatgggtttggtaagaagaggaaagaggtttgtggtggattctagtgtttctaatctgagacttgggtgaggtcattaccaaataagaaagagtaaatgggcataaatggctttaagaattaggaacctgaatgtgctattggagacagtatgggcacgtcattgctcatagacctgcagtacacaaaatgctaaaagatttcaatctgaatagagatgaaatgaaatggaaacatggatttttttttttttttttgagacagtttcactgttgctgcccaggctggagtgcaatggcgcaatctcggctcactgcaacctctgcctcctgggttcaagcgattctcctgcctcagcctcctgaacagctgggattacaggcgcttgccaccacacccagctaatttttgtatttttagtagagaccgggtttcaccatgttggccaggccagtctcaaactactgacctcaggagatccaccgccttggcctcccaaagtgctgggattacaggcatgagccaccttgcctggctgggaacatggatcttaaggaaagaaggaagatcatcaggaatagaaatatgaatgcacatataaagaatgattatttcctcttaatttcttgaaaatattcactatcaagtaatataacactttgtagggtttgtaacatatgaacatgcctgagacaactatagcagaaagaatgagtagtggagatgaatcaatctgtattatttcaagtctcctacattttataatattaccatattaattctgccatacaactcagtaatgaaaaggaatggagtactgatgcatatgaaaatatgaccgaatttcaaaataattatgctgagttaaagaaaccagacagaaaagcatatatagtatctgattccatctatgatatttatagccagaaatggtttaattaaaaaagaagaaggatcttaaatcaacgagctaagtttacaaatgtaggaattagaaaaagaatgaaccaaacctagagttagcattataaaggaaataattattagaagagaaataaataaaacagagaatagaaaaacagtagaggccggatgtgatggctcacgcctataatcccagcactttgcgaggccaagacaggaggattgcttgaagccaggagtttgagaccagcctggatatggcaaaaccctgtctctacaaaaaatataaaaagcagcctggcccgggggagcacacctgtgatcccagttactcgggaggctgaggtgggaggatcacttgagccccggagatgtaggttgcagtgagccaagatcacatcactgcactccagcctgggcaacagagtgagactctgtctcaaagaaagaaagaaaaagaaaaaagaaaaaccatagagaaaatccacaaaaccaacattgattcttcaatactattaattaaactgacagaattcactagtgaattctaacaagcttttaatgaagagctaataccactacttctcaaactctttcaaaaacttgaagagaagggaacctttcttgactctttctgtaaggccagcattgctctgatacccaagcagataaagatattacaagaaaataaagctatatcccagtatccctaactgatgcaaaaatcttcaacaaaatactatcagagagaattcaacagtaccttagatggattatacaccatgaccaagttggatttatttccggaatgcaagaatgtttgaacaaatgaaaactgaacaatgtaatacattgcattaatagaatgaagggggaaaaagacacatgatcatctgagttgatacagggaaagcctctgataaaattcaaagccctttcatgatgaaaacacccagcaaactaagaatagaagaaaacttccacaacatcataaaagccatgtaagaaaaccccacagctaacatcatactcagtgttgaaagacggaaagcttttcctttaagattaagaacaacataaggatatctacccacctttgccactcagcatagtactggaagttctagccaaaacaggcaagaaaaagaaataagagcatctggactgtaaaggaaaaagtaaaataatctgtgttttcagatgatatgatcttactggtaaaaaatccaaaagatttcacaaaaaattaaactgccaaaaataaaataatattaaatttttaaaattttgaaatttattgttgttcagtaaaagacagtacagattgcaatctgggagatttcaaaccaagtggtaagaaacttgccttacagcaggtatagtacaggctataaaggaggatgtattttgacaatttcatgattgacttataaatttatattctttttaaaggcaatcagagctgtttaagctgatttttctatagctgcttgatttaacttcactgaaccatattatgtcatgatgaaggtgtaaaacttatattttgtgggattttttatgattatagctaatgtttcagggatatcaggatgtcttaagttttggctacatggttatgggtaattgccgtggggtatatctaaactgtgtttttaatttttatttagtagtactaaaatgaattcatcaaagaagcggaatacaaaatcaactggaaaagtcaattgcatttctatacactaccaatgaacaattcaaaaaaagaaattaggaaaaaatccatttacaatagtatcaaaaataataaaataggagtaaactcaccaaggaggtggaagactagtacaatgaaaactataaaacattactgaaagtaattaaagaatacaaaaataaatggaaagatatgccatgattatgaattataagactaattatgtcaacatttcctaaagtgatctatacattcaatgtaatctctatcaaaatcccaaggacatttttgcagaaatgaaaaaatgtatcctaaaattcatatggaatttctagggaccagaatatccaaaacaatcttgaaaatgaataaaaatgtagtaggattcacacttcctgattttcaaaacttcctacaaagctgcagtaatcaaaacaggatggtactgacataaaagcagataaatcgatcagtggaatagaatagaggagccagaaataaacactcacatatatggccaaattatttttcacaaggatgccaagactgttgaatggaggaaagggccgtcttttcaatgaagggggctaggagaaccggatatccacattcaaaagaatgaagtgaaccttagcctaacattgtatttaaaaaatagctaaaaacaaataaaagatgtaaatgtaagtgctaaagctatagaactcttgaaagaaaatataggataaaaattctgtgacattggatttggcaataatttcttggatgtgacaccatggacataggcaacaaaagaaaaaataaacattttggacttcttgaaaatcagtaactcttgtgaatcaaaagatactattaactggataaaaaggcaaaacccacagaatgagagaaaatattttaagttatatatctgataagggcttaatatctaaaatatataaagaattcctacgatctaacaaaacaaaaacaacccagttaaaaatgggcaactgatttttataaacatttctccaaagcaaatatacaaatggtcaataagtatatgaaaagatactttaatcactaatcattagggaactgctggtcaaaacgacagagataccatcctatacccatcaggatgactattataaaaaacacacacaggccgggtgcggtggctcatgcctgtaatccccacactttgggaggccaaggcaggcggatcacgaggtcaggagattgagaccatcctggctaacatggtgagaccccgtctccactaaaaaaaaaatacaaaaaaattagcccggcgtggtggcaggcgcctgtagtcccagctacttgggaggatgaggcaggagaatggcgtgaacccaggaggcggagcttgcagtgagctgagatggcaccactgcactccagcctgggcgacagaacgagactctgtctcaaaaaacaaaaacaacacacacacacaataagcattagcaaatttgtagagaagttggaaccctcgtgccctgttaatgggaatgtaaaatggtgcagccactatggaaaacagtatgatagttcctcaaaagtaaaaacaggattagcagatgatccatcattcccacttctaggtatacgtccaaaagaattgaaagcatggtttcaaacagatatttgtacacccacgtttatagcagtattattcacaatagccaaaaagtggaagaaactcaagttggacagatcaatagataatgtggtatattcatacaatggagtattactcagccttgaaaaggaaggaaatactggcacatgctacacaatggatgaacattaaagacatgctcagtaaaatgccattcataaaaggacaaatgaaataggattccacttgaggtacctaatgtagtcaaattcataaaaaccaacagtagaatgttggatgccagcggttgtaaggagggaagaatgggaagatgaaataacttctgaggatggatagttgtgattattgcacaacaacattaataaatgtagtgtcactgaactatgtattttaaaagattaaaagataagtttcatgttatatataatttaccttagttttagatttaaaaaaacagcatttattttagtcactataacaattacacataaaatggaaatattgttgatttaaaaagccaatgcacaagctgggcacggcggctcacacctgtaatcccagcactttgggagggtgaagcgagcagatcacctgagattgggagttcaagatcaccctaaccaacacggagaaaccccatctctactaataatacaaaattagctgggcattgtgatgcatgcctgtagtcccagctactcgggaagctgaggcaggagaatcgcttgaacctgggaggcagaggttgtggtgagccgagattgtgccatggcactccagcctgggcaacaagagtgaaaatccatctgaaaaaaaaaaagccaatacacaattaaaatgggattctaaaacatactcaattaacattaaatatacaggtaagaaggaacaggtaaaaaatagaatggacaaaaattggtaaaattatagaactattttggctatagtaataattacactaactgtaaatccaccaaacactataactcaaaggtagatatggttagaaggatgaaaaagcaagacttaactacataatgtttataagagatggaatttttttttgagacagagtcttggtctattacccaggctggagtgcagtggcgagatgtcagctcactgaaacctcctcctcctgggttcaagcgattctcctgcctcagcctcccaagtagctgggattacaggcatgcatcaccatgcccggctaatttttgtatttttagtagagatggggtttcaccatgttggccagtctggtctcgaactcctgacctcaggtgatctgcccgcctcggcctccccaagtgctgggattacaggcatgaaccattgtgcccagccaagagatggaatttaaaagcaaaatgcaggtatagtaggagcaaatggatgaaaatagatataccattcaagtaataagcctaagaaaactgctgtggctatcttaatatcatatgaggtggattttaaggtaaagaatattataagacatgaaaagggacctttgtagtgttaagagagttaattcatctggtagacataataatcataagatatatgtcctcaataatagagcttcaaaataaatgaagcaaaaatttacccagcactttgggaggccaaggtaggcggattcacctgaggtcaggagttcaagaccagcttagccaaaatagagaaacttgtctctactaaaaatacaaaaatcagccaggtgtggtgtcatacacctgtaatcccagctactggggaggctaaggtaggagaatcacttgaacccaggaggcggaggttgcagtgagccgagatcatgccacagcactctagcctgggcaacagagtgagactccaatctcaaaaaaaaaaaaaaaaaaaattacagaattcagaggaaattataatacactgttctaagcaattaatggaatggtttgacaaaaatattagtaaagtcataaaagggccaggcgcggtggctcacgcctgtaatcccagcactttgggaggctgaggcaggtggatcacaaggtcaggagattgagaccatcctggctaacacagtgaaaccccatctctactgaaaatacaaaaatgagccgggcatggtgggtggtggtgggctcctgtagtcccagctactcgggaggctgaggcaggagaatggcatgaacctgggacgcagagcttgcagtgagccaagattgcaccactgcactccatccagcctgggcaacagagtgagactccgtctcaaaaaaaaaaaaaaaaagtcataaaagatctgaaccaccttgacttaattgacatttataagaggacacatgcatctactgaaaactcattctcttctagtgaagatggtaccctcactcattttatagcccatattctgggctataaaataagtctaagtaaagtctcttttaaaaaagagaactcatatatgttctctgatctcaatgaaattcaattggaaatagataacaatgtctagaaagacctccaaatttggatgctaagcaacacacttataaataatccatggttcaaaggagaaattaaaagctaatacaaaaatatttcaaaatataatgaaggtttaatgcatcaaaacttgtgggaagctattaatatggttctcttttttttttttttgagatggagtcttgctctgttgcccaggctagaatgcagtggcacaatcttggctcattgtaacctccacctccctggttcaagggatcctcctgcctcagcctcctgagtagctgggattacaggcatgccccaccatgcccggctaatttttgtatttttagtagagacagggtttcaccatgttggtcaggctggtctcaaactcctgccctcaaatgatcgcccgcctcggcctcccaaaatgctgggattacaggcgtgagccacacttaacttcacatttcataattcctgagtcttatcaggcaaaaacaagtcctgaaaaaacaaagtaaatctacttattatagtagggcagataatacaaagttgggcattaaggtaatatcgtatttatagttttaaagctgatgactctataaggacagtatgtgcttcagtgaaattataaacatgaaaactctgctttcagttcttttggatacatacccagaagtgggattgctggatcatctggtaattctacttttaattttttgaggaacaaccatactgttcctggaccaaactgagggtcgggctgctatttcttgccacccattaatgagatgccaatgaactgggaagaaagagtttttatttctgtagctggttacagggagaaggcctggaaattatcgccagaccaactcaaaattacaaagtgtttcagagcttatatcctttctaacctatatgtctacatgtaagtgtgcattcatctaaagacataagtgattaacttcttttaatctataactaaggtctgagtcctgaagaccttcctgtggagcctcagtaaatttacttaatctaaatgggtccaggtgctggggtgattaccctgctaaaccatggaggtttggggagttccttcaaacctccaatacccttgtttgtggaggcctggggagtttcttcaaaacccccaataaaacttgtttaatcctaaatgggtcctgttatgaattcctccattattttgtcatgctttaaggcccaggaaaggcctaagcaaaactcttgatgggcttttgttacattccagcctttgtataagggcactggcttttttttttttttttttaagcatttaatagttaacttaagcacttgattagtactgaaacagttgtgatggaggcctgcattagtgaaacctggcctgctacaatccccactgtcaatttgcgcatgatttctatcatgcttgtgtatttatttatcatgagaatcgtagggagatggggtgtcataatctttctggctactttcagctgagagagggtcattgttatggggcaccaaatgcagtactggagtggaggaggttgatttgttcccggtagcactgtctattttaggggcttagagagagtgcctgctgaaacacctagttttcagttcacagggctttaagaaagcaaagcttaggtttcagtgatttccagttagggaaaatggagaaaaaggaaaagaaaaaggaaaaaattgaaaacattttgagacttgcagccagaaaaattagaatttaatccaaactgtagaaaataataaaaactgaaaaacatcgaggaagactagaatttaacaggtgtaactataatttttgaaacataatttttctctcttgtttcccatttttattaaaagacaaatcatggtaggactggtttgctttattatacttggcctaattacttatataccgtgcagcaagaataattattttttacataggcgttttaaatgggctttgatggaactttgttccatagcaggaatctgagataagacctttttaaagccgagcccaaccatggatttataccatcaaatacctatgagttgggtgaattcctctcttcttgaggttccaagataacttggggttcctggcctgtcagaaagtgacattctttacttaccacaggtcagaaaccctgtacagggtctatgtacacaaattatgaggccagtttccaagggctttcttggcttcctaagtcaagtttgattccttaaaggagagcaaagtcaaagccttggtaaaataaccagtttttccaattgtgtcctgttacaaaagaaaacagattcttactgcacttatgcaaataactatattgccataacttaagaatactcacagtttcgaaattctggagaaaatcaggtagagagaaacaaatatgctccaaattttgttcataggagtatactgtacttaaatgttaaaaggtgttaatagctcaaaagaaaagtttccttgcctctgaaaagcaaaacaaaggattagcaacattttaagccgaaagtcaaaaagatcacttcagtctcctattagttcagttcatgcagttaattcctgtcctgtttgatattaatgaacattttaactcttcaagagtcatcaacgtttttcctctattttgatgtcacaatctccaaagttatcagaaacctgcattcaagagcacctgttagagctttacagctgattataaaaccaccttctaaagaggaccaaaacaagacagacaacaattatttatggaggacaaaaggttttagggtagccatagttaaagacacaattgatgacaagggtatctgttacctctgtggcacacaataattttaacataacaattataattattaatgataacatacactaagatatatcagaattataggagtcttccataactttggaacacataccaataatatatttatgcacatacagcccaaagaaagccaaacaccatttcatgtttgacaatgcttcctgtataattttatatcaaataagccacatttcacctttacattagtgtactattaatgttaaatccaatttttaataaaaccttatagacacatttacccaattttaatgtttgaccataaagtaagagttttatagacctttcataactctttacaatttttgttaaacagaaggttagtgctctaagagaaacccattgtgcttttattttaatgctcaatttacagaaaaactggatgatatccctttaattttagccaatacatttacacacagaattgtctttacaattacccttccacagcttgcttaaactttcatttttattttatccaacttaaaacaatcctttaaccttttaatctagtaaaaaatatccacattctcatgcctccttataatctttttaccaaaagtatattttactttccttacacaacttgcatgtaaactgttttttcaatagtcttaaatacacattacattgttaattcttagcaaccttttcttttggtgaaaaccttggtaaatttgggattttaattatatactaggtatggagcctacgacctagacagaaatgcaggtaaggtctgacttattctagcatctagctccatgtgtcctaggccttacctagctgcaaagcaggcaagttgtacagctaagagtcatagtggcattttataaagcatttaggaggcctaatcacctttaaattgtacaacatttcttgcataaatttcctttcataaattctttcacaacttacacagacaatctctgacatgccttgactttctgacttgttctaaacatccctctctttaaacaaccagttaatttactttaggacaagaatttaccatacaggagcccttcttgtataaattctcttttctttaaaactttttgcatagctaggggacatggctaatttcacatgtccccaggccgtatctagaatttaacagtccaaaataaattgaacactttttaagtcaaagaagcattttatgacctaaagcatttagcaaacctagtatttgacctgcataatttagaccaactatttacatttttgaagatacttttaccaataatctttaaaattctccttatttttataactttctgtatatctctcttatttcctggtttcttttaccttgttttatatataacctttaaataagctttgaataagacaacaattagttacccttggccaggcgtggtggctcacgcgtgtaatcccagcactttgggaggctgaggcgggcggatcacaaggtcaggagatcaagaccatcctggctgacacggtgaaaccccgtctctactaaaaagtacaaaaaattagccaggcgtggtggtgggcacctgtagtcccacctactcgggaggctgaggcaggagaatggtgtgaacctgggaggtggagcttgcagtgagcagtaattgtgccactgcactccagcctgggtgacagagcaagactctgtctcaaaaaaaaaaaaaaaaaagttaccctttaaaaaggacacaatctttagaaagaatgttttcctacgatatatttttattagaaaatacccaaataattagatatctgttgtttaatataactttagattctaaattatgacaagtttacttatgagtatgtatcccattacatttatctaattatttattttaatcatttacccagattatatatgaaaactgcgatagttgtcattaaagttaggaaaccaccattgcaaaattatgaccgagacagtgaaaatgatctgacctaactgactccatcttccttctaacctacaaggtattcttgtttattaacttagtttataatttagctttgaaacaaatgtgataacagtcctttcccagaacaaacttccttcatgtctgtggactagactgcttaaggccagaagattagaagttagggtattttggccaggcacggtggctcacgcctgtaatcctagcactttgggaggccgaggtgggcggatcagaaggtcaggagatggagaccatcctggctaacatgatgaaaccccatctctactaaaaatacaaaaaataaccaggcgcggtggcgggcgactgtagtcccagctactcgggaggctgaggcaggagaatggcgtgaacccgggaggcagagcttgcagtgagccgagatcgcgccactgcattccagcctgggcgacagagcgagactccatcttaaaaaaaaaaaaaaagagtattttactaaataattcaagatgtaactatcttcattaaaacaatattaatgtttcatttatttaaaaattacacatgcaaagattattctgtttgcactgaattatagttttgtagcctctatgccagattttgacaccttataatatttggcagagataagtatgaaattgcttgatcaataaatgcaaactaaaatgtatgctggaaactcttaagacatttctaatattactttaccaataatttttaaaaccagcttacttattaaagattttaagtcacataaacttgaaaaagcatttgactagtctttccttttttctgttattcaagtgcttttttctttgagccatttaattagacctcttttgtatatcttcagtagtgaaacatggtgtacacaagacaaatacataagtgtattatgcatgccaatagaagtacattttatagattcgtaagacctcatttttcagtctccctctactgcctaggccagagtacagtggcatgatctctgctcactacaacctctgcctcccaggtaaaagcaattctcgtgcctcagcctcccaagtagctgggattacaggtgcctgccaccatgcctggttaatttttgtatttttcttagagatggggtttcaccatgttggccaggctggtctcgaactcctgacttcaagtgatcagcccgcctcggccttccaaagtgctgggattacaggcatgagacaccacgcccggccttaactggatgtttgagctctgggtggagcccatactgaatcctgggttttcaaaaagggagaattattatgaggctagaccatgtgatgcttttacagtgcacttaaacaattttttcccaaagacatttctaagtgtctaaattacactttttctttaaaaccccagagtagcttctgtttaatagctattaatgaagaaaacagaattcagtcaactgagaagaaaaaaagttttgctcaaaaagataaggccctaggagagagagaaataaaaccaaaaacacgaaggccttttaaaggccttcacgcccccgtgcgcacacacacacatatgcacatacacattttggatgttagcttttaattaagctgactcccaatcattgagcttcaaaaaatctttctccttcccagaggcctctcagcagagatggacccaatacttcccattttcaagtttacatggtatcaaaaggaacaagacagacacacaaacaaatggaaacatttcagaaaaacccaaggggaagtgcactacggcaaaacagactctcaaaactaacgcaaaacctgatatcaaccaaagggaaagtgggtgtatgagccagccctgttgcttcccttggcagtaccggataaatggcttaaccagcccaaatgggaaaacaataggctcctggcctaagatcccattgactcaccctttgagcacgtccgctccttatctctgttcttccccagtagagaaagggacgtgtagatttgcacataaacagccctctggagggtcccctggggaaacctcacctgacagctgctgggatcctcctgaagactgtctcatcgcaagctaccagccgctgaacgcggcactgtccttatcttctggctggcgacttttttgttcccagaccaaactgagggtggggctgcccaataatgagatgcaggtgaatctcgctgcccaataagaagatgcaggtgaatctcgctgcccaataatgagatgcaggtgaatctcactgcccaataatgagatgcaggtgaactggggaggaagagagtttttatttctgtaactggttacaaggagaaggcctggaaattatcaccagaccaactcaaaattacaaagcttttcagagtttatatcccttctaagctatatgcctacatgtaagtgtgcattcatctaaagacataagtgattaacttctttgaatctataactaaggtctgagtcctgaagaccttcctctggagcctcagtaaatttacttaatctaaatgggtccaggtgctggggtgattacccttatcttgtctcctgctaaatcatggaggtttggggagttccttcagccctcccacacacttgtttttggaggcctggggagtttcttcagacccccagtaaaacttgtttaatcctaaatgagtccttgttaagaatttcttcattattttgtcatgctttaaggcccaggaaaggcctaggcaaaactcttggtggggttttgttacatcccagcctttatataagggcactggctttttttagcttttaatatttaacttaaccactcagtcagtactgacacagttgtgatggagggctgagtgaaacctggcctgccacgatactgtttttcccagtgtgtgttttacattcccaccaacagggcacgaaggttccagtttcttcacacctcaccagcacttgttattttccatgctgttgtttttaatatagtagacgttagtggtggtgagcatcttttcatgtgcttatgggccatttgcttatcttctttggagaaatgtctttcaagtcctttgccctttttaaaattttttaaaaatttttattgtaaattaagaaattacggccaggcacagtggctcatgcctgtaatctcagcactttgagaggctgaggcaggaggactgcttgagcccaggcgaacgttcaagaccagcctgggcaacatggcaactcccaataaattgtatgtatttatggggatttatagggtacaaagttatgttatgatttatgaatacaatatggaataattaaatcagctaatatgtccaacacctcaaatacttaacatttttatggtgagaacatttgaaatttattcttttagcaattttgaaatgtacaatatgctgttattaactacattcattgcactgtgcaacagatctcaaaaatcttattcctcctgtctaaccaatggtttgtacctttgattatcatctccccattcccccgtgcccagactctagtaaccaccattctattctctgcttctgagttcagttgtttttttttttttttttttgacacaaaaatttcacttttgttgcccaggctgtcgtgcaatggtgccatctcagctcactgcaacctccgcctcccgggttcaagtgattctcctgccttagcctcctgagtagctgggattacagatgcccaccaccacgcccagctaatttttgtatttttaatagaaacagggtttcaccatgttggccaggctggtctcgaactcctgacctcaggtgatccacaccctaccttggcctcccaaagtgctgggattcaggcatgagccaccgtgcccagcctcgttgttttcaatttcatgtatgaaaacatacagtatttctctttttgtgcctcacttatttcacttagcatgatgtattccaattccatccatgttgtttcaagtgacaaaatttctatctttttaaaggctgaatagtattctgtattgtctacataccacattttctttatccatttatctgttggtggacacaggttgattgcataacttggctgttgtaaatagagctgcaatgaacatggaagtgcagatatctccttgatatactgatttcaaatctttttggtaaatacccagaagtgggattgctggagcatataataattctatttttagttttttgaggaagctccatactgccttctgtaatggctgtactaatttacattcccaccaacagtaagcaagggttcccttttctccatatcctcaccaacacttgttatcgtgcatctttttgataatggccattctgataggtatgagatgatatctcattgtggttttaatttgcacttccctaatgattcgtgatgttgagtttttttttttcaaatatctgttgaccatttgtgtgtcttctactgagaaatgtctactcaggtcccttgcccattttgtaatcagattattttttctctttgaatagaattatttgagttccttatatattttagatattaaccccttatcagatgtatggtatgcaaatattttctcccagtctgtagcttattgcttcactctgttgtttcctttgttgtgcagaaactttttttttttttttttgagatgaaatttcactcttgttgcctaggctggagtgtaatggcatgatcttgactcacggcaacctccacctcctgggttcaagtgattctcctgcctcagcctcctgagtagctgggattaccggtgcatgccaccatgcccagctaattttgtatttttagtagagatggggtttctccatgttgatcaggctggtcttgaactcccgacctcaggttccgcagaaacttcttatgttgatataattccatttgtctatttttgcttttgttttttgcactttaggggtcaaattttaaaaaatgttgcccagataaatgttgtgtagttttagcccctgtgttttcttctagcagtttaatagtttaaggtcatatatttaagtctttaatccattttgagttgatttttgtatatggtgtaagataagggtccagtttcattcttgtgcatatggatatccagctttcctaacaccatttattgtggagacttttttttcccactgtgtattcttggcacttttggcaaaaatcaattgaccatagctatgtggattcatttataggctctgtattttgttccattggtcaatatgtccatttttatacccgtgccatgctgttttaattattattgctttgtagtatagtttgaaatcaggtagtgtgatgcctccagcattgtactttttgatcatgattgccttggctatttgtgtttttttttttttttttttatggttgcatatgaattttaggattgttttctctatttctatgaaaaatgatattggaattttgatagtgattacattgagcctatagattgctttggatagtatggacattttaacaatattagttcttccaagtcatgaacatttattttcatgcatttgtgtctctttccgttttatttgtctcttctgttttgttcattagtgttttacggtttttaacatacaggtctttcacttccttagttaaatttactaatttttttttgtcattgctcttaataggtttgttttcttaatgtctgtttcatatagttcattattaatatatagaaatgctactgattttcatatgttgattttgtatcccacaaccttactgaatttgtttacaaatttctaacagttttttggtggagtcttcagggttttctatacagaagatcatgtcatcggcaaatagacaattttacttcttccttttctatttgaatacctaataattcttttctttttcttgcctaattgctctggctaggacttccagtaccatgttgaaaagaggtggtgagagtgagcatccttgtgttgttcctgatattaaaggaaaagctttcagcttttcactgctgagtatgatattagctgtaagcttgtcatataaggctttttttgtgttgatacattccctttacacctaatttgattagagtttttatcatgaaagaatgttgtgttttgtcaaatgctttttctacatctaatgaggtgatcatattgtttttgtcctgcattttgttaatatggtatatcacatttattgattttcatatgttgaaccatctttgcatcccaggaacaaattccattttatcatggtcaatgattcttttaatgagctattgaatttggtctactggtattttattgaagatttttgcatctgtgtttattagagatattggcctataattttcttttcttacagtgttctattctggctttggtatcaaggtaatgcaagccttgtaaaataagtttggaagtagtccctcctctgtaatttatttgggaaagtttagaaaggattggttttagttcttgtttaaatgttttgctgaattcagcagtgaagccttctgggtcctgggtgtttctttgataggagacttttcattactgattcaatatccttaatcattattggtctgttcggattttccatttcttcatgattcagtattggtaggttgtatgtgtctagaaatttatccatttcttccgggtggttcaatcctttggcatataattgttcataatattttcatatgatcctttgcatttctgtggtatgcattgtaatgtgtctcatttttttttttatttgagacagagtctccctctgttgcccaggctggagtgcagtgtgacaatctcagcttactgccactttcacctcccaggttcaagtgatttttgtgccccagccacccaagtagctgggattacagatgcacacctccatgcctggctttttttttttttttttttttttgtattttattagggacgaggttttgccatgttggccaggctggtctccaactcctggcctcaagtgatccatccgtctcggcctcccaaaatgctgggattataggcatgagccactgcacctggcctcctcattcatttttgatttaatttatttgtcttctttcttttttcttagttagtctagttaaagtttagtgatttcatttattttttcaaaaaactaacagaattttgataatcttttgtatttttttcagtctctatttatttttgctctgatttttattatttcttttgttctgctaactgtgggcttagtgtatcttttcttctatttccttgaggtacaacattaagtcttgtatttgagatctttcttcttttttgatgtaggcgtttattgccatttcctcttaaaactgcttttgctgcatcccatacatttggttatgttatgtttccatttcattttctaatatactcttaaaattcccttttgatttcctctttgacacattggctattcaggagcttgttaccattcaagttctttgttcatttcttaatcacattgttggctttttgttgttgttgttgagttggagttttttatatattttagatattaaccttttatcagatatacaactagcaaatgttttcctcttcctgtgggttgccccttcactgttgatcatcattggatgcacaaaagtttttaatttttacatagtgcaatttatctactttttttcctatattgcttgtgttttggggatcacattcaagaaatcattgccaaatccaaggtcaggaagaatagttcctatgttttcttctaagttttagggttttcacttttatgttagattttggatccattttgagttaatttttgtatacgtgtaagttaaaggtccgaggtcattgttttgtgatgagtcaatgtctagatttcccaagaccatttttaaaaagattgtcctctcaattaaatggtctttatacctttgccaaaaattacttgatcatatacagtcatgcaccacataacaacatttctgtcaacaacagactgcatatgtgatggtggctccatgcaattatgtaacatgctacacaggtttgtagcctaggagcaaaaggctataccatataggccaggtgtgtcataggatacaccatctaggtttgtgtaagtacactcttctgatgttcacacaacacaattgcctaatgaccctttgctcagaacaatgttgagcaatacatggttgtacgtgcaagttcatttctgggctctctggtctatatgtcaggcaccttttaaatcagaagttcactatttaatgtttgatcctgtatcccaattttttaagtttgctatattataacccccatttataaaaatgtgtgtctgtgtgtatgtctgtgtgagagagaataagagaaagagagaaagagagaataggcatacctatggaaaaatagtggaactaaatgagacaaaatattaatggatgctatctttagctgagaatatcacgtgtggtctgtgtattcttgtaaaaactttccttgcccacattttctggaatgaacatgtttagaagagttttgcaggtgtatgttacttggccttccctgaaatatgaagggacaaacaaacactaaaggatgtttgagaggtgagagctgcaagaaagatgagggttctgtttagcttgggtgcctgggctcaagagaatgtgagtggatcctgggaggggtgaggtctggaagccactcatgcccatccctgctttgtccccacaggtctcagctgagtctgctctgatcacccaacaagacctagctccccagcagagagcggccccacaacaaaagaggtccagcccctcagagggattgtgtccacctggtatgttcaagatgggtctctaatccttgcccctcctccccttgtctccatgagcttccagtctgtttcctttgcacttccttgttctttattccacagagaggcattgggtgcctccagttcaaggctctgtccttctggagccttcctgctaggatggtatcaagacacacaaatgaatgagacagccaaagaaactgataggaaccttgagagagaattgagtgggacagagatggggctggtgaggcctccaggcaatggtgactttgggctgacatccggaggagggcagggccagaggttcagagagccaggaagagtgctcctaggagggttccactggaacaattgccagggggcaagagttggagaagatggagcaacagcagggggctgctgtggggagtggagggttaggaagttagagagacacgtggggtcagatcccacacagatgaagctggattttatttcatgagtgatggatgtccctgagaagttttcagcagagggccaccagcatcggatgtacatcttgagtgcccactcctggactgaaccggagcaagacaggaagcaggtggagggccttgagtgtgaggcgctcccctgggatgttatgtggtgtcccgtaaggtcatttgagcccccagagatgcagcaggaacctggcctgaagtgtgcttgactgttgtgttcgcctcgcacttcttcccccttttcccccatgtgtatgagttaggaattgattgctgcatgaaggtttccagggcaggcaagtgtggcaagcagtggcttttaaaatccatttacaaagttgcatttcttttccatgactaagggccacaggaaaggcttgcctgagggcaaaccctcacattgcacatgtgggcttgccaggagcagagcatggagaaggaagaacccagcgtgaagcagacacaaactcatctgtaaatgctcctattgctgtggtccagggtcaagaccaggaagcaggacgggaataggaaggactcaagacatatttggggtgtggatggatgacgtgtggggaatgaggacaatcgaggcaccaaattcaactgctcagggtaacttggcctctgaggggacagtgtgtggcagggctagcagtacacatttggggaccctagcacataggtgatgcttgaagccgctgtcttgagtgtgtccacctggaagaagttgtaaatactgaggaggggcacaactgagcccatgaggatttgaagttggagacgataggccagggagacaggactgcaatgggctgagcaggagcagttggagaacttccatcctagaggagagatggcccttccagccacagggagcaggccatagcaagtgtcaaggactgagatgtggaaactcctcgaaatgtgcatttctcttcctgtgaatgaggtcaagaatctgttcatgacacagacactgtttgtacactggttctcctaggttttcttcactcctagtaagaggttaggttttttttttttttttttttaaatcattgagtcacatgaattcttacagattagggaaattatacattgattgattgattgattgactgattgagataggatttcactctgttgcccaggctggagtgcggtggcaggatcatagctcactgtagcctcaaccacttgggctcaagcgatcctctcacctcggccttccaaagtgttgggattacaggcgtgagccactgcgctgggtccaaaattctaataaaaattcccatataacgccgggcgcagtgactcacacctgtaatcccagcacttcgagaggccaaggtgggcaaatcacttgaggccaggagtttgacaccagcctgaccaacatggcgaaaccctgtttctactaaaaatacaaacattagctgggtatagtggcgtgcctgtagtcccagctacttgggaggctgaggcaggagaatcgcttgaacccgggaggcagaggttgcagtgagctgagatcacgccattgcacttcagcctgggtgacagagtgagaccctgtctcaaaaaaaaaaaacaacaaaaaaaaaattatcatatatctttgcagtcattttgtggtttcctattttgtaattaagtcattgagccacatggacttcattttgtagtaagaggagagtgaggaagacacattattatttgacagccacctttttggttgccccaacactattattaaataatcacgtttttatcagtgacatgaatcactatgattatgtatgatacttacattattaagtaaggtttgtgtaatttggattttttagaatgtctttcaatattaataaaaataattcaggaatcttgtggctagcatataggtgattatggtctattttttgcgtttgtttttactcattctgccactctctgccttttaattgcagagtttaaactattttcaattaacatagttattgacaagaaaagatttgtttctgctcttcagttatttgttttctttatgtcttatatatattttgttcctcccttatcaccttttgaaaaaactttagtttatttcttggcatgtaccattttcactcacttcttttcttttctgcatattttaaaatatattttctgtttttcttaaatatatattttgtgtatatatatttaataaatatatattttgtatatatatatttaataaatatatattttgtatatatatttaataaatatatattttgtatatatatttattaaatatatattttgtatatatttaataaatatatattttgtatatatatttattaaatatatattatatatatttaataaatatatattatatatatatttaataaatatatatttaaatatatacttagtatatatcttaaagatacatatcttaaatatatatatagatatatatatattttttgagacagggtctgctctgtcacccaggctggagtgcagtggtgcgatctcagctcactgcagcctatggctgctgggtttaagcgattttcctgcctcagcctcctgagtacagggagtagccaccatgcctggataatttttgatttttagcagagacagggttttaccatgttggtcaggctgtctcaaactcctgacctcaagtgatccacctgcctcggcctcccaaagtgttgggattacaggtatgagccacgcacctagcctaaaacttattttcttactggtttccttgaagattacaattaccttcttaagtatctaaacaggtagttttataataccggcagaatttcattgcaatccaaatactgtgctcctgtaccactccatctctccagctttctattgttgctgtcatagatcacatccttgcacgttgtgtgaccactgacgtcgatcttaaggacatgtatgtgtatggagcaaggttgacttgtgatggttgattttatgtgtcaacttggttacccagatacttggccaaatattatcctagatgtttctgtgaaggtgtgtttgttgttgttgttttgttgttggttttagatgggattaacatttaaatcagtgggctttgagtcaagcagattacccccttaatgttggcaggtcccatctaatcagttgaaagcctcaatagaaaaaagactgacctccaccaagaaagagggtgttctgccagcaggcagccttcagacctgagctgtgactcttctctgctggcctatcctgtaccttttgaatttgccagcctccacagttatgtgaaccaattccttaagataaatctttatctctctagagcaggggcccctgacccccaggccatggaccagtactggtccgtggcctgttaggaaccaggccacacagcaggaggtgggctgtagatgagtgagcattactgcccgagctctgcatgccgtcaaatcagcggcagcattagacttcataggagcgtgaaccctattgtgaactccacatttgagagatctaggttgcgcactccttatgagaatctaatgcctgatgatctgtcactgtctcccatcacccccagataggaccatctagttgcaggaaaataaactcagggcttccactgattctacgttatagtgagttgtataattatttcattatatgttaccatataatagtgatagaaataaagtgcacaataaatgtaacatgcttgaatcatcctgaaaccatccccatgcccccaactccagtccgtggaaaaattgtctttcaggaaaccagtccctggtggcaaaaatgttggagacccctgctctagagagccctgactaatacagaatttttaaagatttgaaattcttttaaaccatacttgatctccaagtaatggaaataataagattatatttccacctaacataatacagctatcctgtatacaactgaaaacgcactaaccctttctccagaagaggatgcaaagttcttgagtggtgtttactcctttccttgataccctggaacataaatactataaagtgaacaatacttaaatactatgatataaattcaaaatatcttgtgttacataacaaggggataagagaaggaagaaaacacagatattcgcttaacatatatttacacataaacacacacacataacacaataaggaagaaatacttataatgattacagtccttatttccatagctggtcatgtcattgtagctggtatttataagaagcttctttcgctgtgcattctgtattccctgtgccctcactaagcacctcagctggtcatggctctgtgcctggtagagtgaactaacctttattcctgaagggtctgagctataagtggtcctgctttaatagggtcgtggtagttttccattgactttactcacagggcatggtaatactaagagatgccctaaggaatctcctgtattctagacatcctcttccttacgtccattgtggaataacagtccaattttcccttcaatttcccctttgtgttcagaatcagtcaatccagccagcagggtttgtgtaactggttttcgcctgttgattcagaggcatgaggaacccaaagtggccaagtggcagtcttcaagttacacagaatcactgttgtgtctcctcatggaatcattcctccctctgaaactcagagctctagcaaagcataaagcagcaaaaattttgataacaggccactaagggtaatgtggagtggggccattcctgcttccacccctagattcctggacacatgaatcctagcaatggaagaagcaaccgcatgtattggaggataattcagagcatagacagtctcctggagaaccttgttgcagcccttcaaggtactgccacccagctgacattgtaaatgagttttcaaaaagccatatcccaccatcttaccaagccagcagttttgagatggtggggaacatggtaagaccagtaattccatgagcacaggcccattatagtgggcgcttcatttgccatcaagtgagtccctcaatcagaagcaatgctgtgtgaataccatgactgtggataaggcattctgtgagtccacagaggatagttttgacagaagcattgcatgcagggaaggcaagtctatgtgcaaaataagcttctcttccagtaaaaatgctgccccctccatgatagaaatggttcagtgtaataatcaacctgccaccaggtagctggcagactgaccctctgaatggtgctatatcagagactcagtgttggactctgctgcctatagattgggcactcagtagcagctgtagccaggttggccttggtgagggaagtctgtattgttaagcccatacataacctccatccctgccaccatgcacactttgttcatgagcccattgagtgatgacaaggatggctgggaaagaagctgactggtagtcacagaacaggtcatcctatccacctgattattaaaatccttccctgctaagatcactttttgtgaagatatttgtgtcacatggggcacaaatatcttcatggtttttttacccattgagaaaggtctatccacacacctcttccccagacttccttgttatcagttttccttcagagcctctgaccctccagccaaatcattgaccacagctcatgaatcagtatataactacatgtctagccattcttccctcaagcaaaatgaacaaccaggtgtactgctcagagttctgcccagtggcaggatctcttttttttgagacggagtttcgctattgttgcccgggctagagtgcaatggggcgacctcggctcactacaacctctgcctcccgggttcaagtgattcccctgcctcagcctcccaagtaactgggattacaggcatgtgccaccatgctcggtaattttgtatttttagtagagacgaggtttcaccatgttggtcaggccagtctcgaactcctgacctcaggtgatccactcacctcggcctcccaaagtgctgggattacaggtgtgagccaccacacccggcctagcggatttcttttcaccactgtccttcagggacgtcccagacagtggatgtgatgctgcaaacatccacttctaagggttacctgtatgtggtgcagaaccatctgtaaaccttcttctggcaactgaccatagggaattcctcatgaggccataagtgcaggccaggcaaaagaaagtaatattgcaggagtggggatcatgggcacttgggccacttcttcatgtaactttcttgtgccttcagggcctatttaagcccaattttgtatatataccaattacatttgaaaatggaaatggaaactttaggctgtatgtgcccaaacttatggcttggtaggcaaaataacactcagttcacgatgagcagtcaggtcgtagagtaatttggtggcctatggttaaccattcagtctgcactaaggcccagaaacaagccaagagctgtttctcaaaaggagagtagttatctgcagaggatggcaagtctttgctccaaaacctaagggcctgtgctgtggttgacctagagtgggctactaaaggttcaaaacagcattgctgtctgccaccaatacttcaagcaccgttgggtctgctgggtcgtatggcccaagtgacagaaaaatgtctacggcagcctggacctgttgcagagccttttcttgttctgagcaccactcaaaactagcacatttttaggtgacttgataaataggccagagaaacacacccaaatgaggaatatgttgccaccaaaatcaaaataagcacactaggcattgtgtcattttcttggttgtagggaggtgggggtggcagatacaacaatttatcttttatcttagaatatcttagaagagaaggaatatcttatgtgccacatcattcaacaactaggaatttgtttcccagttgttgtccttctactgaggtaaaaggcccttgaaattttgtcagatttatttcccaccccctgacatgcaaatgtcttaccattaagtctagaatagttgctacttcttgctcgtgaggttcaatcagtataatgtcatcagtataatggatcgtcttgtgtgttatcttgtggaagggaaaggccatcaatatccctgcaggccagatgtggtggctcgcgcctgtaatcccagcagtttgagaggccaaggtggctgggtcacttgagaccaggagttctagaccagcctggccaacatggtgaaacctcatctctactaaaaatacaaaaattagttggatgtggtggcacacatgggtaatcccagctacttgggaggctgaggcatgagaatcgcttgaacccaggaggtgcaggttgcagtgagctgagatcatgccactgcactccagcctgagagacagagcaagactctgtttaattaaaaaaaaaaaaatacctgcaaactaaattatgacatagggctgcgagttgatgcatcccggagacaggatagtgagggtatattgctggccttgccaactgaaagcaaactgcttctgggagtctttattgacaggtatgaccaacaaagcatttgccagttcaacacctgcataccagggtaccagggatgtggcgatttgctcaaacaatgaaaccatatctgggacagttataactggaatcaccacctggttaagcgtatgataatccactgtcattcaccaagatccatctgtctttggcacaggccaaatagtcaagttcaatgggcatgtgatgggaatcaccacagatgcatcctggatggtggtaatgatctctgcaatccctccaggaatgttgtattgcttttgtttttttgtgctttacaggcagggtatcactctgtcacccaggctggagtgcagtggcacaatcatagcacactgcagcttgaactcctgggctcaggcaatcctcctgcctcagcttcttgagcagctaagactacaggcatgtactgtcatacctggataattttgtatgtgtgtgtacagatggagtctcactgtgttgcccaggctggtcttaaacccctggcctcaagtaatcctcctgccctgacctcccaatgtgctggaattacagacatgagccaccatgcccatctggtattgcttttgatttactattttttttaagtaaatgcaaatctggtggcttccacctggtcttttccaccataatagtcttcacttcacatgtcagggaatgaaggtggggattgtgccagctgctgagtatgtctattccaattacacatactaaaatgaggaaatcagacaggatgggtgtggggacccactggcccctttctgagatggacttgagcttagtttgagtaatgacaacataacttcaatggtatgcaaacactgtgctcctgtacttctccgtctttcctcctccatcttgttgttatagatcacatccttgtacattgtgtgcccattaacatcaatttgtaattattgttttctgcatttgctctttaaatcatataagtaaataagaggatttacaaaccaaatgtaccataatactgtgctacagactgaattgtgtccccaaaatcatatgttgaagcattaccatccaatgagatggtatttggagatggtgcctttgggaagtaattgggtttagatgaggtcatgagggtggggccctcatgatgggattagtgcctttttaagaaaagacccagacaacttgctctctctcgcttgctcgctctctctctccccccctcttctggtgtgtgcaaggaagaggttacgcaaatgcacagcaagatggtggccatctctagaactatgataaataaatgtctattgtttaagccacttggtctatggtattttattatagcagcctaagtagctgcgtaccagcatttatatttacctaaatagttaccttttccagggttcttttttttttttttttttttttttttttttttttttgagacggagtctcgctgtcgcccaggctggagtgcagtggcgtaatctcggctcactgcaggctccggcccctgggtttcacgccattctcctgcctcagcctcccgagtagctgggactacaggcgcccgccacctcgcccggctaatttttttttgtatttttagtagagacggggtttcaccgtgttagccaggatggtctcgatctcctgacctcgtgatccgcccgcctcggcctcccagagtgctgggattacaggcgtgagccaccgcacccggcctccagtgttctttatctcttcgtatgcctttgagctattatctaatgtcattacattacctcctaaaggattccttttagcatttcacagggcagatctactagtaatgtgctccattacctttcatttatctaagaaggtcttaatttcttcttcattcttgaatgataatgttcctggatatcaaattcttggttgcaggattttgtatgcttgtgtttttgtttcttggcactttaaatatgttacccactcccttctgggctctatggttcctggtgagaaattagctaataaccttattgaggttcccttgtacatactgagtgggccacttgctactttcaggattttctgttggtgttgggcttttgtccatttgactataatgtgtctcagtgtagttctcttttaacttatcctgcttggagatcattgagtttcttggatgtgcagacaaatgttttttaaaagtcttgcacctccttgttaaatatcattcctaaatgttttattcatttttatgtcattgtcaatgaaattgttttcttaatttcctttttggattgttctttgctactgcaaaacttttacgctgaaaactatcaaacattgctgtaagaaattttaaaaaagcaaaataaacaggaagatattccatgttcatagatcaaaatggtgttaaattacccaaagcaatatacagattcaatgaaatccctaccaaaatctcagtggtgttattttaaaaatggaagaacttatattcaaagtcgtatggaattaaaaagacttattgaccaaaaacaatctggtaaaagaaaagcagagttggcgggactcacactttccaattttgaaacatatcctcattccagggcagctttagtccccttttctttggatcattctttgactctatagagattcctcccgttttcttcccatggctgatggtgtgagctttaattttgaaggcttttcccattgttgtatgacttctgctcctggtgtatcttccactggctaggagctcattcagaacaggtattaggacattcttctgtgcattttaaaggtctaagatggcactgtctaatatagtagtccctaggcccatgtgattgccaatcacttgaaatatgtgaggcaggtggatcacgaggtctggagttcgagaacagcctggccaagatggtgaaaccccgtctctactaaaaacacaaaaattagccgggtgcggtggtgggtgcctgtaatcccagttactcgggaggctgaggcaggagaatcacttgaacccaggaggcagaggttgcagtgagccgagatcgctgcactctagcctgggcaacagagcaagactccgtctcaaaaaaaaaaaaaaaaatgctactgcaaattgagatgtgccatgagttaaaatatacgcaggatttgaagacgtactgtgaaaaaaatgctgtaaaatatctcaatgttttatgtggattacatatttaagtgatattatctggggtacattaaattaaaatgcattattaacattaatttcaccccttctcaccttttttaatgtgctgagtgtggatttaaatttcatatgtgggctgggcacagtggctgacacctgtattcctagcaccttgggagtccaaggagagtgaatcacttgagcccaggagtttgagaccagcctaggcaacatggtgaaacctcgtctctacaaaaaaaaagtacactaaaaattaacccggtgtggtggtgtgcacctgtagtcccagctatttgtgggtcggggggagagggagggtccgggaggtcgagggtgcagtgagctgagatcacaccactgcactccagcctgggctatagagcaagaccctgtctaaataaataaataaataaataaataaataaataaataggccgggtgcagtggctcacgcctgtaatcccagcactttgggaggcctaggcaggcagatcatgaggtcaggagatcgagactagcctggccaatacggtgaaaccctgtctctactaaaaaaatacaaaaattagccaggtgtggtagtgtgtgcctgtaatcccagctactcaggaggctgagccaggagaatctcttgaacccaggaggcggaggttgcagtgagccgagatcacgccactgcactccagcctgggtgacagagtgagactacgtctcaaaaataaaaaataaaataaataaatgtgtggcttatatttcttttggcagtgctggtttaaggtgtgtaaatgcagaattgatgaactgaccaagctaggtagaggagatttccctcttttggttccacacatccctgaaagaggagtcccccagccaccactgccagcttctgggaatcctgtggcatttcattcaccggcttttctctcccctcccaggacaccatatctcagaagacggtagagattgcatctcctgcaaatatggacaggactatagcactcactggaatgacctccttttctgcttgcgctgcaccaggtgtgattcaggtacagaacatatggaccccatgcctaaaggtggaatgcggggtgatgacataaaagttgtagctaaaatgggatcaggagacctagattctggtccaccttggtcttcatcataccatgttccatgattttgtctttgagctttttaataaataaaacaggcccggcacagtggctcatgcctgtaatctcaacactttgggaggcatcacttgagcccaggagtttgaaaccatcctgggcaacatgagaaaccccgtctctacaaaaatataaacattagccgggcatggtggcgcgtgcctgtatttccagctacttaggaagctgaggcagaaggatctcttgagcccaggaggccgaggttgcagggagccgagattgtgccactgcattccagcccaggcaacagagcaaaaccctgtctcaataattaattaaaataataataatacagaaattatttgtataatgtatgctacatggtaaggaaatcttttaaactgtcagctgcaagggggtggggccatgagccaggccaagtggacagggctggatctcagcagtggcacaggtctgctttggggccaggctctctcccctgggctctgtgctcctggcaggtgctcggcctcactcacccttcaggttctcaggcctctccctcctccccagcaggctgggccttggggaagtcccccaagggctcctctccttgcagtctctcaggtgatcccttgcacttcccttgctactggccatgcaatctaaacgatgcttgtcccctaaacggtgctttcccctaatctaatgtaataaataatgaactgtggtccttttgtatgactcaacgagtgttagtgacagctgaagggtgggtatcctgaatgagccatgagtgtgctggtgcagaaactggccctcagaactccttggcaaactgagttgagctgagtagcagggtcttggggtggggaggaagggtcaagggacacatcaggaaaacacattcccaaaaccttatgctctgtcgtcaggtgaagtggagctaagtccctgcaccacgaccagaaacacagtgtgtcagtgcgaagaaggcaccttccgggaagaagattctcctgagatgtgccggaagtgccgcacagggtgagacaggagccgggggctcccagtagctccatggaaccccaaaagacccaagtctccttgtacccctgtctctcccctgacagcacccgcaaggggcatccttgaggctgtggctgcccctcctggtccctctgcgtgtcaccacccctgccccctgcagcagcctctttccacccctccccagcacgagtccccttgaccaggctgacttgttcactgaccacagaaggccatgacttggggcccatgataattttaggggcccatgaaatgatttaatttctcttgaaataagaagaatgagtagaatgcagccaggcatatattcatctttataccaattcagcaataaaatgtattttttaatatttttatgcatgcaggggcccataaagacaaaagtgcccatggcccacaaaaggcataataaggccatgggtggagctccttcaagttcccatgaggacctgagcccacccagccggcctcacccctggcccctgatccctcagtaagacctgtcttttccctatttgggttttaggggccaagagtaatttgctcttctctggcccccctagtatttgctgtgattgggggaaatgggcagacagctggggacaagagctcacttttgtggttgactggaagaccggactcatcttgtggccacacgggcttgtgaccttcccctggagtgtgattgctcctaacgcaggcctcccctgcagcccagggaagctcagtgtgtgcccagcacagaaggctcctggaactgcagctctgaccccagagcagggaggccgaggggctgaagtgcgcatgctcagacccttccccagcctcaagaagggagcacagggggacccactgctgacacgaggagactgtccttcccctgacaccttctcagggacactggggagggagggtggctcctctttcatcccacctggccagctttccatcaagagtcccccctctccctctgtgtgtgtacccaggtgtcccagagggatggtcaaggtcggtgattgtacaccctggagtgacatcgaatgtgtccacaaagaatcaggtacaaagcacagtggggaagtcccagctgtggaggagacggtgacctccagcccagggactcctgcctctccctgttctctctcaggcatcatcataggagtcacagttgcagccgtagtcttgattgtggctgtgtttgtttgcaagtctttactgtggaagaaagtccttccttacctgaaaggcatctgctcaggtaggtgctggctgagggcgggggcacagggcactctctgccctgccccctcccaccctattcccacagacagaaacgcctgcccctgccccaagtctaagtgcctccagcctggctctatcctcctcctcgtggtcacccccatccccacatcccgtgcaccccccaggaccctggtctcttcagtccctctcccaggtctgggggtccccatatctcccagccaagtccaggagggcagggccagttcctcccatcttcaggcccagccaggcagggggcagtcggctcctcaactgggtgacaagggtgaggatgagaagtggtcgtgggattttttcagccttggtcagagcagaaccagagattttccaagtgtttgtttttactctagttccccttctcatcccccttcctcagggtgtctctgagttgtaaggccccattctgtccccagccccagggctccttgtccagtgtcccagcccccagcccagccctgcgccccactgtcctctgggaggggggtgcttcatgggcccctcccttcctgctaaggagactgcttcttttttaggtggtggtggggaccctgagcgtgtggacagagtgagttgatttctccaggagctgggggctcaggggttcaggaactgcttcctgggacagcagaacctgggtgggtgggtccccattgtcctcatggctgccctgactctctgaagtggcctgggtgctctgggctgactgtgggggacacatggccattttgagcaccacataggctggtgagccctgctgcagcccaggtgacatcctcaccccacagcctgcaccctagggatggggtgtctgcctgagcacagcactgggggcctggccccagcagcgggtcctggatgtgctgagtctgggctgcctgcggtgacctcactgagagggggtggggatgtcaggtgcagctgcatactgaggaccctgcagcgagccctaggtgtggactcctgagtcggctttttgccttcccaatgtctttttccagagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggtgagtgggggacagatcattttgtttcctggcatgctgctcacctgggatttcgtagacagtgggagagggcagtgccttagctctcctggcccaggggaaatggaacctgaaggagccaggggactgcaggggatggagcagctgcactgaggtggtgaccgtgccagtctgcaggacatctgcttcttactccctgtcctgtccttgctgtgtcccccgagcctggagctccacaggcatagagtgggggtcacagggttcattgatgagtgaataaggctgcacagtctccatcgtatgctcctaacagaagtcagtgagcccttgcttgtaacagcaggagttttaaatttactctgaaattgttattacattgaacatatttcaaagttcgtagggcagcttccaaaaagtaggattccaagtcgatgcacaaagggcttttgtattggacacacgcacacaatcagttcatatcaatccatcagttttgatgtgatattgagtaggcaggaaatctgtatatacatttattgttcattgctcgtaagcactgaaagtccttccctcgaacataagatgagactatccagtttcctgcagtgttttatttttaatgatttgatttttaacatacagcaatataatctaaacagaattgaattttcgattcaatataagctgagaaactccctgaattattctgagtctctgtttccttcttccaagcccatttagcaaccaattcttcctttttcccttgcctttgcccttttgccacctcctttgctacatgtcaaatgtttacttttttctctcttcctcttcactcttttttaaaaaaacaaacaaacaaaaaaaaactagatcttatccttgaaaatgtcaaatgtttatatgggcagagatctcttccacctagactgtttctgtttcttccttgcatctgtaccactttctttttaaataaagagaagagattttaaaaggaaacaaatgaacaatgccaatacttcctccatgcttattaatgactttgaagatttttttttttgagacaggatcttgctctatcacctgggctggagtgcagtggcaccatcttggctcattgcaacccctgcctcctgggctcatgtcatcctctcacctcagcttcctgagtagctggaactataggcatgtgccaccgtgcccagctaagttttgtattttttgtagagacgaggtttggtcatgttgcctaggctggtctcgaactcctgaactcaggcaatccaccctccttggcctcccaaaatgctgggattacaagcatgagccaccatgcctggcctgatcattttttgaaagcaggtcacccatagccacacatccaccagagtatgaaaaaacttgatcataccaagagccttctttactctttcccagccttttggcccttcttatttcaggtaactacagtggataatttcttgtgattctttgctaaactctttatgcatataccatctaggtacataaatgcatatgtatttatgtggtattgacatgaaaaggattatatcatgtacaacaccaaacaaaactgtctaatatgttttaatatcttagacagcaaatatgttttcaaaattatttttacacatcttataatttagaattagataaaatttagaattataagattttctctagtacccctcccgcccacatagtcactagactttacaaatattaatttaaattaatacatggttctaggaatgattgacatcctttcaacattcaattttattatcaaagaagataatatttcaagtcaagtgttctattatgactcaatcgagatttgggagtttatttcagataaatttttcctattcctcatcaaagctgtttctttgcattttgggtcttcttgtaagtccattttctaatttattatgtctgctgctacttttcttttctttctttctgagatgggtctcactcttgtcacccaggctggagtgcagtggtacaatcatggctcactgcagccttgaccttctaaggccaagtaagctcggacttaccggcttctgagtagctcggacgacagttttgtgccactacacccagcttattttattttattttattttatttttagaaacaggatctcgctatgtcgcctaggctggtctcaaactcctgggctcaagcagtcttcacacctcagcctcccagagtgctgggattacaggtgtgagccaccatgcctggcctctgctatgtggtttaacattcatcagggctaggtgcagtggctcacgcctgtaatcccagcactttgggaggccgaggcggatggatcatctgaggtaaggagtttgagactagcctggccaacatggtgaaaccctgtctctactaaaaatataaaaatacgataaaataattagctgggcatggtggtgcacacctgtaatcccagctacttgggaggctgaggcaggagaatctcttgaacccagaggtggaggttgcagtgagccaagatcgcactattgcactccagcctgggagacggagtgagactctgtctcgaaaaaaaaaaaaatcatcaagacatattcacttttgagtattacaaattaaaccttggggttttaaaaatatacactcctaatctaaaatattgactgctgtatcggcctccttccgagagtcttgcccctttgtctcctgtcttgttgccagacctttcagaacaatgttctggaagtgacgtgctgcaggtctcagagctggctggtggtcggggtcagtactggactgtaggactcctggctctgaccaggacattccccactatgtgttacaggaaccggcagaagctgaaaggtctcagaggaggaggctgctggttccagcaaatgaaggtgatcccactgagagtaagtgttttgctcctggagatgcagcaggaatggagggaatagggacagggtcctaactgctgtccccagaggtcagagggctcttccagagtattccatgctggaagccgtgggtcctgtgctatagaccatctggaccctaaactgtcttctcccatctcttctccccactctacctcatcctctctgcaccctatcattgaccctaatgactctgtccgtcccctcatcctctctcctcctttgttcagggcctgatgtagcccccgcctgcccctgaggacctcctgaggggctggcctgtcctgcacagcaccactaaccccagtgggctaaggagctcttgacctgtgcctcagcccaatttgcagagctgttgtgtaaactacatacgaatgccaaagacttaatgcaaaaaagagtggaaaatatttcactcataatttttgtatattgattgtatattaaattatattttaaatatattcagtaccatacattaaaatgaatgtcacttgtttctgatgttctttaaaataaggctgttggaaaacatagcctcgtgttcctgaccctgtctatctctgaggacggcgaggtgcatcatgttgcacacacgtctcatttaatccctcatcgtcccgagatctgggcagcattgctcggtctttgggttcacttcttgctcagagtctgtttgcctccacctagctctgccccagccccaggaagtgaggccgagctgggtgaaaacagaggtcccctgtcccaggccctgtgctttccacagatgcagaagtggccgccctgggacctgctcccatgacaagcgcagcccaggcagcctcctccctcctctaagctcccgctgcagccactgtctctccctccctcggactctcacgcactttactttctgcctctgtaacgtccatccatactcccctggtgggttctcagccctgtatgagggctgattctctgacgactttgactccccgcagtgccttgcgtgtgggggaggccaggcagtgtgggcgcgctctctgtggatgggaagcgggtgggcactggagcggcaggtttgcccgcacacggggctctccaggttccccgccttgggttctgggcctgatgtggaatcctctgccctttctgagtcccaactcacctggctgtctctgtggctttctccaccagctctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtcagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttttcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatat

SEQ ID NO: 37194 - DNA, 246826 bp, Homo sapiens
gagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggtgaggagagggctgcaaggcggcggcctggaccacgggcggctgcagcgggggcgggggtcggcgcgggggtctgcgcgatggctgcccggggcatccgtcccgcgcccggcgcttgtctccccggccgcccttagcccctcgccgcgcgcccgagagacggcagcggctgcccctctgccttgtccttcccgtcctcgggggtggcggcggagtggcgggcggacccgcactgggaggccgggggccgcggtgggccgtggggtggcggccgcgggacgggcgtggggatgaatgggcgccgcggccccgccgccgagcgggctccctcctctcgcggggaccccgggcggccgctccttcccgggctgacctcgctgccctcggccgccggcgaggggcggcccggcctcgcctcccgccggcctcccggggacccgcgttggcgggagcggcgccgcctctgcctggagccccggctccttcctcggcccctcgctcgcaagcctgcagaatcctgggtcagtgaagggcaggcaatgccgttcggccccagggcgcgccgcggggccgcccctgaaggcatttaaaggggagcgtcttccgcgccctgtgagcgcgtccccgggtccgccgcgtcccttcccttcttacgcaccgacacggttttgtggtgtggacccaagacacaattgcagtcccttgcttgcacgaatgcaatccgaattcccaaaaaaaggaaaccggcgaggaatcggccgcaccttcctgcgcttctgcttgccttgggattagaaaacaacttcggagattacatttcctatgggcaatcttttgttgtgattcagactcaagaaggctttgctttggaagaaatagattagcggcttctctgtggagttggaggctatagagatttttatagcctcttcaatatgaaagtttcctctagaactttgccatcatcagtgctattctgagggcagcagcaacctggaaatttagatacatgcaggctccggccagatgcgtttctttgtgcttgtctgttggcattcttctcttgctgctcctcttgatcaaaacgtacagataataaaggcaaggccaatgaagagggtagataataacagcaaatcccatacaaacaaatgcctctagaaattctcagttctgtcagcggggaggcagttttgctaatcccgtggaacggatgaaaagaaaggcacagagatctcatggattatgtagtggacaggatgtgagggcaggaactggggccaggacccagcaggccagctggtttgcatggtgccactctaaacccccaaaatatgaataggaggaatgtatttgttgggatacctttatttttagatgactttaaggttgagagtgcagaagcttaaacatccttcatagttattatttcttagtttatctctgagaacaaaatatgtttctgtttaaaatttcttttactggtgtgcttgaaacgttattttgatgggagtttccttgtaagtaaaaacattgaaaaatacatacatatgaaagaaaaatccttagtgcagatgggtttgtaaagaatccagggacttttaagtcatataaattaagaagtgagggacactaatttgatgatggtgttaaaattatttcagacacctttaagtagtccagtggagatcatttctgatagtatgatctttttttaaaaaaatggtatttctttatctaggaatgcttctgttgaaattgctacggcgcatggtaccgtcacaaaactcttttattattctgcctgagtaagagaggaaatgaacaaatttttaatgtactttggaaccctgcggattgcacagatactaagcattgtgaaatagggcataaaatgagtggtagcaagttagttctgtgaaatgtttgtcgctgttagcatttttttttttttttggcagtcgactagcaattttcttttccctaaagcttatcttcaatattggtagtagaacctctgctcaagtttatcttttccccaagtgcctagactgggacaaactatcaagcctcctgtaagagattaaggaggagctgctggtaaattcctttcctttttttttttcttgaggcagggtctggctatgtcacaggctggagtgcagtggcgcaatcttggcatactgcagcctcgacctcctgggctccagtgatcttcccaccccagcttccagagtatctgggatcacagatgcacgccaccatgcccagctaattttaaaattttttctagagacagggtctctctgtgttgctcaggctggtctaaaacgcctaccttaaacgattctcccacctaggcagcctcccaaagagctaggattagaggaatgagccaccatgcttcgtccaaattcctctactctaaattatctttttaatttgctaacatttgtgagttgtagagaattgatgacacgagagttgggattatattatgcacctcaaattcttctgccatagagctgttcccttctgaatgatcacttcctcctgaatggctccacttaactggttgggtttcttaaagtgtgggcctcagatcacttacatcagcattaatggaggcacttgttaaaaatataggttttgggcatggtggatcaaacttgtaatcccaacactttgggaggctgaagtaggaatagcttgggcccaggaatttgagaccagcttgggcaacacagggaaacctggtctctaaaaaaaaattttttttaatattctgggcttagtgactcgtgcctatattcccagcttttctagaggctgaggtgggaggatctggttcgcttgagcccaggagatggaggctgcagtgagccatgattgccctactgcattctagcctgggcgacagagagagcgagcctgtgtccaaaaagtaagtaagtaaataaatacataaaaataaatacgggtttctgtcacctcgcttcagaatcagacagctagaggtggggccctggaattggtgttgttaatgcattctccaggaatttctcctgcatagggaagttggaaaccactggcttccttctctctgagcatctcctgagactagctcctgaagtggatagaaagtttttcaagtagcagattaagttttatcccttaggctgctaataaaaaacaattgactgtgattgcgtaattttacctgtcgtacacctttcagaaggcagaggctttggttcacccctctacctccagggcctaaaacagtgcctggaggaactcaattaaacatttgttgagtgaatacgtgaattacattgcagcgaggccaatcttttaaaagttacttgtcaaattaatctatcagttagtggcatattaaagcccagcatattacaaaaaaattttttttagtagtcactgattttataaattaggagccacaagcactataccccagtgacttctgtaagtttggttagtttagaaaggagagagcctttcccaggcgtagtgtgctcaaggtgattagccagaaagaagattcagaacaaagcatttgcttagagagtcaaaatgtaaatttaagtcacagtgtagtggtaaatcatatatcaaacttatatttggtatattgtcttatatcaaaatatcattttataaaccataagtccaacatactgctataaaaattggtttctagcaaatagagaaaattgttatgttttccaatttcacttttcatactaataaaatttgacctttacaccttcttttcaagagttcaccacagggcaccatagatattatgtagttaagagctcaaactttggagaatattgtgtttgaccacacatagtcagggagtttgatctaacctctcaatgcctcatttctcagctgaacatggaaatagtaataataaagttcacatacttctaagtgcttacctaagtttttgagacacatccacttaataaatggtagttacagtgatgataaagaattggggtgtataaaaatacctaaaactcaaaagctaacccatttaattattgtactactggacttttatgatagtaagtagaaatctgttgcttaaaaaagaagtttctttggtggtgtgcgtctatagtcccagctacttcggaggctgaggtgggagaatcacttgaacccaggagatcaaggctgcagtgagctatgattgtgccactgcactctagcctgggtgacagagcaaggccctgtctcaaaaaaaaaagaaaaaaaaaagtttattgctaactccttggtactatgtataatttttttaattgaatgactagactaaacattgaaagtatttaataagctatcaaatatgtattaatataagttttgaaaataaatactaaatctcctgatctcttttaggttaaaatatagtttatgatgagcaactaatattctttgtatttaaaaagataattgttttatggtagaaaaattgaaatacagaaaagtataaagtagaaaactatgaaatacccgtaagtctactacctgcatacatatttcttcaaatccttttgtgtgtgtgcatatggctattcatatacaatttctggtaacaaaaatgggatcttgctatacatatggttgtaacctgctttttttttgcttaacatcttgtcatgagtgtcttttcctatatatatattgcattataacaattttagtaaccaaataatattccgttttatggatctatggtagttttttttttaatttttattttttcagacggagtctcagtctgttacccaggctggtgtatagtggctcaatcttggctcactgcaacctacgcttcccaggttcaaatgaatctcttgccttagcctcctgattaactgggattacacatgcctgccaccatgcctggctaatgtttgtatttttagtggagatggggtttcgtcatgttggccaggctggtctcatgctcctaacctcaggtgatccacctgcctcagcctcccaaagtgctgggatcacaggcgtgagccaccacacccagtcatggatctctggtggtttagccaatttatttttattagacattagtttgtttatttttcctccacggttacttataaccctgcagtgactgtccttctacatatgtctctgaatgtacttgtgagattattttcattaggataaatttctacaaatggaatttgcaggatcaaagcctatgctaaattttaggattttttaaatccgtatttccaatttgtcatttagaaagattgtatcattttatactcttaccatggtatatcagacttccagtctcccagccccttgtaccttcccccattttatggaatgacttaaccagtgacaaacctagtgaatttttgcttttaggaagaagaatggactgttagtataatgtgtttagtagtgtgatatggaaactcagaaatcttgtgcatgggtaatagtgatagctaatgtcgattaagttcttttgcagcatcttatatacattaactcacttcacaaaaaactctcatcttacagatgccttggaaactagggtaccagcaattagagagccagcaagtgtctgagcagatttttactgtagagtccaaaactcttagcctgtttcctagacatgttttataggcatttgggtactttttatgttctcgattgctgttgtggagtaactaagaggttctctgacatgtactaatatataaactgggtggggcacaaatttgaatccctttcactgaagagttggtcacataagttagctcagaaattagctttgggaccggtgctgtgggtcactcctgtaatcccaatacttgagaggccaaggtgggagcattacttgagcccaggagttccagactggccagggcaacatagcaagaccctacaaaaaattttttaaaaagtagcccagtgaggtgatgcccacctgtagtcctagctactagggaggctgaggtgggaggactgtttgtacccagaagttggaggctgcagatgccacagcactccagactgggcaacatagtgagatcttgtcaaaaaagaaaggggagggcagggcaagagagagagaaaagaaaggagagaaagagaaagagaaggaaggagaaagaaagaggagagagagaaaaattagcctcatcaactgtccagcattcatccttaaagtagtcttgttatcctttactctgtagtggttttcctaaagtacccctgcatgaaaaacaggattagagtgctagagaagactagtgaaatttgaaaaggcagttcacttgtgatgtggacttgtcttagaaacgcaagactgtacagaagtgtgatgagggagacagctgggtgtgtgtgtccaggtagttccatgttggcgagtttggagatagaaagtggcctaaggaagtttacttcctgaatgtgaatgttggccactttggagatagaaagtggcctaaggaagtttgcttcctgaatgtgaaggcctcagtgtagagagatatcatccactgggagatcactgaaaagtaaaccaaaacatttttattaatacatgggatggtagaatgtcactccagttttgttcctaaagttcgtagctctctaagaaagtgaattttaagcaagttaatctattttaatgcatcactgctctttcggtgtttttctagtagaattaatgataggtagcttgctttattagcttactgcccagagagaacattggtgaaattgttttggcttcagctctctggactgagtttggctgcctagctcagttttcagttggtcaccaaaacctgtcattgtttttgtgtggtatggggtctgctggagtcatgtggtagtgcgtttggcccttcattgagtggtggagccaggagttgagctgagggctgtggcagaattttgaattcaagtgaattcgaatgtgaaaataacaatgtctggccgggcgtggtggctcacacctgtaatcccagcactttgagaggccgaggtgtgcggatcatgaggtcaggagtttgagaccagcctggccaacatggtgaaaccccatctctactaaaaaatacaaaaattaggcgggcgtggtggcgcacaagtgtaatcccagctacttgggaggctgaagcaggagaattgcttcaattccctgcttgaacccaggaggtggagatttcagtgagctgacatcgcaccattacactccagccttggcgacagagcgagactctgtctcagaaaaaaaaaaaaaaaagaaagaaagaaaataacaaggtcatagcaacacagcaagtggtcagaattttacccttggtggttaaaattaaacatcctctttttaatacaggaggacaatgctcttgctcctctgttgcactggtgagcatttgatgtgttcctccttgcattatgtctgcaaatcgttctggtgtctggtggcatgcatttgcaagacatggatacagttcatggacgtggacgaggtcagctggcttttagtgtcaggctttaaccaacctagttaagaaggacgctgactcttaccataaaagcactgcaacaagattggaattggagctccaacgaattggagccattcgttttgtgtgtgtgtgtctgtttgcctgtgtgtgtgtacagggttaattacttctctgcaaggcaaatttcctgaccggttttattgttctaacacagacaaaatgttgtgtaaacacatatatcattccagtgtgttatctataataggagtgttcattgtggatccagtgtttcacaaaaatcaattcatttccgctctgaacttaagatagtagattttaaaaccaagttatctttcaatttctgaagttatctgaaactcagctgccccagtcttgcagaattggagaattgcattttggccactgatgaatgaaagctatatagctagtaatgagagaaaccttgaaaaattgacaagaaaatgagtgccattcttggtatatagcagatttcaatgaatagtagttccctttgcctttatttttcctctttcctgcacttaatataaagagctaatattaaagtcattaaatgagaatagatctgtattataggtagcactgcttatttttagaccccttcagatacagttattacaattgttgttttaatattctttaaatgattacaggaggaagaaacttggtagcggggttaccaggatgttagctccatgagggcagggagtgtatcgctgttgtccagggggctagccccaggccctagagcagcgcctgctgcctggcagacacgcaagggttatttgttggtttattaaatcaaggagtgtttgaggtccttcaagcctggaggcccgagggctctgagctggtacagagcaagtgctgggggcaagagagacaggtggggagtgaaggagagaggcccacttgggacttgactctgaatgtctgggaagtaggaagttaatgtaagttttaagcaggggagtcccatgatgtgcttttgtttaaaaatctccttctgagtatcatgtgggagtggattggaggatggatagagaggaacattccattgactcggcttccagctgtctatggatgttgacgtttctacctagccttctgctttatctttgtgatgaggataatgtggtgtactttgtgaggtctcaggaatggtttgagatgaatggtaatttgtgtaaactttccggagtttctctgaggaaaagagaaccccataaaattattactattgatcaaatgaaatagcagtgtaagacaaagatcaagaattatttagctttataaacaaattaattgaggttatgaatataggtttctataggagagattttgtttcctttttttagtgaaagaaatcttaaatgtatgggaatgaatccttaaaatagcaggcttttgcattgtctatagaagctgttctctttgaggaagatctgttttgtaaaatgctgctgttgtctgtccaatctggagttttaattagtatcaaagggagggaaatcctgcagtaatcgtaaccttactttaattcttagttcaattagttttaaaccacagtcattatctgttatctttagttgttttgatcttggtagatgaagtgattaatattacagttgtgatttggtaatttaaaaaataacatgttttttcctactacaaaaggaatacatgtttattgaagaaaacttttggaaacatatataaggaaagaagactaaaagcctaccaagatcttaccatccagtgataatgactgttaataccctgtgaaggtcaacatgctcaaattacccagcaggtgcctggtgtgaagctacttagcccgggagagttgaaggcctgttagggaccacgagcactgaaggtggcaggacggtccagggccagtcaacccagacctttgtggttctgggaggatgcgtcctggtgttactacaccttatagttatttaggagaatgtgggtttaatatgaaatcttctgatttttatgtgggccacactttttattgttaacacactggggttcaaagcatacctgagggctggattcagtcttcgttgccttgccagtttgtagcctcaggtacgtacagttttgtagcctgtgtttttcacttaatgtgttgtatttgcagccttttttgctacatcgtcatatatgtaatcagtcacttattgctggacctatagattctttgtctttttgctttttaataaagataggtaaaattcttggaccaaaagttgtttgtaaagcctttgcagcataccgctctcagatgcattccccctatcatgtaaaaggtacttgtttcctgttctcttaccaggactgggtaaaaccatctccaaaaacatcttagccaattttatttgttttaacttgcattattttctgtattaccaatgagtgtgaatgattattaaatgcctattggccttacacaaatttatttggtaaccaacttgtcttgctggaactctaagttccagcaatgttttggtcttgcattcaatgcttctcagtctttgtgattccagataatattagtactgtgttagtagcaataattagtactaattgtaggcatcgttccccaaaactgagggcatcagtatctttggcacaactataatccacttaaagtactgtgactgggaagttctttttttttttttttttgacagagtcgtgttttgttgcccaggctggagcgcagtggcacagtcttggctcactgcaacctctgcctcccgggttcaagtgattctcctgcctcagcctcctgagtagctgggactgcaggcatgtgccaccatgcccagctaatttttatattttcagtggagacggggtttcgccatgttggccaggctgatctcgaactcctcacttcagatgatctgccctcctcagcctcccaaagtgctgggattacaggcgtgagccaccgcacccagccgtgattgggaagttctgagtttagttagctgttcagtgaatgtttgagtacacgctgtatatgcctggcattgctctaggtgagtagccttgaaccaagatagaatctcagccctctaagacttctatgcttttttaaaaattctcgagtttttcatacagaccatcatgtttataaaggaccattttcattcctagaatttataatttatttttaacttgtatttctttcttttttttcttttttgagacagagtctcgctctgttgcccaggctggagtgcagtggcacgatctcagctcactgcaagctccacctcccgggatcatgccattctcctgcctcagcctcccgagtagctgggactacaggcatcagccaccacgcccagctaattttttgtatttttagtagagacggggtttcaccgtgttagccaagatggcctcgatctcctgacctcgtgatccgcccgtctcggcctcccacagttctggaattacaggcgtgagccactgcgcccggccaatgtctttcttttttttgagatgatgtcttgttatatcgcccaggatggtcttgaactgctgggttccagcagttctcctgtcgcagcctcccaaagtgctgagattataggcatgagccaccataacttgtatttgtttattggcatggaacttctaaaacagtgatgaatgcttgttaccctttaattccttccttctttccttcctctttctctttctttctctctttgtctcttctttctctcttttgtctcactctgtcacccaggctgagtgcagtggcatgaccatgattcactgtatccccaaccttccaggttcaaggaatcctcccacctcagcctcccaagtagctttgactacagccacagccacgcaccaccacacctggctaatttttttttttttttttttggagagacgatctcgctgtgttgcctaggctggtcatgaacttctggactcaagtggacctctcgcctcagcctccccaagtgctgggcttacgggcatgaaccgctgcacctggcctttgattttttaaattcactttaattatcttaagttctgttatactctagactcttagcaagagtctagaatcaacgttagttattagttccgtattttgattatgagacaaggtacaaagctgagactgtgtgatgagaacctttggaatgtatatctgacccaacacagatcccctaagtgcccttcaacctacacatccaatttcttcctacctccttctctacacaaaagacataatacattgaactcgggttgggcacctgaccaacctggcccaatcagtgttcgtttcttccctggaaatttgaaactaggctcaatagagaaggatttggccttaatatgctcaaggaccctaagtaaaggattgggagttataagcagttatgttctgctgtctggggactaagaaagatgatttatggatggggagaataaagtaactgtctaaagagaagcagagagaacactacctgactctctgacagcattaagccactctcttccagtctgttcttggtccagctgcattctcgttcttgagttcttaaggttacctccttccccttgatttaggtagctggagtttctgttactgtgaactaaacattcttctcattcttaccacaatattctttttatgatactaccttgtctctttttttttttcactatgtctagggacgttgtgaatttgttattattttctccatataataacatcaacagttaaggatagcaagaaacatggaagtaccaaaatttaatctaattcaggcaatcacaatttgattggaaaggccattttacaaatgcggactctggctcggacctgttttaaaccggtgtagatctctagctgagggaaaacaggaaggaagaaattttgaagttacttttaaatgttgcagaatttcagtggtgtcatttcctttcacatccatataaaatgttgacctcctgcaaaaaccaatactagggacattcacagtgtacagtattatgtgcatctgtatagggggtgagtctgaattctgttcaagtgtgtagccactgaaacaagattttttttttgtttgaggcagagtcttactctgtcacccaggctggagtgtgcagcggtgcaatcttggctcactgcaatctctacctcctgggttcaaacaatccccccacctcagcccccagagtgggtaggattacaggcaccaccatgcctggctaattttttttttttttttttttggtatttttagtagagatggggtttcgccatgttggctaggctggtcttgaacgcctgacccaaagtgatctgcctgctttgacctcccaaagtgctggaattacaggcgtgagccactgcgaagggccttgaaacaagactctaaagtgtactgtcgaaataccaagaagttgaatcacagaatagtttacctggggctgggcttagttcttagattagctttctgtgtcgtggtgatgtcatgtatcaggaatccttaacttaaaaaaaactcagtgataagtttaagtagtccactatctaaatgcagttgggtggggaggtggaaaaagtgatagggagagaaaaaagaggattgtaggagagagaaggaagaaaaaggaaggttgctttattgccacagttttctttattcataattgtatttgtatgagctttttcatttccaagtggaagaagcacagcattgaaatgtagtgactcacatacctgtcaagtccaaggattctgattggcctggcatgatcgtgtgtctgaacccatcatatgaccaagggaaacgtgtactctcattggctctcctgggccttgggtctaccttttcccccagttggtgagaccagtacctaaactcgtggaattaacagaaagcattaaagagaagtaggatctgtcaagaggagaaaaaaacgctaggcaggcaaaacagatggcctttactcagtgtatgatcagtgtcatacaaattaataattaataattgaagttacttttaaatgttgtagtatttcagtggtgtcatttcctttcacatacatataaaatgttgacctcatgcaaaaaccaatactacagacattcacagtgtacagtgttgtgtgcatctgtatagggggtgagtttgaattctgttcaagtgtgtagccactgaaacaagctttttttttgagacggagtctcactctgtcacccaggctggagagtgcagtggtgcaatcttggctcactgcaacctctacctccagggttcaaacggtccccccacctcagcccccggagtaggtagatcaggtctgtggcgtgccacttgttttatttatttatttatttgtttatttatttatttggcagagtctcactctatcgcccaggctggagcgcaatcgtgcgatctcggctcactgcaacctccgcctaccaggttcaagcaattctcctgcctcagcttcccaagtagatgggattacaggcgcctgccaccacgcctggctaattttttgcatttttagcatttttagtagagacggggttttaccatgttggccaggctggtcacgaactcctgacctcaggtgatccacctgcctcagcctcccaaagtgctgggattacaggcgtgagccaccatgtccggccttttttaatttttttattttaatttttagattcagagggtacatgcacaggtttgctatgtaggtttattgcatgatgctgaggtttgggcttctaatgaaccagttgcccaagtagtgaacatagcaccagataggtaggttttcaacccctgcccccgttttggaatccccagtgtttattgttcttaattttgtgtcagtgtgtacccagtgtttagttcctacttgtaagtgagaacatgcggtatttggttttctgcagaagctttcttgaccttctccttttatctctgattgtcagtttcctcttagtttcatttctttccataagcagctgtgacctcagcatgggtcatttcagctatttccttgccctgttgctctgttacatttaggacttcccaattccctttgagggcttcttatccttaaaatgttgctgtcgccagggcttttcataccctcttttgacatttcactggtcttccacggcagtcattttcactgtatttatctgtctgtacctggagcggtgtctttttttctaaccctgcatcgtgtaatgatgatgttctgataggtgattttgtctttgtgcaaacatcataaagtgtatggttgacctttgaacaagggagggattaggggtgttggtccccaacacaggcaaatccacatataagcagggctccgtggcccttgcctgtaatcccagcactttgggaggccaaagtgagaaggttgctcgagaccaggagtttgagaccatccaagcaacaaagtgagactcccatctctacaaaaattttaaaaatcagctgggcatggtggtgtactcttgtagtcccagctactagggaggctgaggcaggaggattgcttgagcccaggaatttgaggttacagtgacctgtggttgtgccagtgcactccagcctgagcgacagagccagattctgtttttaaaaaaaatcatataacctttttgactcccccaaaacgtaactactaatgacctattgttgaccagaagccttactgataacatagtccatgaacgcatactttgtatgctatatgtatgatatattctattcttacaataaactagagaaaggaaaatagtattaagaaaattataaggaagataaaatatatttactattcattaagtggaagtgggtcatcataacattcttcatcctcattgtcttcacgttgagtaggctgaggaggaggaagaagggttggtcttactgtctcaggggtgacaaaggtagaagaaaatctgaatatgagtggacccacacagttaaaactcatgttattcaagggtcaactacttatacaaaccgaggtggtatagcctactatacacctaggttatatgtatagcctattttgctccttggttacaaacccctacagcctgttactatactgaatactgtaggcagctgtaacacaagtatttacagtggtatttgtgtatcgagacatatctaaacatagaaaaggcacggtaaaaatatgctgttacaatcttacgggaccacgattgtatgtgcagttcatcattgactcaaatgttactggctgcatgactgtacctactggatccattgggcgcttaaaacttcaatacatctagagcattgctcacctgccacctttcttctgaccaacctcttcctctgtctgtatatcccatcttggtgaatgatactattatctatccttttgttcattgtttcagcagttatttattgattacttactgtgtgtcagatagtctgtggtataattttatatcattttgttcctgattcctagcacatagcttccaaaatctttggaatttcctgagtggtgggagtgtcttcttattcataatgagtccttttggatcttatctgagttcatgctaatgaactggctcctggggatgaggggctggacaccctcagaattgggggtggtccggaggaagcagtcaggaaactgcaggattggagggttggaactttcagccctccgccaccaccagctccagggaagagagagggactggaaattgagttcagtcacgtggtcagtgatctacttaatcatgcctatgcaatgaaattgcaaacgaaagccctggaactgtgaggttcggagagctgggttggtgaacccatgatgtgcagaaaggtgagtgcctatattgcacagaggaggagagggcatggaagctctgtacttcctctcccccatgctttgtgcagtgagtctcttccatttggctgttcctgagttgcacagagcttttccatgttcggtgagttgttctagtcaattacttaacttgaagtggagttaggggaacccctaaatttgtagtcagcctggcagaagtgcaagacttgaggctggcatctgaagtggggaagtcttatgggaccaagcccttgatttggggagtctgcactaactccggtagtgtcagaattgaaatgaatggtaggacacccagttagtgttggagaacattttttagaactcagtctgcctatagtatttttgaatactgtgtctatacacagtatagacttagtacctgcccttaagctagataggtgaacaagcaattataatttagctttgtaagctattcatggactaagtcagcagcctgtactttttttttttttttttttttttttgagataaaatcttgctgtgtcacccaggctggagtgcagtgagatgatcattgatcatggctaactgcagcctcaacctcccaggctcaggcaatcctctcacctcagcctcccgagtggctaggaccacagttgtacaccaccacacctggctaatttaaaaaaaaatttttgtagagatgggatctcactggtctcaaactcctaggctcaagcagccctcccacctcagcctcccaaagtgctgggattagaggtgtgagccactgcacccagcctggattctatctgatgctgaagtcggtggcttgattctgtcaattcagcctctgaaaggtcgtttgaattcaccctttctagccccactgctctggtcttagtccaggcctttatatattttttcactttactactttgctcttaatggttgctgcttcctgactcgtctggcttctctgttccacttcattttacactcacatgttgccaaaataatctttgttatgtgctgctcccacaataagatctttccccgtgcttttatctcctaaggtggtggacctcaagccttttggtatcaaaacccttgtgtcctcttaagtgattgaggtccccaaggaacttttcttcatgtggatttttgtcttatcattgtctgccagattagaaattaaaaccaagaaatttacacttaaaatagctgtaataaacctattacatgttaacataaataacatttttatgaaaactgttcacaaaacaaaaaaatttagtgaaaagtggccttgttttacattttttgcagatctctttcatgcctcactgaataaaaagatggctgaattccataactgctcctgtagtcagtttgttgtgaaacgttgttttggttgaaatagttgaagaaaatctggccttatacagatatgtagttggaaagaacaggagtcttttagtggcatttccagaaaattgtggttattttgtgatactgtaccaaaacttgacactgggtagtttcttaaggattggttgcagtgtagaatctgaagtcatataagtgaactttttatcctctgttacaataaaatctgttgatccatcctatactttgaatggctattttacccctgtttgatttgaccaatacatacaacatcatgtattggtcatttggaaaatactgggtcactgagttatgtaaatcttacaaatgttgacacatttcattaaacaatatcacaaaatcgtgtttgttatcaccacccatcttattagaaaattctttaaatgttgagaagcagtctagctcataatggcagatacaagttttccaaaattctaattttcaccccaaattcaaattttatcatgaacagcaagtactgtcagttgtttttcttgcagcatcaggcttgctttatttttgagaaactgtgccagatacccaaatctgaataatcatagttttttttggttgttgttttgccaaataaaaatcgagttcctgtaaaaaaaaaatggctagtttagctcacaactcaaatgattgcacagtgattttcttggacattgttgtttggtgtagcacataaatgctttgagtatctagtcatacaagcattaagcatgtgtactcaagggctgagatttaataaagtaataatttttcatgattcatcaaagacatcctgttgtaaaactgacttttttttttttatgtgagtgtttggcagtgaagaatccagtgaccacactggtacagtttggtgccactgctaaggtgggagcagttttacccaccattgtttttgtatcagtgtaaataaaatcacagtgaaaagagcaggtcttgcctgagtaccatcatgatgatatggtttggctgtgtccccacccaaatctcatcttgaaatgtagctcccataattcccatgcgttatgggagggacctgatgggagataactgaatcatgggggcagttcccccatactgttcttgtggtagtgagtgagtcttaggagatctgatggttttctaaggggtttcccctttcatttggctctcatttctctcttgtgaccgccatgtgagacataccttttgccttccaccatgattatgaggcctccccagccacctgtaactgtgagtccattaaacctctttttctttataaattacccagtctcggtgaaaatgaactaatacacgtaagaattttgaccatctgaacccccatgaaagggtcttaggactcccagggatccacagaccacaagagaattgctgccttgtaggataaaatctaaaccttcactcacagtttagagtgcattatgctgtatccctgttgaccttccccttttcctcttctatttctcttccatctggatctcaccatagaatgttcttttgtcactttagctttacagtttatttcccttctgcctccccctatctgtcccttatcctttaggcctaactgggtgttactgaagtgaaaatacccgtacctgccgcagctatgagtcattttccctttgatttccagcactgaacttttggctctacctctttccatctattttctagggacctctgatttaaagttccgaatttacaaatcccatcataacaggaaagcattttacatccctcttgtgacttaaacttaatttatactaatatttttcattttgaaccttcttatacctaattaaatgaaacatttgagcaaataggtgatggggtattgccttttttggggtcttctgttctgtcagaaatggtattatagttaggtctagcccagggaaaaaactgatttcctttaacagttatttgaatgatacccattttcctaatcaggaaggtttcttggtattatctaggtactgggttttatgctgccaagttcatcagttaaatggcctttagataaaggacaggttggagttgtgctcagctcatataaaatgtgctttagaaggacttctggtattatctgacccacactgcccctcatgtcacacatgtttctgcacgtacacaggatgagtactgagtacccttcatgtttcagggattctgcaggtctttcacatatgccatctaaaatttgtttttcacaattttgtgaactagatgacaagatccttgtgttacagatgaggacctcgaatttgctgccatttgtgtaatgaaaatataaatggcatagtgagtagctgaacttaaataaaaaatcattgacttaccacataaataatagtattataacattataaaacaagatttggtataaatgagctttcatcagtatagacacatctcaggcattagtctaccttgcctagaaggagcaggaattatttattgagcactgttttggatatatactgaagttccctcaaattctaatgtctcataactcttcaggcagttatagtaattgctggatataccaggaagttatgcctgtaattactgctcagaaatgaaatatgtaaactctagcattatattcatactggttttattatgagatatattaccttttagatttcttataagatctattttttagatttagcttacaaagccattaactgttataaaattatactgtaaattataagctttagttagatgggccgttaggcatagctttgctggcaactgtaaccttttatgattgcagtcaaaatgtaatccagatgctcttcgtaatagaccattgagtcagaatatcctgaatattgttttgcaggttcaaaatgttggaagagatctgaatcaggatgataaaatgacattcacccatctgattttgggcttacttctttgtgacatacctaacctggtgattaaattctttttttttttgagatggagttttgctgttgttgcccaggctggagtgcaatggcacgatctcggcttaccgcaacctccacctcccaggttcaagcaattctcctgcctcagcctcccgagtagctgggattgcaggcatgcatcaccacgcctggctaattttttgtatttttagtagagacggggtttctccgtgttgaggctggtctcgaactcctgacgtcaggtgatccgcccacctcggcctcccaaagtgctaggattacgggcgtgagccaccacacccggcctctgatgattaaattctaaaaccaagagttatttaaaagattttgtagacagtgggggttggaacttgaaagtgacccatcagctatgtagctactagcattttcctaaaaagtcctcagtgaggcagctggacaaggttgagaggcaggcagcatagccaagggattctggagccaagctgctcagctactgtcttagcccacttcgtgttgctgtaatagaatatctgaggctgggtaatttataaagaaaaaggtttatttggctcacaattctgatggctaggaaggtcaagttagagcatccggtgaggtcctcaggttgctttcactcagtgtggactcctgaatgtgatgtggatgtgaagaaactggaatcctcatacattgttggtgtgaatgtagcttggtgccgctgctgtgctaaggggagctagagagtgcagaggtcacatggtgagagaggtagtaggagcgggatgggaaggggccaggttgttaacagccagctcatgtgagaactaagagtgagaactcactcactcttggggagggccttaatctattcatgaaggatccaccccatgacctgaaaacacctcccactaagccccacctccctacactgccacagtggggaccaaatttcaacctgagatttggtggggacacatagcagttactagctgtgtaaccataagcaagctatttaacttttctgtgcctcagtttcctcatctgtagaatgaggtcgatcacagttcctgtctcataagattgttgtgaggatgttaaaacagcgcagtgcctcactaaatagtaaacactgtataagaaatgattgttattattcttatcacctgtgatccaagcctggaatttataatttaagatacgaatgaagttattatatgtagttttgttaccagttgattatatgacctctcttaatttctcagttgctctttccatcatctggaagcttcgccatttgttttaacctttgaagagatgagaggaaaagatgcatgataggcttaaattgctctcatctacttataaaaaataattagacataacgtggccaggcgcagtggctcactactgtaatcccagcactttgggaggccgaggtgggtggatcacgaggtcaggagttcgagaccagcctggccaacatggtgaaaccccgtgtctactaaaaatacaaaaattagctgggcgtggtggcgggtgcttgtaatcccagctactcgggaggctgaggcaggagaatcgcttgaacctgggaggtggaggttgcagtgagccaaggccgcaccattgcactctagcctgggtgacagaatgagactctgtctcaaaaaaaaagaaaaaaatagacataatgcaagataacgtcattaaaaagtgggcaaagacctgagtaggcatttttccaaagaagatatccaaatggtcaaccagtacatgaacagatagatgctcaaaattgttagtcattagggaaatggaaatcaaaactatgagaataccactttacaaccattagtatggctatcatttttttttaaaaaggaaaataacaagtattggtaaggatgtgaagaaactggaatcctcatatattgctggtgtgaatgtagcatggtgccacagctgtgtaaaataatttttcagctcctcaattagatagatacagagttatatggcttagcaattccattcctagctatataccaaaagaaaacaggtgttcaaacaaaaacttgtacataatattcatagcagcattatttaccatagccaaaaggtggaaacaacccaaatgtccatcaacttttgtgcatcagtggacaatgtggcatattcatataatgggatatgattcagctataaaaagaaacgaatgatatatggtacagtataaacgtaccttgaaagcatgtagaataaacatgaaaacatgtataacatagatgtaccttgaaaacatgctaagtgaaagaaggcaatatactgtatggttcctttttttttttttttgagagggagtctcgctctgttgcccaggctgaagtgcagtggcatgatctcagctcactgcaacctctgcctcccaggttcaagctattctcgtgcctgagcctcctgagtagctgggattacaggtgcccactgtcgtgcccagctaattcttttgcatttttagtagagacagggtttcaccatgttggtcaggctggttttgaactcctgacctcaagtgatccacctgccttggacttccaaagtgctgggattacaggtttgagccactgcacctggcctgtatggttccatttatatgaaatacccagaataggcaaatctgtggagacagaaagcagatgagtagctggggcagagcataggatttctatttggggtgatgaaaatgttctggaactagatactggtggtggttgcacaacttcatgattgtctgagatgtcactgaattgcatactttaaaatcagttcaacagtaaattttatgttatttgtatgatgctgcaatttaaaaaaaataaatatttcgacatgacgttttttccaagtttaccttagttgtaattttgccaaaatactttcttaaaccattttattgtaattttaggctaagatcatttgcactttatatatagttgaatgaaatatatcgtagttgttttattctcttgtaaatctagaaaagatgaaaaatgaaagccatgagagttttaagtatgtctttgccttgtgcagatattctcaaagggtattgtggagcccttggggctccttatgaccttttcaaagggtctgcaggttcaggttattttcatagtaattgttgagagttatttgcttttcaaatttttatttatttatttatttagagacggggctttgctctgtccccagcctgcagtgcagtggtgcaatgacagctcactgcagcctcgacttctgggcacaagtgatcctcctgcctctcagcctcccaactgggactgcagggaggcattgttttacatttacatgccaccatgcccgctagtttttttatttttcatagagatggggttttgccacatgttgcccaggctgatcttgaactcctgggcttaagtgatccacccccatctcggcctcccaaattctgagattacagaatttgtaagcataagccaccacacccagcctatttgctttttttttttttaaactctttttctccacaggtgtaaagtgtagttttccaaacgctctataatatatgatggtgtagtctctttgttggctaatggtctatgtacttgtatatgtctggatttttttgttttttttttacaattctctaaggtaagctctttgtgatcctcaataatttttaagtgtataaaagagtcctgaggccaaaaagtttgagaacaaaatgtcttggtaaaaaatgtatgtgccaataatgaaaaagcatatacgaactacttgtattatatatttttgaaaacagaaggaaaataaattgtaagccaaatgactcttttggctgcttagcttttatcatctttactgcttcagaggttactagatttggaaccaaagtgtactttttgggatgcggtaggtttctggttttaaaaaaggatgtctggtattgattaaatctatagttttgaactttctaatccagcagctctgtggagtaggtactgatacttggattttataaccagggcacaaaatggttaagtaacttatctgtggtccgacggctagtaagtggcaggtctggtgtttggatccatgaagtctgtttcctgagtctgcactgttcacagtatgcgatctatgtaataccgctccttatgtacattgtataataatagctccctgggaatgtatgtgtgaagttcccatttggaaggctggcatcgtagtactgcactgatagtggtggcagtgattgtgaggtgggttgggttctggtgcctatggcaggggctccagcaagcagatggttagaagacagatagggagcaaggataggaggatgggctgctataggggccagacctcctgcccaggatatttctggtccagttcgaaagttggacctttccttcctagagattggctccacttatggctttataataggacctcttccccttctggagtcctttggagcaagatgcattttcacagttttctcccaacctctttacttgagtctagcacttactgcctttgaacttctctgagggtttttactaccaactagaaatgaaagaaaaagttgaagagggagatggtattcaaaagataagtgatacaaattggagtcttttaggattcatattattgaaacgcaatttgtcaacctccctaagagggtcacatcactgtggtgtgggcccccccaaggcatgtcatcactgaggttaggatgggctctctgccatgaggagtaagccagtgcctccagctactggctagaaacagggagtgttgtcaggagatctgcactggggctgaaggacatccccgcctacttcccttttgctcttcttactatcagtctttactaccgcagatccctttctagggtccacgacctttgctggggtaaagtgggatgcagggatggggcctggggatgctctaggcagtttgcatgaaggagtggctccattggtgttaaagattaggccttctgatactttcttctccacttgtactttgagttaaaggctcttacctcaagagattttctttactctgtggccatatctgtaactgtccttaactctctgtgcatggcagccccaaaccttcccagtggaacagtgcaagctcagagccttgcaggtcagtgaccccacacttggcacaggaattccagggaaaagtgtgaaagggcagtaggtggctcctccgtcctgcttctttgaaaacctctgacctaaaaggtttttgaagctgaatatttaaagaaaatatgtatgagattgtagagatagatgcctaggcggctgaaggggatgtggcaagtggatggcctccctcagggctcctttccacctgtggtggccacaggttcaagactcctgtccaaacattctggtttgtttatgtgttccagaaacagacagagaagaaggtattgtattttttgagacagtcttgctctgttgcccaggctggagtgcaatggtgcgatctctgctcactgcaggctccgcctcctgggttcaagcgattctcctgtctcagccacctgagtagctgggattacaggtgtgcgccactatgcctggctaatttttgtatttttagtagagatggggtttcaccacattggccaggctggtcttgaactcttggcctcaagtgatccacccgtcttggcctcccaaagtgctgagattataggtgtgagccaccatgcctggcccaaactggtattatatctgcatgaaaaagggtcactgtgccaatacttttttcatttaagtttttttttttttttgagacggagtctcgctctgtcacccaggctggagtgtcgtggtgcgatctcggctcactgcaacctccgcctcccgggttcaagcaattctcctgcctcagccgcccgattagctggaattacaggcatgcgccaccaagcccagctaatttatttgtatttttagtagacatgggggtttcactatattggccaggttggtcttgaactcctgaccttgtgatccacccaccttgacctcccaaagtgctgggattacaggcgtgagccaccgctctcggccctcatttaagttttaatatgtttgtgggtagaaaacgtcttaattttttttttttaatctcagaaaatgacatgtgttggtgttgagatctctcttgagtggcttcatcatttgttcgtatgcccaatgtagaaccttattctttatcctgaattccttcctcccccttacacctgatttaattgtgcactattgatctggcttagttctggaacttctctcactctcactcaggtgttgccctagactcataggtgctctctctccagccagttttgacctctccatatctttttccattagagcagtagttgtcaaactttttgattaaaactgagaggccaggtgccgtggctcatgcctgtaataccaacagtttgagaagcccaggtggtaggatcacttgagcccaggaccagcttggacaacatagtgagaccttgcctctaccaaaaagtaaaaaaattagccaggggtggtgacatgtgcctgtggttccagctatgtgggaggctgaggtgaaagcattgcttcagcccaggagttggaggctggattgagtcgtgattatgtcatgacactctagcctggattacagagcaagacactgtcccagaaaacaaaacaaaacaaaatctgagaaattacttattccctaatttatgatttggttattaacttatttaaaatgaaaaataaacccatgtaaagttagtatacatagctttttaatgaaaatcgctttttttttttcccaaaacaacaacataaaatgtagtcggaagagtggccatcgttcacttatgtgttgcagacctccttaatgtctgcctggatggaagagtttctcatccagtgcatacatgcatgaatcattgcagccaggtctcaaccctgtcagacaacactctctttttgtagtaagtctttggtaatgcttcttttattcttaagaaatgtattcatctcagaattcaaatgaaagtaacatactaacatgataatagttcagtgtgtcagtgttgtctcagctacactaggatcacatgctcactaggtcaggtgcactgagaatgcagtggctgcaaatgcacacggtagaggtacattacttggtgattcaaatatcaagaagggcattagatgtaatgacatgttctctaaaactgtgagcaacttttggtaaaatacaaaacagtcttttgatttatgtggtaattatattcctagcaaattgaatgtgtagtgaaacttggaaaaagtcttttgtgattctgtgtgaaatggaatttggttttaggttccgataattatacatggggttttcccctacattactatctagagaaacattcaaaagtcgtatgggacaattcctcatatgggactgttctgcacaacctgttaaataaatgccagtggtgcctcccagcgaatgagaccaccaaaaataccccacggattttcacacatccattagggaatggtacatacctattaagaacactgataagtggaatcttggctgtattttttttcttgttttttgtttgtttgtttgttttgagacagagtttcaatcttgtcacccaggctggattgcagtggtgatcttgactcaccgcaacccccgcctcccggattcaagtgattcttctgcctcagcctccggagtagctgggattacaggcgccggccaccacgcccgactaattttgtatttttagtagacacgggtttcaccgcgttggtcaggctggtcttgacctcctgacctcagtgctgggattacaggtgtgagccgctgtgcccggcctgttttgtttttttaagttggatgataatttaaaaaataacttacaatacagcctgaccaacatggtgaaaccccatctctactaaaaatacaaaaattagcaggcatggtggcgcacgcctgtaatccgagctactcaggaggctgaggcaggagaattgcttgagtgaggttgcagtgagctgagattgcgccattgcactccagtctgggcgacaaagcgagactccgtctcaaataaataaataaataaataaataacttacaataataattacttgaatctcaccgttaatcagtgttaatattttgttgtatatccatcttgtccttttttgtacatttgtagtttttttccattcaaaaatgggatcatttaaaaatttaaaaagagtcgatgtcttggctgggcacagtgactcaacgcctgtaattcccagcactttgggaggccgaggtgggcagatcacctgaggttgggagttcaagaccagcctgaccaacatggagaaactccgtctctactaaaaatacaaaattagccagcgtggtggtgcatgcctgtaatcccagctactcgggaggctgaggcaggagaatcgcttgaacctgggagacggaggttacggtgagctgggcaacaagagcgaaactctgtctaaaaaaaaaaaaagaattgatgtcttgatgctacttaattttatctaattcacgtgtttttaaaaatcataacaaaatcagttttattcttcattctatcatacaattagtacaatctcaggtaagatgcaaacaatgtatactcataagtctctttttaacatgaaaactggtgctacctagggaagtacaaatgaaaccacaatgaggtaccacctccaacatgttaggatggccattataaaaaaagactgaaataataagaattggccaggatatgaagaaaagggaacgcttgtacactgttggtgggaatgtaaattgatatgaagcagttatggaaaacaatatggaaattcctcagaacattaaaaatagaactactgtatgacccagcaatccctatacccaaaggaaatgaaatcagcatcttgggaagatatctgcactcccatgttccttgtggcattattcccaatagacaagatatggaaacgattttttttttttttttgagacggagtctccttctgtcgccaggctggagtgcggtggcgcaaactcggctcactgcaacctccgcctcccgggttcaagcaatttttctgcctcaggcacccgagtagctgggactacaggtgcgtgccaccacgccctgctaatttttgtatttttcgtagagatagggtttcaccatgttggccaggatggtctcgatctcttgacctcgtgatccacctgcctcggcctccaaagtggtaggattacgggcgggaggcaccacgcctggcggaaacgatttaataagtgtctgttgccagacaaaaaaaataaattggggcatatacatccagtggaatagccattaaaaaggtgatcctgtcatttgtgacaacatagatgaacctggagagcatgctgctaagtgaaataaactagaaaaagaaaagaaaaatattgcaagatctcacttatatgtggaatctgaaataaagctgaatatgtaagaatagagtggctgagtggttatcgggggaaggggaagtgggagatgtaggtcaaagttgcagttacataggatgaataaaactagagatctaatatttagcatgatgactctggctaatattgtattggaaaatttgctgagagtagatttcaggtactcttaacacacacacgtagctatgtgaggagatggatgtattacttctgactgtagtagccatttcactgtgtatatgtataacaaaacatcgtgtcatgtaccttaaattatacaataaacaaagaagaggtgccggtttgaaggggcgaggacagagcgtggacttgcggaaagttaggtggccttggtgatttaatctctcaaaccttcggttttcttatctgtaacacgtattagagaaactgtgtcttgtcggaacctacccctcagtgggggtaatcccagctgtttgtcctcagctcatttctaactgaactgcaggcttctcaagagcagccaggatgtcaccttttcatcacctagcaccagctcaggacctggctcattaatttattgaacaaatgaatgtggcagaaaatttgctattggtgttggactgtgtttaaactttgtttcatgtttatcatggttaaacctccatcagaggtaaacaactatgttaattattacatcaaacttctgtacatcttgccccaaatgggatcatttatttgttcaggataaaatgtttttgaagtttttagcacacctgatagttgtatttcttctagattgggcttggatattgttattactcaggaatctggttgaatgtttgattgtataactctgcctttgacatatgtaattaaatgagtttgtatttaatgtgttccttgaggcagccaggtgtatttacctcagaactgttgaaggcttgccatgtctctaggactcattggtacctttaaggcatctctacaggtatgattttcttttactgtggattctttttttctttcaaaagtttttcagctgttagatatttagcagctcagtctgtttgaatgatttaatgtgttactattgaaaattactttgaaatacaatttgactgttttcaagagagtttggattctgaaggcccacagcgtataggctgaaacagtggttctcaaatctagcatgcattcactggatctgggacaggatccaacagtttgcatttctaacaagttccccattaatgctggtgctgttggtgtggggaccagactttgagaactattgggctaaagtgtggaagacaattaaaaataataatatggaggggaaatggggcccagtgtgtttgggaacaggatccctttgtgctctccacagacaatagagcagtaaagaaaaactggttttggcacctgaaaagaaggaaaatagacataaactttagaaaatactgtttgatagttgcagtggtccttaaaattaagataggagaagagatttggaaataatttaattttaaaaagtttattttaccttttttattataggagtaatgcatgttcataatggaaagtgtcataaatacagaaacatttctattctaaaagagaggaaaaatttccccaaagtatcttctgacatttttggcaatgtccattcagtatctcttttatgtgtaggacttttgtttttgttttgccatgaaataaagtttttattgtcaaaataatatatgctcattataatgaaagaaaaagaaagatcataaaggacactcactctttccagaaacaatactgataacatactgaagtttattatttggtatctcttcatgtgaatatatccatttatgtgaattaccttgaccatatggttttataacctaattttttcagtcactatcttttcatatcattagatgtaattctgaagcatcttttttaggcgcagagtatcttactctgaaaaactttgttgtagctgatgctcttcatccactggcccctcccatttctcatttctctactaggaatttgtaggtcaaagagcatgtaaaaatcttgatatgggccgggcacggtggctcaagcctgtaatcccagcactttgggaggctgagacagggggatcatgaggtcaggagaccgagaccgtcctagccaacacggtgaaaccctgtctctattaaaaaaaaatacaaaaaattagccaggtgcagtggcgggtgcttgtagtcccagctacttgggaggctgaggtgggagaatgacttgaacccgggacggggagcttacagtgagccgaggttgcgccactgcactccagcctgggcgacagagcgagactctgtctcaaaaaataaaaaataaagaataaatcttgatatgtattaccagatacccacaaagggcatagaagtttctgttctcactagtagctgtgtgcctgtacccagaccccaagtctatgctcattgccggtttaataattgccagcctgataggtgaaaatagtatcttttcattcacttcttttactgataagaagcttaacacttttcttcatgtgtcagttggtcgtttaaatttcttttgaatttctgctcttgtccttgtcacattttcttttggggttaatcttttttcttgatttatatgaactcttcatacttagggacattaattccttacatcatatgcttcagatatttgtttccaaaatttcatttgcttttaaaactaacttgtggaattttttttctttcatagaagtgttttaagtgtttcatagaagtgccatccactatgattttccttttttttgtttttttttttgtttgacatggagttttgctgttgttgcccaggctggagtgcagtggcacgatctcggctcactgcaacctctgcctcctgggttcaagcgattcctgctaatttttgtatttttagtagaaacggggtttcaccacgttggtcaggctggtttcaaactcctgaccttaggtgatccctccgcttcggcctcccagagtgctaggattacacgcatgagccattgcgcctgtcctgattttccatttttaaggatttctgctcatggtgtcaaatgagaacatcccctgtcacttcaagattttacgaatattaacctgcattttcttctacaacactttctcttttttaaaaaacgtttttaaaggtggagttttgctaagttgcccaggctggtcttcaactcctgggctcaagcaaacctcccacctcagcctttcaaagcgctgggattataggcatgagccaccgtgcccagcctctgccacacttccatgatttcatttgttcactagggtcttcaaactgtctgtagtttgttttgatgcaagcaaatacatttattttagtgtggccaaatgtaatttacatttttaaatattgaattattttggttgcactgtgcaaacattaggcaaatttaggtataaagttggaaaaagccactaagtgtcacactgttctgaggagcactgggaattctgagaaggcttaaagagtttgccatggttttctgtccttgtgatagtttgttcggaatgatggtttccagcttcatccatgcccctacaaaggatgtgaactcatccttttctatggctgcatagtatttcatggtgtatatgtgccacattttcgacagaaaaccaaacactgcatgttctcactcataggtgggaattgaacaatgagaacacttggacacagggtggggaacatcacacaccgggacctgtcgtgaggtgcggggaggggggagggatagcattaggagataaacctaatgtaaatgacaaattaatgggtgcagcacaccaacatggcacatgtatacatatgtaacaaaacctgcacgttgtgcacatgtaccctagaacttaaagtataattaaaaaaaaagagtttgccatggaagtggaggtcaggagaggggagaactgagcaagtatgtgggtatttccagctcctacttctcccaagaactgcaggcttagatgggcagctgtctagtaggcagatcttcttgggcatctaataataagctgttcaaaattaacatagccaaagcagaattcttttttttttttttttaagacagagtctcacttatcacctaggctggagtgcagtggcatgatctcggctcactgcaagcctcgcctccctggttcaagggattttcttgcctcaacctcccgagtacctgggattacagttgtgtgccaccatgtccagctaatttttatatttttagtagagacagggtttcgccctgttggccaggctggtcccaaacatctggcatcaagtgatccacccgcctaggcctcccaaagtgctgggattacagacttgagccaccgcacccagcccaaaacggaattcttgatgctgtccccaccctaatgcgcacaccccagtcctttctcgtcttagtaaatagcgctgtcaaacacccatttaggcaggccagaaacttcaaaggtgtctttgattccgctcttccaccactttatatctactccatcatgaagtcttgtagactttctgtccagaatatatcctgagtctgaccactcctaatcatttccactgttaaaacattaggccaccactgtctctcatgtgggtgttattgtggtcttctggacgttgtcttggttccactttgtctctccctgtaatctgtttcacatagtagcttctacagtgtaaataagatcatattattcccttgattaaaacctttcaaagacttcccattacatttaaaataaaatccaagccttactataaaagatccacttgtctggcctctgtgcttctccagtttcttccttctgcactccccttgtctgctttgcggtagcctaacatgtctctttctatctcttgaacaggttcttttctttcgttgggtctttatacaggctgaacctcctctagaactaactagaagctacctctgatgtcttctcagagagactttccttgactatccccaggcacatgaagaagccccacacaccccctctagtcaccatctatcttgttaaccttacttattttcttaaagtggggttctgtatgtaaaatgatcttctttatttgtttactggtttattagctgtcttcctattcgagaatgtaagctcccagaggacactctgttttgttcacttctgaatccctagcacttagccccgtgcttggcccatgacatttgtggtaagtactaggtgaccatttttggaactgttcccaccccacggcctgcattcacactttaatcacagcagctcagcttttatatcgtgagcttcagtgggaggttttgtttacagaaagttttcttggttgacaaaagcctgaagatgattttcttggaagatgaggatttattctaaggatatgtgaggaagcaaagtttttgttgttgttgttgttttggaggggtggtgggggatccgagtctcgctttgtcatccaggctggagtgtagtggcgcaatcatggctcactgcaacctctgcctcccgggtttaagcgattctcctgcctcagccacctgagtagctgggattacaggcatgcgccaccacgcccagctaatttttgtatttttagtagagacagggtttcacggaagcagagattttctgtcagtgttccatctacttcataatgtattgttgatatggttcttgattttttaacctgaaggcataagcatgaaaatagcataatgatttttcacagttcctgtccaagagtactttttctttacatgttgaattacctaccatagattgttttatcctataattagaaagattatgagattacatcatcttatatttacccttaaagagtgtttcccgaatcataagccaaagcctttgtataaccttattatgtaaatatttatgtttcaggtgtgttattccctttgtgtgtgtgtgtatctatatacatatatatgcatagtatttgtgttctcttattcctatgacattgtaaacgttctagttgatgatgtctgtgcttccattgcaactcttcactgcatgggtactctgatgtgtatggcttgctgctccccagatattcgttgactttgtgacatctgtcctaggacaatttcactattttagtttttggctactcagttaattagaaatgcatctcagttgtattttaagttattgctttctacattttaatcagtaaatacaaagagattgcctttagtttttgttatgtgtattttcaggttatgttactgggagtacaaagttttacaattgttgctttctttgtggattataggttttaggaaaataaaatttatcgtattgacagtttttgccttgaaaggcttattaaatttagcagtcctcccttttttgtgtgttttttgatccttatcctttttttttttttttttttttttgagacggagtctcgctctgtcacacaggctggagtgcagtggcagagctcactgcaagctccgcctcccaggttcatgccattctcctgcctcagcctcccaagtagctgggactacaggtgcccgcccccacatccagctaatttttttgtatttttagtagagacgaggtttcaccgtgttagccaggatggtcttgatctcctgacctcgtgatccgcctgtctggtcctcccaaagtgctgggattacaggcgtgagacaccgcgcccagcccatccttttgtttttaatctgtcattttattttaggtgcatttctagttcgcttggcctgctgtctttttcataacactttattcctatgtaatagatataatgttcttttgcattttattgtttctaaagcaaatatcttctaattaagaaaaataacttctagttaatttatttcaaggggaagcagtgggggttttattcctctggatgtttgttgtcttgtgtcctgtggaatattttctttctgtttttgttcttttctttctctaactcaggacagtgctgaggaatgttttcattggtgccgtattttctttttctttcttttcttttttcttttttttttttttgagacagggtctctgtctgttgcccaagctggaatgcaatggcgcaatctcggctcactgcaacttctgcctgctgggttcaagcgattctcatgcctcagcctctcgagtagctggcattacaggcatgcaccaccacacccggctaatttttgtgtttttatagagaaagggtttcgccatgttggccaggctggtcttgaactcctgacctcaagtgatccacccacctcagcctcccaaagtgctgggattgcaggcgtgagccgatgtgcgtggcctggtgccatactttctgcatttttctttaaggaaggttccaaatgtctgaagtccaccaaatgtctgaagtcctgcccagacttttggagagaaaacacagcaaagcaatcagtaggttaatgactgcatggtttctggaccaaattatcctcatctaccacttagaacattaagttgtaaaccagagtcagcacagccagggtggagattacttatttgtatcccttgctcgtaggttatttaatattctctgttgtgtcaaagtttagtcgggtatattaattagtcagcttttgctaaattatgttgtggtaacaatctccaaatctcagtagtttacgacaacaaaactttgtttctcagtttaaggctctttgtgggcttcatgccatggtagaacctcaaaagtggcatgtgccatttcaactcatacttcattggccaaaagcaagtcacgtggtcatgcagggcctcagtaagcaagaaatatttacccgcccggggatggacaggtaggaaagggtctgttaaggaagggcagcaaatatttggataacagtactatgtgtttgtatggagcgatatttaagaaggtttcctaggttttttgaggggtattgaagctgagaggttgggggcaggcaggaagctctgcagcctgtagcctatggtatcaagcttcatgagaacgagaattaactagttacatctttattaccatttttggcatctctgcagacagtggatctaatgcatgatagctgattaataaatgtttgttgaattaatgaacaaaatagcaagaaagtaacgtattctgaggcaggagaattgcttgaaccaggaggcagaggttgcagtgagctgacatcatgccattgcactccagcctgggcgacagagtgagactccgtctcaaaaaacaaaagaaagtaaacagattattttcatgctatttgatgcctccgcttagtttggaaccagtttttattttattttattttattttattttattttattttattttttgttttgtttttgttttcgtgttttttgagacggagtctcgctctgtcgcccaggctggagtgcagtggcgagatctgggttcattgcaagctccgcctcccgggttcacgtcattctcctgcctcagcctcctgagtagctgggactacaggcgcccaccactatgcccggctaatttttttgtatttttagtagaggggtttcaccgtgttaaccagggtggtcttgatctcctgacctcgtgatccacccgtctcggcctcccaaagtgctgggattacaggcatgaaccaccgcgcctggccttggaaccagttttatagagcagttcctacaatagctccttttatatttaaaatgaaaagtgctttcttgggggtcattttgccataccaaaagattatgtgcttaaaaaaaaaactacatactaattacagaaaaaattttaaatatgcattaaatacaagcaagtagaggttgtgttctatttggctactcaggacaactattggtgttttgttatatatcctcctatataattcctttctttcttttcttttttttttttttgagatggagtttcactcttgttgcccaggctggagtgcaatggcgcaatctcagctcaccgcaacctctgcctcccaggttcaagcgattctcgcttctcagcctccctagtagctgggattacaggcatgcgccaccacgcccggctaattttgtatttttggtagaggcggggtttctccatgttggtcaggctggtctcgaactcccgacctcaggtgatccacccgcctcggcctcccaaagtgcaggggttacaggcatgagccacatagtgcccagcctctttcttttcttttctttctttttttgagatggagcctctctctgttgcccaggctggaagaatacagtggcaccatcttggctcactgtaacctctgcttcccgggtacaagtgatgcttgtgtgtcagcctcccagtagctggcactacaggtgtgcaccaccacacccagctaatttttgtatttttagtagagacggggtttcatcacattggccaggctgatctcctgacctcaggtgatccactcacctcggctgcccaaagtgctgggattgcaggcttgagcccttttttttttccccatatggcttctgaacattgtttatatttattgtcacactaggatcacttagttttgtacttttagtagtatctattgctttatttgttatgttgccaatcggcagttgtaaaggtcgtagatgaaatagacaagtatttataagattaattttatcttacccttgttctctttttctcttcttgaatttcctccttcaaatatatgaactatttacttaaccaaacactctctttctcttccctctcaccatggcaagagtgaaagggaccagaatgatgaaaggtagacagttggcctgaggaaataaggtgccttggcgattctcagactggataatcagctcctggggaatcaggcgctgacttttttttttttcctcctgcttttactcagagatcatcttttcatattttgggatttgtgcagtcatttcaatgatctaaaagtgaagagcttgataataagttgattttagtcctactgtctttttgtgacggatgtgctagataagcttaatgtgagtcattcaagaaccaagcccctgtttgaacctgtccattgagggccctgtttatcagaggttgaagcattttttagctagcagctgatcttgggtaagcaagccattgtacaagttccccatgcctagttgttttgcatcattaatcatcttttcttcaagccatggaaacatggctgagtcttgagtcatctggctcttcccagtgctggaaatccaccctgctgaggtgaatgtgtgaaatattttttgttctcggtagagatctgagaactggtttgtctcctgcaatgaacagattgaattccttataaatatgttactaaaaggtaccttttgtgtccattttacagatatctgacatgattatttattaaactcctttaaataactcctgtgcttaatgcagtttccaaatatttgaaatactaaatgtagatttagggaactcagtgaccagttttcatttgcattttgatgaatttctctattttaatatttgtagttgctatccattttagaaatatccactctgccaagtaggttgggaatgtgtgcaagaatgacagcttaaataatgtgcttgtttgctattggagccgatgcccctaagtaaagctaccagataaagagaggaaagggggaaaaaaggaggagaatgaagccaccgtgtaacatctgttagagactcaatgtgagccctgtgagttagtcttcatttcccatgctatgttttatttttatttttcctgttccattaaagcatttcggttaattctgtataagtagaatgctgataactccttagagaaatgtgattcagtaataaccttgtttccatgtgactacttatctaatctgccatgcatctgctttaaggaaggtgtccattagggtcaactcacaggtcagacattaatcttaattgtcaaatgtctcaactcattgctagagactaaattgatcttgatggcactcatctgagtaccgattcacactaaaagacagtcaaggggttgttttcctttgtgtgttgtaattcttagcaggatcctaaaaatgaaagttttaaaatgtggaatagcatgattaatgaggacatttattaaggttaaggcagtttaaaagttcagtttaatctaaggttagcttgtaggaactgatataagagatagttaaaaatttgttaagctttacttaaaacctgtatttgggggtagaaacagttttcctagggtacttataatttcctttaattatctcagaaagagggtctcttattaggatgagggaaaaaaatgacccgtcattcttttaaatcaggtttaatttattcctgatatttatatgattcttatatgtcatgtaattcttatgacatataagagagaaaacattaatctagagtaggtaatttcctagttcagcttcttccacttgtgtgaactacagaagaactgaagagtaattgtaattgttttataactttaaagaatttaagagattaaattgctgtccttgtgaattctttgttaagtaactctcaaagaaatagtcaagttaaaggggatttactttctaaaactagctttcttttctttctgtctaaccttttattatgaaaaatttcaacatctacaaaagaaaggagagtagtatcattacccagctacagtcactgttaactctcagctaatcttgtctccatcctgccaccctccactccagattattttgaagcaaattctagacatcacttccttttattaaagcaagttgcgtttcatagtgacaatagaaaccatttactcttggcacaggtgctaaggtctgaatacaactttaaggagacagtgtctgcattgaagagcttatgttttaagaaaggagtttatgttttcactggatatactcggcgttcagggaatcagagactttcttcaagtttcccttgtcttttaaatagggacgtatttgcaagttcttatctgtttggaaattcctgtagcaagttcaggtttagtcattctgtactgctttggtggtgccttatctaaatagtattgaaaggaagaaagaattatttcaccaagagttggccttgaaaggagttagatgtattgggtatatttaggaagtaccccttcaacgctgtaataatataccaacttttaaagctacctcataatagctcttaaaaacacatttaaaacacttagaggtgatcctttttcctagccatcagtgggacaaattaattcctttttgagtaaaaaaaaaaaaaaaaaaaaaattctctttttttagtactcaagatcagcaagtattggttgactcattctttgttgttaaacctcttggtttctcaggccagtgtgtctttttgtatactttgaccttgcactttaaactgaattccttttgtcctttgagggaggcataaagctgtcagttcctgttggtgagtgtgggaaattgagttttcactcttctctataatttctgcatttcaagtggttttaataataatcataactatttctcaattttacttcttaaaaaagtagattcatcagactgaattgaatatttgttttccttctaaagctgaagccaattttgccatacttgtttgtgcattcttaagagtttagtacttaagcatagaaaactgtggggttcacatttatattttgctttattacaacttagaaggtaattgatgacttggctctgtggtatgctcaaagtgctggactgagctagttcaagaatgtcattagcagtgaatgggaaatatgtgtctacttttcttcagtagctaaacagaagtaattatatatttacattctacctatttcatagggatgttgttagaattactgtgattagatttttttttttaatttccaaatgtatttaagcttctttacagataggtgccatatcaaagcaaggtgttaatgtcatttttctcaatttgtgtttttgtcactagaaatatatatatattgctttttctcttttcctggtatatttttctgataaatgttttgaaatttgttatcttaagtttttcatagctggaatgctagaaaagcatttatgtcctatttttagtgcaagtgatgagtctggctgggtgggtaagttaatggcaaggtaattgaactgtgctgagtgctcgccgatgtatccttctggcctctccattttcagggtagagttactgtttacagtgacatgtttcacagtctgtgtgaccagccagtgtgaatcagttcgtctattgcctggctttcttgagctcaatttttgtctcatttcccctttccattttatatatcacatttcaagatggatgatctacttgtctaaccactccagggaagattggtgccatctaataaagtcaaaatgaggtcctgcatgttacctggcataaattagagaattatagaatgaatgtgtgaacagatctgagactagagctaggtcacgaaactcctcagtttttttgggttctcattatgtgtttatggatggaattgttctctttatctggtttgggtggttttgtttgtcagtggccaatgtggtggatatttcaacacaatttggacatgcttcctatatattttgcagaatggtctttttcttttggttaactttataactaatagttaaagaattttcaagcctcagctgggtacggtggcccatgcctgtaatcccagcactttgggaggccaaggtgggcagattacctgaggtcaggagttttgagaccagcctggccaaaatggtgaaaccctgtctttactaaaaatacaaaaattagtcaggcctcactccagcctgggtgacagagcgagactctgtctcaaaagaaaaaaaaaaaaattatttgggcttggtgacgtgcacctgtaatctcagctactcgggaggctgtggcacgagaattgcttgaacctgtgaggcagaggttgcagtgagccaagatcgtgccattgcacttcagcctgggcaacaagagcagaactccatcttaaaaaaaaaaaaaaaaaaaaaaaaaaaaaagaattttcaagccacattaggatgcttatcggcatgagttttacataataagacaatctgaaatgtatttgagttttgatgtttctaatctgtagaacttgaaggcctaaggattttgtagttttttagggaacagcattcctctttctctcaggtgatctatgttatgttgacctactcaaacatgttaactttgaaaatgaaccaacgttcaggaacaaatgaaatgacattttcaggacagcattccaaatacatagttagggacagttgttcgtagcttctggagtgtttgaaaatggccctcatatcatacaacttgaattggcattcattgacaatcactttgcttttaaaagatgcttaacaaagagttgtaagtaacatactttgagactgagtaaataaaataaacatgcgaacctttgatgttaagctgagtttgtttgatttttcaggctgaatatacaaagactgtttctaggaaaacttgtgctttgtacagatagaggaacctcctaagaattttgattgtggcttccaaaatagcagatttctagaatatgattacctactttatctaagatttcaaaaagctgctttgtctattttatgatataaagttttcaaaaaatcatcactgttttgtttgccttttttttttttcttgaaaaggcatgtgtttaagcatcagccttattagctggactgttatttcatgtatttctgttagaacgctggataatggacttgaaacttacatggctaatataataccatgaagtttaggaaactaagggctcatttctgttgtattccttggaacgtatgtgggttcaagatcaaaatcattatttcttctttgttttggtatttgtctctttcgggaattaaaatttgttcccaaacattcgtaggactacactgtagcaggaatctgaatagaaaacactccttgtttagttctgagtttatgtggatgaggactaagtgaccattgaaggtggaagggtgatcacagagattactcagaacttaatttattaattctaaaatgcgttcattgaatacacatggtttgtgtgctttttatgggccaaaccatgtaacagaggctgggaatgcagttcttgctctcaggggaatgtagtcttgtctgagaaacagacaatgaacatcagtttccaatagatctagttgtaggcttagagcatgcagagggaacaacagaaaaaatccactgagaccattctggggtccaaataggacccatggcccaagtttagaatggcaagaaagaggaaagacagagggagcttgggcagtgttctgcaaaggataaattcagttctctaagaatagttcactagtccttttttttttctttttttttttgagatggagtttcgctcctgtcacccaggctggagtgcagtggtgcagtggtgcagtggcacgatctcggtgcactgcaccctctgcctcccaggttcaagcaattctcctgtcttagcctcctgagtcactggaattacaagcacgcccggctaattttggtatttttagtagagatggggtttcaccgtcttggctaggctggtcttgaacacctgacctcaggtgatccacccacctcggcctcccaaagtgctgggattacaggcatgagccattgtgcctggcctggtcacttgctcatagttattaatctgaagaagttctacagtaaatcaaatgttcaggattgcctaatgttgacttactgatttagaatatcattctcttggtatgcttctataaactaccagtgctcaatttttcttttcaattttgaacttgttgatggacagtgtctacagtctcttgacagttatgtaatttgtgtctatttaggtttaagctgtcaccttcccaaatgcggcatctgtgtagccccagagggagcattctaaaaggtaaatctgagcctggcgcagtggcccaggcctgtaatcccagcactttttgggagctgaggtgggaggatcacttgagtccaggagttttagaccagcctggtagcaagaccctgtctctacaaaaaataacaataaataaaattaacaggcacagtgatgtatacctctagtcctagctaccgtagaggctaacatgggaggattgcttgcactcaggagttcgaggctacagtgagctatgatcgcaccactgtactccagcctggtagcaagggcctatctctaaagaataaaaaatagactaggcatggtggctcatgcctgtaatgctagcactcggggaggctgaggccggtggatcacctgaggtcaggagttcaagaccaacctggccaacatagtgaaaccctgtctctactgaaaatacaaaagttagccgggcatggtggcgcacgcctgtaatcccagctactcaggaggctgaggcaggagaatcgcttgaaatcgggaggtggaggttgcagtgagctgagattgcaccactgcattccagcatgggcgacagaccaagactctgtctcaaaaaaaaaaaaaaataattaaaaaaaaaaataaggccgggtgcagtggctcacacttgtaatcctagcactttgggaggccaaggcaggcgaatcacttgaggtcaggagtttgagaccagcctggccaacatagtgaaacctcatctctaccaaaaatactagcctggcgtggtggtgcatgcctgtagtcccagctattcaggaggctgaggcaggagaattgcttgaacctgggaggtggaggttgtagtgagccaagatcacacttctgcattccagcctgggtgatagagcaagactctgtctcaaaaagaattaaaaataaatgaacaaaaataagccaggcgtggcccggtgcagtggctcaccctgtaatcccagcactttgggaggctgaggcaggaggatcacgaggtcaggagatcgagaccatcctggctaacatggtgaaaccccgtctctactaaaaaatagaaaaaagtagccggtcatggtggcgggtgcctgtagtcccagctactcgagaggctgaggcaggagaatggcgtgaacccgggaggcagagcttgcagtgagccaagatcgcaccactgcactccagcctgggcaacagagcgagactccgtttcaaaaaaaaaaaattagccaggcatggtggtggatgcctgtaatcttagctactggggaagttgaggcaggagaatgacttgcactggggaggtggaggttgcagtgagctgagattgcaccattgcactccagcctgggcaacagagcaaggctctgcctcagaaaaaaaaaagtgtatatatatatatacatatatatatatatatatatatatgtatatatatatatatatatatatgtaaaagttaaaaaaaaaaaaaaaaagacccatttctgccgaaaatctttcagtgactccatcaccccaatgggccatgggcaagtcctgtttccactctcacatccttgcctttgggattgttttcattcctgctgagtatttaccctcacctggaaagcagctgtgtgaacttctcttcatccttcgtaggctggtggcctttcttccatgctcagttaatcagtttctcttctctgcttcctttgttctttggcctgctctgcggtgttgtatgaaacacactgtgccagaattgtttgtttactttctgttcctgttctaaatatgagctctttgaggcaggacctgtgtctttctttggacctttacgtttgtcgcagtaactgtcatataataaacagtcaatacttgatttaagctgagcaatgtaacacttaaacattaattttgttacatttactggattataatggtgactgaaaaaaacatttttaagttttttactccacctgggacaattctaactaagtgttttacttatgttaaaactcatttaattatctttgttaaagaattactctgatgcttgttaaaatagttaggaagactttattcaagactattgcaatggcggggagagatccagctcaattctgaatccagcaaggacaaatagagaattacagtcaagtagcagaatatggtcagtgaatggtaaattgctaagtggagacatcaaggtcagtagatcttataaaactggcttagtctgcttgggctactgtaacaaactactatagactagatgccttaagcaatcgaaatttatttcttatagttctggaggctaagtctcagatcaagatgccgacagatttagttcctggtgagggccctctttgtggtgtgcagacagtcaccttcctgctggcagaaggagagatcatctctctgatgtctgttcttataagggtaccaatcccattcatgaaggctccactctcatgattttaattacctcccaaaggctcgctttccaaataccatgaccttggggataagtgcttcagtgtatgtattttgagaggacacatttggtccatggcactgacctaacaagattgttgccgaaggcaggcctagaatgtatacatcaaaggtgggggtgaggaatttgatcaaatatcaaaggtgatcagatatctcagatgggggtgattctcactaaactgacttagcaggattgtttgtaaaactgagttaggtaggctgaagacaggaggggactggaggaggttgcggcttcgttgaggagggctcagagaagcctgagtttggtcaaggagagggtctttgtcactgttaggagccttttaacttaggtgctaattatactagcattttatagacaaagaatctgaagcttagaaagaggctaagcaactcacgaggtccgtaccagtaagcaccctacctggattctagctggcgtgctttctgttccataactttaaagcattgatcatctggaccctgcctgtgatggctcaatttgcttttgctaacctgctgtgagaatcagtgggagtttgcctctgctttaaaattactcatggtcttgctgcccttagtgctgtcaatcctgtgatttccactggagcaacatactcaggttacaacactgggtaacatttacattttagcagctttcttgaaatttaaaatatatgtgtaagtatctcatttatatgcatttctagtttctttatacaacagaataacttcttttacatcaaatttctgaatttgactaaatttagaaataatggaatctcatccattaaatatagtcatagaaggaaggaaatatgaaaattaggatttcagatgtttgaacataaaagataattttaaacattgtcagtaatctatttctttttttttttcgagacggagttttgctctgtcacccaggctggagtgcagtggcacgatcttggcttactgcaccctctgcctcccagttcaagtgattctcctgcctcaacctcctgagtagctgggattacaggggcatgccaacatgccgggctaatttttgcatgccaccatgccaggctgatttttgtatttgtagtggaaatggggtttcgccatattggccaggctggtcttgaactcctgacctcatgtgatccgcccacctcgcctcccgaagtgctgggattataggcatgagccaccgcgcccagcccagtaaaatctatttctatgaaaagctcttcaaatgtaggtgaacgctgtaagctttatgaatcaactgttttctaaatggtaatacatgaaatctgacaattttttatgtgattttattcaattttctaagaaaagtaaaaaatcagatacatagccgctcttctcttgggactagtcttgataccttttgtatttttatatagtgctttgctcatacccttcttgctgttttttgttttgttttgttttgttttgttttttttggtgggggggtgggggatggagttttactcttattgtccaggctggagtgcaatggtgtgatctcggctcactgcaacctccgcctcccaggttcgagcaattctcctgcctcagccttgcaagtagctgggattataggcatgcgccatcacactttgctaattttggtatttttagtggggacagggtttcactatgttggtcaggctggtcttgaactcctgacctcaggtgatctaccctcctcgacctcccacagtgctgggactacaggcgtgagccactgtacccagccccttcttgctatgttttagcctgcaatgctgttcccacttgtgtctatatagcactcctaatttaaatcatacacactgctattctgcagtgatttcttactctttcagtcagggttggtagcttttttctctgggctttcacagtcctgtggaagggcacagggttatcttatctgatacaatgtgtacgaaaggagtaactgtatcatagtaaaagttttatatataagtgaaaatatttacaacactttatccagcttacaagtttttgatatattttgtttctgtgtcttaaacacaatggacaaatacctcatataaagttttatatttttaattgtcatatatttcattatatggatatatcttttttggagacagagtcttgctcttttgctcaggctggagtgcaatagcacgatcgtagctcactgcagcctccaattcctgggctcaagcgatccttccacctcagcctcccaagtagctggaactacaggcatgtgctcccatacctagctaatgttttggtcttatttttgttacttatttatttatttttaaacactttgttgcttaggctagtgtcaaactcctgggctcaaggaatcctcccaaactttggctacccaaagtgctgggattacagatgtgaaccaccatgcctggctggatgtttcataatttacctaactgttcctatgctattgaacagttaagattatttaagtttttaattgttaaaaataaagtcatggtgaatgcctttggacatatatctttgtattttggattattttcttatggcagatttgcaggagttttgttattgggtaaaatggaaagaacatttttcctttattttttaagagaaagggtctggccaggcgctgtggctcacacctgtaatcccagcactttgggaggccgaggcgggcagatcacctgaggtcaggagttcaaaaccagcctggccaacatggcgaaaccccgtctctactaaaaatacaaaaattagccaggcgtggtggtgggtgcctgtaatcccagcgacttgggaggctgacaggagaattacttgaacctgggaggcggagattgcagtgagccgatatcacaccactgcactccagcctgggagacagagcaagagtgtctcaaaaaaaacaaaaaacaaaaaacagacagggtctttcactcaggctgcaatgcagtggtgcaatcatggttctctgcagcctccaactcctaggctccatcaatcctgcctgagcagttcctaggactgcaggtgcgtgccatcatgcccagctgatttctgtatttgttttttttatttgtagagatgaggtcttaccatctttcccagctggtctcagacttctggcctcaagcagtcctcctgccttggcctcccaaaatgctgggattacaggcgtgagccaccgtgcccggccacttttttctactcttgatatacttacctatgatacgctttccaaaggagttgtaacagtttgccctcccaccagtggtgtgagagagggtctctttgctctaacagtattaatatcagatatctgtattaaacttatttattttgaggccttacctctttccttgtggtaaactttctgaactaggttgacctaaagtaaactggtttagattcccaaataaaattgacaaaaactttataagatccattttaaaagttggagtgtcaaggaaataggaaaagctttgttagagagggaaatgttattcagtgaagtacatattgaatgtgtgaacttttcttcagtaacagttgttatcttttaaaaatcttctccatggtatttggaattttaaagcttaatacctctgctggattttgcaagcgtgaaactaaaacacagtgaaatttgaatgtgcaaacatacataaactggaattgtgaataaattagattataaaccaaacacattttgagtataagtgggcctttagaaagttttttatattatgggtagaaggtgaacctttctaaagaaaataagaaattgaggaaatctaggattttcttctttttattttggatctcagtgtgtttgtgatttttaacagaaacgttcttttctgtactttaatggtgcagccagatccatgtaaagaaaaggagtgaaatccccaggaaagatgaccagcagcaggattcttttcagcttttctccctttcctcaggcttgaatatatttcagtgcacctcaatcaagtgaagtgagattaaatatttgagtcatctgtctgttgccttctaaaatggtctggctttctgttggctgcagtctatttagtgttttagtgatgctaatgttattgaatggtttttagttctaaaacttctagtagtgataaatcttgtgcatagaagtcccctaggtcacttagcagagcgcagttggtttttgttaatgactgcattgtcctttgctctcattcgtgatacccagtgacttttcattgatgttgcagtaaggctttttttttgttgttggacttctcccattctttacacattggtaaataatcttcagctgtagcaggaggtagccagcatctatgtgtggatcagatttatcaatatgtacctgtgcagattgcctttatctcctgattgggcaaatacttaacagtccttagcagtctctccattgagttttccaccaactctaactggcaaaaggactcagttgtattggacaggaaaatcttattgtctttgctgtccattgtggcactaaagctgtgaagatgtcatacatgtgaagtattcactggattctcagttacttactcgttatcaaggcttacatgtagccaatttaattttgatgaatatgtttaaatgtagggcattttataattactggctcatggttttttatacagtatgtgcatatttcatttcttttactaccgtctttcagcccatatttaattcatccatttgcagctgttgcactgttttgttgaaactggcttaaaaatctggcaggaggcttccctactttcttgcccttttcggtgttatggtgttattttacacagttagtactttctatgtagtttcttctttcctaaagctgaagggccatatctctcaaacttttctctgcttacctttaaccactgttcgtgccgatgagctgataataccaggcttggttgctggctgtatttagaggtatacaatttaaatacccagagataaaggtgacagtagtaaattagtgcactgtattgtcttaagactaagtgtgatttcagttcttatgctacaacatggaagtttattttaatgttttcctttatgtatgggctttgcaatggttgaaacttgagtttttatttggaagttttggaagacaacttttagattgtctcttttttttttttttgagacggattctcactctgtcgcccaagttggagtgcagaggcgtgatctcggctcactgcaacctctagctcccgagttgaagcgattctcctgcctcagcctcccgaggcatacacgaccacacctggctaatttttttttttttttttttgtatttttagtagagatgggctttcaccatattggcccggctggtctcaaactcctaacctcaggtgatctgcctgcctcggtttcccaaagcactgagattacaggtgtgagccactgtgcctagcctagattatctcttctttagtgactgtatatatctacattacacagatgacaacattttgttttcctgtaacctaggccattacatttttttttcatgtgacaaagtgtttgcaattatttgtgaaattttaattttttcatcacttattaatttatatttgagaggactggaaagtatgtgagttgaaaatagtttaaacttatacaatctcattattaatttggctgttaatttgaatctattccataacttatatttaaaataaaattttgatttgaaaggctcttatctcaatcagtggttcttaaaattattgtttgctgtttagagttatattttttttccaggaagtacttttttagctttcaggaacttgatataatgttttattcttgatgacccactggaaaatagaaccttctagaagaaataaagtcactttattgaagctttatgaatggctctcctatctgcatctgtagggctctacaatctgatttttccaaacaaatagacaaactatggataataacttttcagatgttactttgcagttagttggtggtctggaagaagaaaaaagagcttcaaagaggggactgttaattccatttatctcttgaacaggaattgctttcctgtctttcattgctgtcccttatttttcacctttatgttgtagctaggttttggttttattagctccctgatgaattctctcttcctgccaatattaaagtaaggatgatttagaagaactgaggttaaaatctgcctattgaagctctccaggctagataccctgacatttctctttgtggaaagtaagcaggagtaaagggacaaatcgtccgaaatgccattgagtgttgccaagtgatgtgctgacagctgtacctgacagtgattgctggaccctggtcattcctgagtgtctccttttcacctcccatcccctgctgccactcccccctaacaacaacagaaattctgggaggaatgcctgttccctatttagaggacaacttgagtgatcatgatagtttgtcagatataatgtggacaatgacctttttcagttttagtaataagattcttctttttatcaggttctttatcctttatgcagttttaaaatattacttatgaacaagctgcatatcccttttaggtcatcttgttcttctacttcaaatagcacatgtagaagccacatttgaggctcagggcttcagacatgacaatagggcattgatcaggttggctatatgtttgggatttgtcagttcctttgtccattttttgtctcgctttcagtaccttttctctgtgttttaaaagggctttgtgtacctcttgcctttatgtgtaatcttacagggcagctttcttctttttcattcatttcctgctctaagagtcatctcaagataggaatctggtataagactcacttatagaacagggacataggctcttccagttgttttcattcattgcagattattttaaataagagaaaggtttccttgtatttttctttaatgttttccaattttgaattgttatagatgcaaagcctttaaaaggataatatgtggaggcagtatttgtttggggtatcttttaattgtttttctagatcaaggacagatatagatagattaatacctgaaacgaaaccctaacaactctcaaatatcagataatttttttttatgtttctgaggatgtttttatatcctttgagatatttaaaatatacacatttttatgtttctcccacatttggacatttctttcccctcaatgtttcattgatgccacatttctaccaattttaatcttgtattctatatcttactatcctatagtttcttcaagctgaaattagaccttttgagcaactttaaaacaaatttttaaaaatatttatttataaaagatcaattacacttattaccttagtaccataataaaaatctgtttcaaataaatgagtctgaagatgggaagggacaccattcagtgggtttagaaatagacctgttaaaatacaagtccagctggctgggcacggtgcctcatgcactttgggaggctgaggcgggcagattgcttgtgctcaggagttcaggaccaggctgggcaacatggtgaaaccctgtctctacaaaaatacaaaaattagccaggtgtggtggtacacacctatagtcccagctacttgggagactgaggtaggaggatggcttaagccctggatgtggaggttgtggtgaactgagattgtgccactgctttccagcctgggtgacagagccaggtcctatctcaaaaaattatagaataaataaataagcaagcccaaaggcaatttcattttattttatttagagacagtgtctgactgccgcccaggctgcagtgccagtggtgccatcatagctcactacaacctcgaactcctgggacaaaagcattttttcctgcctcagcctccccaagtagctgggattgtaggcatgtaccacacacccaatttttaagtttgttttttgtagagacagcatcttgctatgttgcccaggctggtcttgaattcctggcctcaagagatcctcctgcctcagcttcccaaagtgctaggagtatcggtgtgagccacctgccctgcttgaattgttttttttttgttgttgttttgtttttttttggagacggagtcttgttctctgttgcccaggctggagtgcagtggcacgatctcagctcactgcaacctaaacctccttgggttcaagcaattctcctgcctcagcctcccgagtagctgggattgcaggtgcccaccaccatgcctggcttatttttgtatttttagtagagatggcattttgccatgttggccaggctggtctcgaactcctaacctcaggtgatccacctgcctcggcttcccaaagtgctgggattacaggtgtgagccaccgcacttggccctgaattgtttaaatatgaagatgaagaggtctctgctgtccttactcctctggcctctaataccttctagccatcttgccttactttggaagggagggagacagatgtagttgttcacagttgagagctgctgaaacactgtgactttatggacagtagtagggagaaagcaagcctaatccgtttataaatgttccattatatacaaaataccctttctaccaacagtaggttcttaattactgacaccaggcatgctttggttgtgactccagcagcgcgggttggtggcatcttacactgaacagcctgggcctccactctccccttctgtaaattttgcctgtcactaattgtttgggcccagtttcttcatttatataagaggattataagatttttgtgaggggatggtcaataattaagtgaaaaacagatgatgtatgttcataatcaccttttagtctctaggtcattaagcctagattagcctattttggtgtattagaaatttgctgattatctggactatgtattagtagtacatgtagaagatttcttttttctgtgtgtgtgtgtgtgtgtgtgtgtgtgtgtgtgtgtgttttcttatagatgtggtctcactctgtttcccaggctgaagtgcagtggtgcaatctcagctcatgcaatgccaccaatccatgttgctggagtcacaaccaaagcatgcctggtctcagtagttaagaacctactgttggtagaaagggtattttgtatataatggaacatttataaatggattaggcttgcttaggcctgggttcaagcaatccttccgccctagactcctaagtaattggaactataggcacatgccaccacgcccagctagtttttgtgtattttttgtagagacggggttttgccacgtcacccagaacagccttgaactcctgtgactgttgtgggaaattgatctagactcaagtgatctccctgcttcggcctccaaaagtgctgggattacaggtgtgagccactgtgcctggcctgtaaatatgtttgaattacctcatttcatcttgcatgcttgttatttttaacatgccttttctccctttaatttttaaaaaatttggctgggcatggtgacgcacgcctgtaatcccagcactttgagaggcataggtgggtggatcacttgaagccaggagtttgagaccaacctggccaacatggtgaaaccctgtgtctgttaaaaaaaaaaaaaaattagccaagtgtggtggcacgcacctgtaatcccagctatttgggaggctgaggcaggagaatcacttgaacccaggaggcggaggctgcagtgagcagagattgtgccactgcactccagcctgagtaacagagcgagactccatctcaaaaaaaaaaaggccggaatcctagcactttgggaggctgaggtgggcggattgcctgagctcaggagttccagaccagcctggtcaacatgatgaaaccccgtctctactaaaaatagaaaaattagctgggcgtggtggtgggtgcctataatcccagctactggagaggctgaggcaggagaagtgcttgaacctggagggcggatgttgcaatgagccaagattgcaccacttcactccagcctgggcgaaagagcgaaactctctctcaaaaaacaaaaaaacaaacaaaaaaatttttttttttttttttttttttttttttttttttttttttagacggagtcttgctccgttgctcaggctggagtgcagtggcactatctcaggtcactgcagcctccgcctcccaggttcaagcgattcccctgcactcagcctcctaagtagctgggattacaggtgctcaccaccacacccagctaatttttatatttttagtagagatggggttttgccatgttggccaggctggtctcgaacacctgacctcaggcgatctgcccacctcggactcccaaagtgctgggtttacaggcgtgagccaccgcacctggccaaaaaaatttgaaaattttcaaacattcaggaaagttgaaagaacagcacaatgacatacttgttttaaaagaccaattacagtttaattatttgatataaagttaagttttaaattatgccagtaattaatactttagacattttattccacatggttaaattttacctttttaactattcaacttagtatttatgtgctagaacctaaaatccctaattgtttatgttttgttttgatttttattttttggaattgttgcatattttctgaataatcttcccatgtttatgatagcaaaacattggaactgaaataacaaatctgtttcaatatacttttttatcatgcaaaatgacattttaataaatattgttttagccaggcacggtggctcacgcctgtaatcctagcactttgggaggctgaggcgggcagatcacctgaggtcaggagttcaggaccagcctggccaacatggtgaaaccctgtctctaccaaagtacaaaaattagccgggcatgatggccggtgcctgtaattccagctactcgggaggctgagatggaaaaatcgcttgaacttgggagatggtggttgcagtgattgcagtgagccgagatcgcaccactgcactccagcctgggtggctgagcgagactctgtctgtgtgtgtgtgtgtgtgtgtgtgtgtgtgtatacacatatatacgtatatataaattgtatatatataaagaaagaatatatatataaagaatatatatgcgtatatatataaagaaataaagttgttttaaggatggtcattctagtttataaatacatgtttattagaggccttctacttatctatatcaacattagggattttaatgtaagtgccaaaattaaggatcatcagtattttttcttttgactttctgtaattggctcttttttcctgaagctgaaatgaagaaagattaaagacttcttaaacatattctagctttggtttaaaaatctgaacattatccaaacttgaagaaactatttacctgtttcttcattgcttaatacttagtctctatgtttttctattttttgtacctaaataaggagtgtttgtctcaataaaatatctaggtccagcaatatgtttagaaaggttttaataacttgctgaaagcatgcattttgtgtaaagtgtggcaaagaaggaaacaattgtactttcactgggaaaagactaaaaggaaatataaataccaagctgttgatagaggttgccttcggagagtggaattgtggatttttttttcacctatcttttcagttttctaaatttcccacaattgtcacctataacctttaaagggggaaagtgtaagcaatcatgatgtaggccctgttgtaaaacagaagtaaatgggactgtgcctatttgcctacttggtgctgcccttttccgtgtgttgtctcctcgccgaagagctccgggcccttagccctgaggtgctgcctctgcttggggctgagcttcctgcactcctgggtaactctcctgctttctaggccacagggccagggacctcagagagaagaatgcctttccttttctctaggtatgtttctgtttgttttcagcgtaggtgacctaccttatgctgctgaagtcccctcatagagatagaactgatttcgttcacttttttcttttcttaactgctctaggctttctgttagattttcaaaaaatgtgtgacttcctgcttacatatggtaaatgtttacacgtcaggaagcttttcctttttgtgtgtaagaagtagaagctcactggacttatatgtcagcattctattaatcttaattcccccattttgtttctgtgatctgctatgacattacaaaaaaaattggtttatctttcttctttcgttttccagtgcctttattgcatggaacagtatcccctgcacccacgcttcaccctggttagtttaccaggctaactactttgtgcctctttggtgaagttcgtattcctaaaagtatgaggttatcatcatgggctctgaatccagactctctcttccattgtttaataactgtataaactgtgttttagtctctggaagagggaatactaataatatttagtccatagctttgttaataggattaaattggctaatataggtcaggtgtacttgcaagcacttaaactttccattcgttattataagctattactattaaggatcatgccagtaaatcctcaccaaaattgacttcattattttggcataatgttattgtagactattatctttgattccgggagtaaggctaagttgtcatttgaatgagataaggacctcgaaatcagttgtaaagacaatcttggccgggcgcggtggctcacacctgtaatcccagcactttgggaggccagggtgggcagatcacgaggtcaggagattgagaccatcctggctaacatggagaaacccatctctactaaaaaaaaaaaaaaaaaaaaaaaatacaaacaaaaacattagccaggcgtggtggcaggtgcctgtagtcccagctacttgggaggctgaggccggagaatggcgtgaacctgggaggcagaggttgcagtgagccgagatcgggccactgcactccagcctgggcaacagagcaagactccgtctcaaaaaaaaaaaaaaaaaaagacaaaatgttttaatgaggagataaaaatcactgaaccagcctgttgtttttatattggatcagtatagctttgtaccgtacctggaaataaaaataaaaatttttcctgagtaaattaataagatgtaggaaagatattaaggtttatttttaagtaagctctaaatagaaatgataatctgattataaaaagaagaatatgaaaaatatttaatatgctagtgctctgactcaaaaattaaaacctacattttttctttattatttgttttttgagacagagtctcgctctatcacccaggctggagtgcagtggcacgatctcagctcactgcaagctctgcctcctgggttcacaccattctcctgcctcagcttcccgagtagctgcgactacaggtgcctgccaccacacccggctaatttttttttttgtatttttagtagagacagggtttcactgtgttagccaggatagtcttgatctcctgacctcatgatccgcccgcctcagcctcccaaagtgctgggattacaggcgtgagccactgcacctggctaaaacctacatttttttcaattctctttttaacatttgaaaattttgcttaatctaaaatatactccagaagtttaaatggaaagaccttaataaaatattcagtcaaatgctcttcctttagaaatggaggtactgaagttcatttctcctatcattctaaattgatgtttcattttgactatatatttagtgagttatggcagtaaaagcagctttaattttttttctgaaagcctactcatattggagccctttataacttgcctcttgaagtatatatatttattcatacaaatcaaacactgatgtctgtgaagtttcatatcatcttttatatttgaattttgttcatatacttattgtcacccaggctggaagtacagtggtgtaatctcagctcactgcaacctctgcctcctgggttcaagtgattctcctgcctcagcctcccgagtagctgggattacaggcatgtgccaccatgctggctaatttttctatttttagtagagatggggtttcgccatgttggccaggctggtctggaactcctgacctcaagtgatctgcccacctcagcctcccaaagtgctgggattacaggcatgagccaccaagtttttaattgatggcattttaaagaatacctcatattttatactttccagacattttccccacttatatgaaatttaaaatgagagtatagctgttatttgttacttggtcataaaggtatttggaaaagcactgatcttagaattttaataaaaggcatttattaccaaaaaaaaaaaaacactggatatattgaccttaaaatgagtaattagtattttccagtaaagcattttggattcaacatagactatgcttcaccctacctcacttctattagaaaaccttttttaaaaagaaattttctttttgtcagctttagtaaataatgtcattcaggattcctattcacaatctgagatctgccacttaacttgctcagaagccttacagtccacaccatttgttctatcctttcaattcaggttttatttgtttatttatttatttattttttttggcgtgctgttgcacaatcttggctcactgcaacctctgccttctgggttcaagtgattctcctgcctcagcctcccgagtagctaaggttacaggcgtgcgctatcacgcccagctaatttttgtatttttagtagagatggggtttcaccatgttagccaggctggtgttgaactcctgacctcaagtgatccacccgcctcggcctcccaaagtgctgggattacaggtgtgagccactgcacctggcctcaattcagtttttaacttgagcttaaacgagatattttttaaaagttaaaatctgtgttgaggcatatcaagaattgctatgtctcttgggggagagatgtgaattccatcaacatagatatgctagtttatagtgaactgttaggaatgctgtacccttgactcatacttagtcttttctttgtggcttgtggctctcttttcaacttcattaacatgtaattgaagtgtactaaatgcatatacttattttttatgttttttcaattttttattttttgtgtgtgttggggggtctcactatgttgcccaggctagtcttgaactcctggcctaaagtgatgctcccaccttggcatcccaaagcactttacagatgtgaggcactgcactttaaatgtgtatatttaaaaatgtacagtttggttagttttgacatgagcatatgcctgtgaaatcatcattcccaagagagcaaacacttctgttcccccaaaaggttcttgtgcctctctgttttgtgtcctttcttctcctcccatcttcaggaaaccactgatggggtttttgtcactataattagtttacattttctagaatttttctggaagtggaatcatagatatatacttcttttttaatctgacttctttcacttagcataataattttgagattcacgcatgttgttgcctgtgtaacagttggttactttttattgccaagtagcatttcattggatggatagatcatcatttgtttattcattgatcagttgattgacatttgggtttcagtttttggctcttaaaaataaagcttgatagtacatttgtatagaaatctttgtgtgggcataaattttcatttctcttaaccaaatacctagaagtagagtggctaggtggagtggtagctgtgtaatgttttaagaaaactatatttttaaaagtttgtacaattttacattcctctcagcagtgtgtagagctgttccacatcctcaccaacactagatgtggtcattctttctcatattagccattctagtggaaatatagtggcatatcagtgtgattttagtttgcatttccctgatgattaataatgttgaacatcttttcatgggtttattgcccatttctagaagttattttacatctcagccatttcctcactgagctgtcttattcttaaattgtaagagttctttagatattgtggatacaagtactttttctaatgtatgtgttgcaagtaagtgttttctttgtggtttgcttttttgttttcataagggttatcttttgaagaactgtttttttgttttttttattactttgaagcccagtttactaattttttcttttttgtttttttttgagatggagttttgctcttgttgcccaggctggagtgcaatggcgcgatctcggctcacagcaacttcgcctcccaggttcaggccattctcctgcctcagcctccagagtagctaggattacaggcatgcgccaccacgcccggctaattttgtatttttagtagagacgggtttctccatgttggtcaggctggtctggaactccggacctcaggtgatccacccgccttggcctcccaaagtgctgggattataggcgtgagccaccgcacccggcctaattttttcttttataaatcatgcttccttgtgttttgagaaattgcctagcctaagttcaggaagatattctcccatcttttaagatttttatatgaagcatatatggttttgcatttaggcctaggacccgttttgaattaatttttgtgtattatgtaaagtgtcagtgttggcttttctccccacctggatatccagttgatccactttgtttgttgaaagacttttttcctccagtgatttgtctttacaactttgccaaaaatcagttaaccaaacgggtaggtctttctgaactcttcttttctgttttattgatctgtctctttacaccaatcccaaaaggccttgactactgttgttttatagtaaatcttgaaatcagggtaaatctttcaactttgttcttttaaaaagttgctctgcttattctaggtctttactatcagcttgccgatttctgccacaaagcctgctgcaattttgattgggattgcattgaatatacaaaccctttggaaagaatggcattttcacagtatttaatctttcaacccatgaacttagtatcttagtaccatttatttaggtcttctttaagttttcttcgcaatattttgtagttctaagtgtagaggccttgtatatgtttttttgtgtgtttgtttgagacggagtttcactcttgttgcccaggctgggcctcccgggttcaagcgattttcatgcctcagcctcccaagtagctggaattacgggcatgtgccaccatgcctggctgattttgtatttttagtggtcaggctggtctcgaactcctgtcctcaggtgactcacccgccttggcttcccaaagtgctgaggttacaggcgtgaggcaccgcgcccagcctgtcttttgttaaatttacatttagaaattttacatattttgatgctactgtaaaacagttgtttttcttaattccactttccaattttttgcttgctagtatttaagaattcagttcattttaatacattaaccttttatcctgcagttttgttaaattcacttattgaatatagttattgttttctagattctctgggattttctatataaatagtgatatctgtaaataaggagagctttatttttactttccaatcttcatgcctattttttgcttgttgtttttcttgtcttattactttattgagtaatctccatatcagtgttgcacagaagtggtaaaagcagatatccttgtcttcttcctgatctcaggctgagaaattcagtctttaaccgttaactgtgatgttagatgtaggttgttcatggatcccctatatctgtttgtagaagtttcctactaattctaatttgctgagaggcatttttttttgtttttttttttttttgagacagagtctcgctttgtcacccgggctggagtgcagtggcatgatctcggctcactgcaagctctgcctcccgggttcacgccattctcctgcctcagcttcccgagtagctgggactgcaggcaccggccaccacgcctggctaattttttgtatttttaggagagacggggtttcaccgtgttagccaggatggtctcgacctcctgacctcgtgaaccgcccgtcccaaagtgctgggattacaggcgtgagccaccacacccggcctggttttttttaatcatgattggatgttgcgtttttgtcagaagcttttaaaaaaatatctgttcacatgatcatatgggctttctgctttattctgctaatatagtatattacattttctgaatggtttaatcttgccatttctaggataaactatttggttatattttagtatcctttttatataatattgatgttcaatttttaatttttgtgaatgatttttgtatctgtattctttagggatcttgttctattattttttgtaacgtctgtgaggttttggtattatagttgtatgacctaaaaaagtgaagtgggtagtgatctcctttttttttgtttgtaaaacttttcataatttttgtattatttcttctttgaaagaattcaccagtgaaacagactatggctttcttttgggggaagttttttgttttttttttttttcttttgagacggagtcttgctccgtcgccaggctggagtgcagtgctgcgatctcggctcactgcaacctccgcctcttgggttcaagtgattctcctgcctcagcctcctgagcagctgggactacaggcgcgtgctaccacacccagctaattattgtatttttagtagagacgttggccaggatggtctcgatctcctgacctcgtgatcccaaagtgctgggattacaggcatgagccaccgcgcctggccggggaaggtttttaatgataaaatcagcttctttaataaatataagagtattcacattctcgtatcaattttagtaagctttattttccaagaaatttgtttcttttatctacactgtcaaatttattggcataaggctttttactatttcttattttttaaatgtttgtaggattgatggggatgccccttatttctacgatttttttttctctctgtatctagctcgaggtttgtaaattttttttttcaaagaaccaaagtttgattttgtaattttctctattgtctgcatttttattcatcctgccatatcactgtaatttcctttcttctacttactgttggtttacatttctttttccaagtttttttctgttattgtttagattactaacatttaatgtaattatcggttgttggaattagacctgccatcttcctattactggttttgtttgtcctttctgtttttttttctttctttcttctgtttcttttttcttgacatctttggatttttaacattccattttcatttgcctcttgactttttggctatgtctttttctgtgtgttgtgtgtgtgtgtgtgtgtgtgtgtgtgtgtgtgtgtgttgtgtaattgctccaggtagtaaatatatttacttaaccttttattatcagcttagagttaatattttatcacttcacatagaatgtagaaggcttgcagccataaaagtccctttaccctccccccagagacatttatgttacagttgtcatatgtgttatatttatgttgaaaccctactacacagtgttacagtatttgctttcaacagtctacatattttaaagaccctaataggaaaaataaatttatatttactcagatgtttgccatttcttttgctctgctttcattcttaaagatctcagcttctctctaaaattttcatttgattctttttaaactagtttttctttctctgctgataacttgtatctttccatgcatttgtgtttgtgtttgcctcatggaaagtaggtgtaatggctgttctacagtctttgtgtgataatctcaacattttcattgtcttggagttggcatctgttgattgcaattttttttttttaagaatttgtcagattttcctacttctttgtatgtccagtagttttggattatatcctggacattgtgagtttcatgttgtatagatgttgtgtgctgttgtaatcctctgcagaatgctgtttgtttcagtaggtatctaacttggttagatctgccttggttatataccagactataaattctctatgctgtctgtggacaggggttcctttctcagttcagttttcaagaccagtgagtgctgtgcttctttgagcctgccgtgcatatccatatctcaggtgtgagcctaagacaagcgggagttaattcacacaatggcaggtcccatttctaccttctttcctctctggttttccccacactttacagcccacaggtgcctttttcattagttcctttaaccacaaagaccgtgtttctgttggagttttagtctctgcacctgtgcttcactgcatagctccctgactggggcccacctgtggggcagagttgtagagaaaagacaaaaaagaaagtttttactccatggaaaggaaactttttagaaactttttactcacctcccaaatctgcctgcttttgtctacttcttattgtcctcaagtattatagttacattttgtgttctgtctgctatagcagaagcagaactctggtttgtgacattttattttatttttatttttgagactgagtcttgctcttgctgcccaggctggagtgctgtggcaggatctcggttcactgtaacctctgcctcctgggttcaagcgattcttgagcctcaccctcctgagtagctgggattacgagtgcccaccaccacgcccatctaatttttgtatttttattagagacagggttttatcatgttggccaggctggtcacgaactcctgacctcaagtgatccgcctgccttggcctcgcaaagtgctgggattccaggtgggagccaccgtgcctgaccaggttttgtgacattatttaatgtgttggatatgtgattattctttttcaacatggtagcctttttttgtttttgtttttgagacggagtcttgctccgtctcccaggctggagtgcggtggcacgatctaggctcactgcaagctctgcctcccaggttcacgccattctcctgcctcagcctcccgagtagctgggactacaggcgcccgccaccacgcctggctaattttttttggtatttttagtagagacggggtttcaccatgttagccaggatggtctcaatctgctgacctcatgatctgcttgcctcggcctcccagagtgctgggattacaggcgtgagcaccactcccggtctcaacatggtagccttttacaaattactatatttttttcaaattgtagtaattcatacagcaagcatatataatggtaggacaaaacaccttaagccaagatgtcatctccatggtctgtccaggtagcatagaacacaaaaggagatgtgattgaaagatgttgcttcatctacatgtttctactattgtctggggttccttaggagccaaggagaacctcgctgtgattggcattggaaagacctgtggttggaagaaaattacctgggaacattccagcctcatcttttttttttttttttttttttttgagacggagtcttgctctgtcacccaagctggagtgcagtggcgctatctcggctcactgcaacctccggctctcgggttcaagcaattctcctgcctcagcctcctgagtagctgggactacaggcatgtgccaccacaccgggctaattttttgtttggtggagacggggttttaccgtgttagccaggatggtctccatctcttgacctcgtgatccacccgccttggcctcccaaagtgctggaattacaggcgtgagccaccgcccctggcccagcctcatctttaagccataatttggctattgtgttagtgaataaacctgaaaggtacatcttcattcatacataaacataatttagttttcattaggtagattccttgttcacatccagctgagaacatgacactaaagaaatcgggctttaattggggagggaaagagagagaacgtggagtccctttggttgtcacttaagagatacagatgaaggagaagtagagttggaggtcagaagggccagaaggtaaatgtagtctaatattagtcatagtgaggtgaaggcttttggagggtagagattcacctagggtgagaattatttcctaagttctagagtagcatggtaaataacaaatagtcttaggtgctttgtcaggaactgataatgactacaagtatatttgaaatcataagagttatatttatgtttgctgtgatcctctcatagtagctgtgaaatatttaaagtaaggcataaaattattatatctatatctatatctataagtaaaaatggtctattttaatgccttcagtatcatagttgagtattaagctaatgctaacttcataaaatcattttttcctaagataatttttgagatttataggaaggtagaaatgcatgcatttcctctggatttgccatttgttgcatagtattatgtataacattttcttaaacaaaaagcttaaagaaaatattagcaaatcaaacctagctgtgtagtgaaagaataacatgcatatatgaattggtctattgtacaaattctaggataattcagtatttgcaaatatgtcactataattcagaatgtaagtaaaggagaaattcattatctcactagatgcttaaagaaagcttctgaaaaaaatttagccatttcttaataaaattataaaaaataggaatagaaggaaactacataaatatggtaaataatctttactaaaatacaacaacaaaccaacctattaaaatatgaaataccaaaactgtcactgtgaaagtcacaggcaatacaaaaattattgctatcacaactattttgtatagcttagtattattgctttgggctagtaatgtaaggctaaattctttatttccagaaaatataggtctaggaaatctaaagagattcatatgtgagactattagcactaataagaaagtatggtaaagtagctggatacaaagaagagaaatcaataacctctttattttgcaacacagtaaaaaaatggaagtaaaactgaatgaacagaatgtattctcatatatattaaatatctgttttactatgcatttaaaatccagagcttaccatttttgggaaactctacaaaaagatatatgacatgttgattccaaaaggattttatgaggactaagtgagataaaacacactaaaatgttcaagagaattatcaaggttgcctatacaatatattgaatgagaaattgtcgaggaaaagaaaggcagctgcaatttctaaagggaatctacagtgagaagtagtctgattcacaaacctctggttaaatatggtgtcttgactacacttgttttctccttccctaaagtctgcaataatctcaaaggaagcttaaaaatgttaattcatagctgggcagatggggtgttgtcacctgtaatcccagctacttcggaggcagaggcaggagaattgcttgaacccaggaggtggaggttgcagtgagccaagattgcaccactgcactccagcctggggacggagtgagactctgtctcaataaataaataaaataataaaatacataaataagtgaaatcttaattcataaggagaaacataacagtaaaggagacagtgaccaaagattttaacaatttttcaaaacagaaagtgaatggagggagtagtaactgagttcacagagaaagataccacctaagtacctgcagaggtcagttatggagataacagcatgccccagggatatcttgagagagttccttgtgcttgggggctccacgtattccaaaaggctgaagtcagttttacagctcacagtggaaattccttaaaagtccatatccagatctcttagaccttcctctcctacactccagcagatgggtaactacttcagtcccgtctgctggggaaatgggaggagcgctagaaccggaagtgctccagactagagaggtgaagcacgggattgaaagtcaagtgagcctgtacaggtctgcacactgaagtgtagggccctacctccttccttcttcactcctcctcaaggcagcacttagatgagttgatcccttcacaccccacccagcagttcgttctacctggcaaaacttaacagcttcggtgaagaaacctccacattactgaacatttggaggtgtcccaatgaaaaggtaactcaatatacctgatcattttacagagaagcccatcagtcaacaagcttgccacccacgctgagcttgggcagttttttagtgcctcattattaaatatggaggcgcatccagggaccactagatatacaaggaaaaccttaaaagtgaaagagacgaccgagacaggcggatcacaaggtcaggagttcgagaccagcctggccaacatggtgaaactccatctctactaaaaatacaaaaattagccgggcatggtggggcgagcctgtaatcccagctactcaggaggctgaggcaagagaattgcttgaacctgggaggcagaggttgcagtgagctgagatcgcctgggcaacaaagcaagactccgtctcaaaaaaaaaaaaaagtgaaagagacccagtcaatgagccaatgaacaaaaaaggaacccagaggaatccaatgatccaagaaacagaagaacagagaacaagaaagtgcttttggaaatttaaaaatgtgatagttggaaaaaacttctgtggacaaattggaagatgaaattgagatgtattagggcaagagactcattttttttaatttaaatttaagattttaaatctgtgagtatttagtactcattctttttttttttttaatttttgtttttgagacagggtctctctccagttgctcaggctggagtacagtgacaccgtcttagctcactgtagccttgacctcccgagctcaggttattctgccacctcagcctcctgagtagctgggactacaggctcatgcaaccacgcctggctaatttttgtatttttactagaaacagggttttgccatgttgcccaggctgatcttgaactcttggactcaagtgatctgcccgactcagcctctcaaagtgctgggattacaggtgtgagccactgtgcccagtcaatactcatttttaactgtgcatttaccctgttaaattaaacgtaaggaaaaatattcactaaatctggatttttttgagacggagtctggctaagtcacccaggctggagtgcaggggtgcaatctcggctcactgcaagctccatctcctgggttcacgccattctcctgcctcagcctcccgagtagctgggactacaggcgcccgccaccacgcccagctaattttttttgtgtgtgtgtgtgtttccagtagagatggggttttaccgtgttagctaggatggtctcgatctcctgaccttgtgatccgcccgccttggcctcccaaagttctgggattacaggcgtgagccactgcgcccggccctaaatctggatttttgtttttagttagagaagaggactggctttttttcacatcggctgttgatgaataaataatgcctgatggagatttttggagcattagatttgtgtttggtagtctgggacagatgttagtgtaatatgcattgtttacaggatatggagttagcaggacagctaactccacagcgtttggtcaccaaacgaatgatatcgtgctaatcacgtaccctttctgattttcatttacctgatccataatatggggatggtaataatggtaacctatctcacagggctgtgatgatgagtagaagagataagacctataataaattacctagtataatgtgtagcatgtactaaatgctcaatgaaaagaagctttgattataaccatcaagtagatggactggtaattatagatggttaagaaaaaggtacagtcagccctccgtatccatgggtttcacagagtccataggttcagcctaccatagattgaaaacatttgggggaagaaattatgtctatactaaacatgtacagacttttaagcttacagaataacagttgtttacatagcatttaccttgtattaaatattgtaagtaatctagagattatttgaagtatgcaagaggacgtgcttaggttatatgcaaatactgtgccattttatatcagggacttgaggatccacggatttttttttaatccatgggaggtcttggaaccagtgttcctgggataatgagggacaactgtatacttaaaaagtaacacgtgaatgaatgaattccttaattgtagagctatgctctggctctagtattagtcctctgaccattaaagatagcatgttggtgtgtttatgattatacaggaattaagttttcataaacttaaatgttgcattttcacttacaggcgtcgattagcaaggtaaaagtaacagaaccatggctcagtttccaacaccttttggtggtaagttttcagaaatttctctttttaatgtactttgggaccagattttaaaaacttgatattatggcaaatttaaaattaaaaagtagagaaaataatataatcagcattcatgtattccatcatatagtttcattaattatcaactcatgcccaatattgtttcatctggattcttttggagcaactcccaggcatcatttcatctataaatattttagtatgtgtacctaaaagataagaaaacgtttaaagacataacttcagtaccattatcacatctataaaaatttacaataccgggccgggcatggtggctcacgcctgtaatcccagcactttgggaggccgaggctggtggatcacctgaggtctggagttcaagaccagcctggccaacatagtgaaaccctgtctctatgaaaaatacaaaaattagccgggcgtggtggcaggcacctgtagtcccagctacttgggaggctgaggcaggagaatgacatgaacccgggaggcggaggttgcagtgagccgaggtcgcaccactgcactccagcctgggcgacagagcaagactccatctctaaataaacaaacaaacaaacaataccatattattgtacctgtaaaatgttcgctacatctagtctgtaccttatagtctttggacatttccctgatagtctttagacatttcttgttatggtttgtttgtttaaattgggatccaaataagatacaaacattgcaattaggtcatgtgtttcccaagtctcttagtgaattttcccccactcctctgtttttttatcagcaagttatttgttgaagtgatggggtcatttacactttttcaaagcctggatttgaagcatgacatttttgtttgttttacttcagttaaactaaacataagtttgaaacatatcagtctgcataaaatgtgttttttgggtaatttttcctaatgttattaggaaattgttaagtgttcttgcttacacccaagttactttttaacaaaaatacttattaaaaagtacttattaaaaaatacttattaaaagttcatattaacggattactcttggaagctgtctaatcttgtcatgaagagagtaaaagtctccgtgggattctggtacagagatctgtaaacttttaaaaatcactagttattctattttatttttgtcccccttcttaattactgtacaatttctggtttttgtttatagttacagggatgaattctgacagggcagtgaaaatttcttctagaagttgcagaactgtaaggcctgtgaggaaggggtcatttctgtcttggacacccgttcatccccacagtaaatatttttccagtgactgaatggatttttactttatctgtcagtgtcatcccagacccggtagagaggagagatgcaatgtttagatgtttttgctggtgtgctgggcacattcacattttgtgtgaaacatacgtattgtgtattcccagttttgtggaaggtgtccgagcttttgaaagctttcatgtatgtaatctagaattattttagtcaatttgaggagacctaggactaaagtctgcaagatctcagtcgtgagtggacatctagtcagcctaagagctgaaactgaaggaaaacctaaaacccattctctttggctattatttcatatcaggacatcccctgcccttctttttttttaagtctgtttcctgcatactgagatacctgtttttaaaaacagctttagtgaaatataatttatattccataaaatttactagctttagttgtataataatttttagcaaattatatagagttgtgcagccatcaccacaatctaatatattaatattttaatcaccccccaaaagattttcatggatatttatcacactcaccttcttctttcataacttttgcctgtggcatttaaggcacttgagagtacagttttaggtttaagttaatttagtctgttgcttgggtttatgtaagtaaattattaatttactataatcttgctaactatgggattataaaacaagtttctaaaaaaggaatgtgtgcctcttcttttctttccctcccattctctctctttctgtttcttacattttgtgtcctgttttacacttttctaactttatatgcataacttccaaggacaagaagatgtgaatttatcaagtctttataatacattgacagaatcttgaagtgctgtggaaatagtgtgtgagagcattttgttttccttttctcactgaataatttgtttgtcttttctttggattttaggcagcctggatatctgggccataactgtagaggaaagagcgaagcatgatcagcagttccatagtttaaagccaatatctggattcattactggtaatcacagtcagcattttttcatttttacttatcagtagtgcagatgtctgtggaaactctatcatgcaaagacgagatgggcaaatatgaccaaggagagacatttacctgttttgccctaaccttgtgcctgtccttttacaatttttttacacataatggaatcataccttgtttgcaatttttagtgcatgtcaaaccacttgttttgtgcatgtaatttatgggaattggttaagatcaaaggaccaatggctcacacctgtaatcccagcactctgggaggccgaggtgggcagatcccttgaggtcaggagttccaaaccagcctggccaacatggtgaaaccccgtctctactaaaaataaaaaattagctgggtgtcgtggtgggcgcctgtaatcccagctacttggaggctgaggcaggagaattgtttgaaccctagaggcagaggttgcagtgagccgagatcacgccactgcactccagcctgggtgacagagcgagactccatctcaaaaataaacaaactaattttcctgtttgattatttttcagaattcactttataaaaagtggaatctttatttccaggggaattgttctgctaccatgcccagctaattttttcttcttctttttttttttgagacagaatttcgctcttgttacccaggctggagtacaatggcgtgatctcggctcactgcaacctccccttccagtttcaaacgattctcctgcctcagcctccgaagtagctgggattacaggcacccactaccatgcccagcttattttttatatttttagtagagatggggcttcaccatgttggccaggctggtcttgaacttctgacctcaggtgtcgttcttaatcattgttatttattctctgtaaatacttcagaagtacccagaatttggagtataggtattgggaatggcaaataactttttttataaagtgaaagtatgggtcatcagtttcctaaggatttctataaatgtgcttttgcacaatgggtagctgttcatatcttagttaatagcagattaattaaagtggaaaatctatgccaggaaatggtaggccctttttgagatgattttttgaattctaaagtcagtgctgatggattcttttactgttgcctatgggcttatccttggacttttataatgcactcaactggtatttatagtattaccagcctctttgtaaattttgtaattttgctattacaggatttctgtcagctgttgtttttttttttttttcctgaaactttttctgtttaatttacaggtgatcaagctagaaactttttttttcaatctgggttacctcaacctgttttagcacagatatggtaagttggaattttacatgaaattttacataagcataaggcaaaataaaatatcgttttgttctatttggtaatatgatttcttatgttataaaaggagaacatgtatctctagcctgaaatatcttgttacttcttaccagagagttatgtctgaaaagtgtctttctcatatggaactaaaacaaaacaacaaaaaaagtggtgacatttgaatgacaacactgtcaaaaagttgaatttccatggagacatctaaattttggtgttccttcaccaattagttttggcttcacccatatcacccacatttatttgaatgtcccacatttcttgctttataatggaatgattttttatctttcattgactgaagaataaaaggtaaagaaaatatttgagagttagtgcatggtaaatccataacattaatagataatagtgaattatttgactatcacaaataggcattcaatcttttaagccacaggaaatacagagagtataataaaaagggtggcaaatacagttttggattcttggctcatggctttggagagccatgctgaattctgttgtcctctaagatgtctcatttttttcaccaagggtgcttaatacttcacttccctgagttaattagtgatacgaaggcagctcgctatgaagaaagagcatgtaggctgggcgcggtggctcatgcctgtaatcccagcactttgggaggccgaggcgggcggatcacgaggtcaggagatggagaccatcctggataacacggtgaaaccccatctctcctaaaaatacaaaaaattagccaggtgtggtggcgggcgcctgtagtcccagctactcgggaggctgaggcaggagaatgatgtgaacccaggaggcagagcttgcagtgagccgagatcatgccactgcactccagcctgggcgacagagcgagactccgtctccaaaaaaaaaagagcatgtgatttgtagtcgtacacctgagtttgattcccaggtgtaccattttcagtgtctctgatttggagatacagttaccctctttgacctcaagttttctaatctagaaaataggaatggttatagttttgtgagagttgttgagaggattccagaaaaaccaaggacttattgtggctcctgtcacataataggccctcaaagtaaaacccaaaaaggtatcatctccaggggctgggtattctacataactgaattttccagctaactactttgtcctcttaaattaccaaacttttaaatttataatcttgtggaaattaataaaggttgatacagctttttgtttcttttaagcacagtctacagaacacaatctaagcttttcttgatgaaatgtcatcattatgaaaattagtaactgtcctgaaatagcaaaactttcacaggagattgtgtgtgtgtgtttgtgtgtgtgtgtgtgtgtatttggatatatttgaattgaaacgaaatgataccagatctctgtgctttttttgggtatctgctttattttctttttcctggttgtcagcatattggccgccagactgtctctaaactagtgtgcttgctcctctgaagccattctaattctaacttctgatctattagagctaaaaaatcagataaccaagcggttttggaattacagtttaagtaaagtaagatgctcagatgaagaaacagcctgcaagaaagaagtcatgtgcaagtgagcacagaagccctgttctgtcagttaaatgtgaaagtttaaacgcaagagacctgtggcacctttgtgaattttaacaagcttctgctttgcagctcatacatgatcatgtctcataccatcaggacctctcgctggaaccttcttccgcagacttaacttcctccactggattatgcttttgtgttatattcccaatttttcaaagttcatttattctttcaacattgaaaaattatttatcagatatctcctgtgggccagggactgttaagaggtgctgcggatatagcaatgaacaaaatagacagaatccattcttttactgaaacggcagtctagtggagggagacaataacaacacaaaaattgtcacatggtggtaagtgtggtggagaaaaataaaatacactctaatgaatttcattttttttcttctgttttttgtaaaggtgggatcttgctatgttgtccatgctggtctcgaactcctggactcaggccatcttcctgcctttgcctcccaaagtgctgggattataggtgtggccaccatgcctggcaaagacaactgtcttaattgaaaaaagtgacatttggctgggtgtggtggcccacgtctgtaatctcaatgctttgggaggccaaggtgggagcatcgcttgcgcccaggagtttgagaccaacctgggcaatataatgagccctcatctttaaaaaaaaaaaaaaaattttttttttttgtttttttttttttttttttgagatggagttttgcccttgttgtccaggctggattgcaatggcacgatcttagctcactgcaacctctgcctcccggcttcaagcgattctcctgcctcagcctcctgagtagctgggattacaggcgtacaccaccacgcctggctgattttggtatttttagtagagatgggatttcaccatgttggtcatgctggtctcaaactcctgaccttgtgatccacctgcctcgacctcccaaagtgctgggattacaggcgtgagtcactgtgcccggccaaaaaaattttttttaattagctgggcattgtggtgcatgcctgtagtcttagctgctagggaggctgaagtgggaggattgcttgagccctggagtttgaggctgcagtcagctatgattgtgccttctagcgtgggtgacagagcaagaccctgtctctaaaaaataaaaacagttgtcctaactttctaaactatttttacctgagtggcccaaagtcaggtttttataatgactatgtatattaattaaagatggtaatgtggcaatcttagattgaatgaatctttaatttttttcttacgttttgctaaataaatttgtgatggcgtattttactatcaaaaatgtctgtaactctcttttcccaaaagaaatgtctttgaaaagtcattggaaatttcatgaaccactgatatcctgcccagatgatggaataatgcagtgcaaattatgagtttagcaagatctgcctttcaactgagctgatttgatacttattcacatagtaaccctgagtagtacttgatctcttaaagcctaggtttttttgtttgtttgtttgtgtttatgttttgagacggagtcttgctctgttgctcaggctggagtgcaatggcacgatcttagctcactgcaacctctgcctcccaggttcaagtgattctcctgcctcagcctcccaagtagctgagattacaggtgcccacgaccatgcccgcctaacctttgtatttttagtagagacaggttttcaccatgttggctagcctggtctcgaactcctgacctgaagtgatctgcctgcctcggcctcccaaagtgctagaattacaggcatgacccactgcagccggccaagcctaggtttttaaaattgcaactaataatagctgatctaaagaagcagctccctccaacccccatactatttttatgttcttctgtgatttttctggtagggtcccagggtaagtccttactccttttggtagacggaagaatgggtttgactctgaagttttaggcagtccttgtgtcagtcatctggggaagaagataattttttgcttttttgtttgtttttgagacagggtcttactctgtcaccaagactggagtgcagtggcatgatcatagctcactgcagcctcaatattctgggctcaaacaatcctccggactcaaacaatcctcccacctcagcctcctgagtagctgagtctacaggcatacaccaccatgcctggctaatttttgtattttatgtagagatggggttttgtcatgttgcccaggctggtcttgaactcctagattcaagccgtctgcccgcctcagcctcccaaagtgctgggattataggcattagccatcacatccagcaaagaagagaagtttggattaagaattggaaactgtgtctagtttctctctctgagctttacttactttgttctggactttgtttcaaatatttgagtgatacgaactgatggacagtatatgttagaaacctttattatgttttatttccatgtagaaactatattccagttaactaatttgttaactttcaactgtaatctgttaatgctttggggactccttgtctctcctggctgatttccaattaagaatacaagaaaaccttaattctcggaggatggagtcaagtcagtgtgtgtcatgccaaattataaccgtggccaaagatggtacatcttcctagaaattgtcttattaataaggagctggaaggaggttggcagatatccttttggcaattgaagtgcttagaattttttcaactttgctatgatgtggaggggaggagaataaagcagtgggaatagacaagagccagaaggtacaggaaggaagaagagacggggtgaagaggctggatgagggctctggaatctgagacggagggccagcagaaatggagagaaaagagggagtgagggagcactacctggaaatgggccctgagaggaaagaagggagccagacacatgaaggcaaggattagatcaactttgtgatctggttcagaatgggtgtcagggcaaacagccatatagtcatagtttgtactttcttaagacactcctgagtatgtgtcagaagggccttcagccccaacaagatcaatttgctaaactcatacaaaaaaaaaaaaaaaaaagaataagcaccctggactcttgatcccctctcctccatccctcattcctgagtctttaccatccagtagctcatggcgttgaactaagatgacatcttagttacctggctgcccaaaccaacacctgggcaccgtgcttgatttccctcttttcttcaccctgcatacccagtccatcaacgtaattgcatttacggactttatccccaatctggccacttctttcctactgctaccatcctaacctgtcatctcacctgggcccactgttcgagcatctggactgggttctctctttcacacttgcccctttagagtctagtctccaaacagcagctggaattttttttttttttttttgagacaaagtctcactctgtcgcccaagctgggcagtggcgcaatctgggctcactgcaacctctgtctcccgggtctaagtgattcttctgcatcagcaccttgactaactgggattacaggtgcacactaccatgcctggctaatttttgtatttttagtagagacggggtttcaccatgtcagccaggctgggctcgaactcctgacctcagatgatccacctgcctcggcctctcaaagtgctgggattataggcatgagccaccgcacccggccaggaataatcttttgaggagtgcagtggtgcgatctcagctcactgcaacctctgcctcacagcttcaagtgattctcctgcctcagcctcccgagtagctgggactacaggcgcgcgccactatgcccagctaatttttgtatttttagtagcagggtttcaccatgttgggcaggatggtctggatctcctgacattgtgatccgcctgcctcggcctcccaaagtgctgggattacaggcttgagccaccctgcccagccttcttcctgttctttaaatgggccaggtttctccttgcctcagggtcattgtacttagtgtttcctcttcctataattcagttgctctagttcctcacatcgcaggttcattgcctttcaggtttcagttcatatgtcacctccccaaagtggcattccctgaccagctagtgtaaagtggtcccctctgcccacctctttccctttaccttggtagcacttatcaccatgtaaaataatctggtttgttctcttgttagttctgcttgcactaaaatataagctctgtggtgctaggaactgtgtctttttcatagatataaccccaatttccagatagatgcccagccccccactcccccctgccccataattggtttttgaatgaatgagaatgaatgactggattagtctgcactgctgctgggtctcacctccagcccaaggggcagcaggtgagagatgagcagcctgaggccaggctttgtggatgaactgggctcctaaaggaatctgtaggtgccaacactgcagggaatgaggtgggacaagaggagcctggcctcatcccttcatcctgtaacacacacaaagtagtttcagaattgttacattcacctccactacaaacaacaaatttaggcccagtgcagtggctcatgcctgtaatctcagcactttgggaggtcgaggcaggaggatcacttgagcccaggagtttgagacctgcctgggcaacatagtgagaccccgtctctactttaaaaaaaaaattatccaggtatggtggcacatgcctgtagtctcagctactcagaggatggggtgggaggatcacttgagctgaggattcaagcctgcattgcgctatgattgtgccactgtactccagcctgggcaacagagtgagaccctgtctcaaacaaacaaacaaataaaaaaaaaaaaaagaacctagtaagtagtgtaaaccaaaaagtatctgagacaagaggtctcaatcattttaggagtttattttgctaaagttaaggacatgccgggaggaaataagcacagaatcacagaaactgtgcttttctccaacgatgattttgatggcttcagtatttaaagggaacaggtaggctggagggcaaagagggaggatatggtaatccatatattgccagagaaaaggagcaggcaggggaatagtcagttaggtaatagtaaatcagtaaagtgctcagtaagtcggcactttacataagataaaatggaacataaagtagcctgtagaggtgtttgaccttttatttgtagctccctgcttaggaacaaagggactcagctttcagggactcagctttcagcttacttttctaccttttgcatagtgaattgaagtcctgcgtttttattttcctttcacagtagatttcaagattactttgtagttccttttgtttttaaacagaggacatataaagtactatgtgaagttacttggactaggcttttttttctacctcttacgtggatatgttagttatttataatatgattaggtttattttcatttttatttaatttagatatgcctcctcatctttgtggacttaattttattatttaaatacataacagattaaaaaggttctaaaaaccgaaactaacaaaaaggtgtgctcagacaaggtcactccctcttctatccctttaccctgtttccacccattgtattagtttcctgttatccttcatttatttttgttggaaaaaagcaggtacataatgtatataacgtgtatgtattcatatttaaattacttcctttcctccttacattaaggtaacctgctataaatgctctctgttcttttttttttttttttttttttttttttctggagacagagtcttgctctgtcacccaggctggagtgcagtgacgtgatctcggctcactgcaacctccatctcctaggtttaagcaactctctgcctcagcctcctgagtagctgggattacaggcacgtgccaccatgcccagctaattttttgtatttttagtagagatggggtttcaccatcttggccaggctggtcttgaactcctgacctcatgatccacccttctcggcctcccaaagtgctgggattacaggcgtgagccaccgtgcccagcctgtttttttgtttttgtttttgtttgagatggagtcttgctccgtcacccaggctggaggtgctatcttaggtcactgcaacctccgtctcccaggttcaagcaattctcatgcctcagtctcccaaatagctgggactacaggcgcccgcgtgcccagccaatttttgtgtttttagtagagacagggtttcaccttgttggtcagactggtctcgaactcctgacctcaggtgatccacctgcctcggcctcccaaagtgctgggattagaggcatgagccaccgcgcccagccgtaactaccatatttccataaatttcttagaattttcattaccagggattccccacagttatgtttattgagaaaagcgttttttgagtatcacgacattttcaactaaatgttgggattgtcgtatgtggtttaaagtcaagtccctagaacctcatggttaagtttcttctcctcacccatgaaaacacttctgtaggacacctttagagtctaattaagccattacctaaagtcttctcccctaacctactcattatcccacactggatattcctgtttctcaccagagaccatactgggcagtggtgtggggaacagggagtgggcacctgcctgactgattgattggttttagtgtgcatgttgatgttgatttttattaatgggaactcttccccaccaaaccgttttaaatagttgcgtatcttttaaaaaactacttagcaaaagaaggaagttcaccatttcattttatttacttagtttcctttataaaacctgaaaggtagtacaaaaataaagcaaccagaagccagtttcatttatgagcatagatccaaaaaagtcaaaatcttagcaaatagaatttcacaatgtatgaaaagaatacacaatgaccaactttatgccagaggtgcaagattggttcagagtcgaaaaattctatcaacattagtcattatttcagcagataaaaggaagaagaaaacttgtgatcggattggtaattacagattaggcacccgatgaaaaatacagtaaccatttctaataagtagaaaggaaactacttaaatatgtgagactactatccatgaaaagagtcaaactctgtaaaatatttgaaaaggtttattccaagccgaatatgagtcaccaatggcctgtgacacagccctcaggagatcctgagaccatttgcccaaggtggttggtatataacatggttttatacattttagggagacataagacatcaatcaatatatgtaaaatgtacactatttcggtctggaacaatgggacaactggaagcagaggcttccaggtcatacgtggattcaagagtttttaattggcatttcattgaaagagttattatccaaagagctggaatcaatagaagggaatgtgtgggttatcataagtggttttggagaacaaagttttgtcatgcgggtgaagcctcccggtagtagacttcagagaaaatagatggtaaatatttcttatcagactttaagagcctcctttatcagtcttaaggcctgtgttgatgctaatgctggtcagctgggcctgaattccaaaagggaggagggtataatgaggcatgtctgacttcctcttcccatcttggcttgaactagtttttcaggttaattttgaaatgcccttggctgagatgaggggtccattcagatggtggggggctcaaaattttgttttcagtttacattactttccagaaatcactaccaactgtcattctaaacaatgaactctattaaactattagctctagtaaatctactgtttcatttaaactcagaactgagcaagaacgcattcagtaatgtcttagaaggcagtaagaccaataaaaaagattggcctaaatattggaaaagaaagataatgctcatttttttctagttatgtgattgtatacttagtacacccaagagattttagttttaaaacattaataagaacttgtaggagtctggtaggatagctaaatacagcctaaataattttttaaaataaaaaatgttctctgtgcttgaaataagcacctaaaaatggaaatggggggaatgtttcatctaaaatctggcaaaaatgataaaattcttcagaatacatttagcaagaaaagcatattatatgaaaaaagtgatacaattttattaaaggaaatagtatatttgaacaaccggaaagattgtcttttctttggttgggtaaactattggtgcaaaagcaattgtggtttaatcaattctccaaaaatccccttctaaggcagtttttggatcccagtagggttgtttgtataacagataaaataatctaaatgttcataggaaaatagacacccatgaataaccaagggggaaaaaaaaccttcccagaccttcccggatcacaatataccagagagccagtgtgatcaaatcattgtaatattgacctggaaattgttcagtcagaacagatagtccagaaatagttctcacttcatatgaacatttgatacatgataaaaatgtatattagttcagtgagaagaagagggattgattaataaatattactgggaaagctaggaatccatgtagaagaaatgtgattggaccctggaataactcccccacccctacccataattattggtttaaggattgaaatgaaataaaataatacaatgttagaaaatcaaggactaacaaccttctaatcatatgataaaagaaatattttatatacaaaaatttagaatttttatgccgtacatatacataaatcaacaaataatgaatttttaaaagtctttcagcagtcagcagataaacagttaatttgtgatacactatgagctcttataaactaacaacaaaagacatgcaatatatagaaaatttggcaaaggatttgaataagcagttcatagaagtgcaaatccaaatggccacgaaatacagaaaaatgatgctcaggttcacaagtagtgagaagaattcagattctgaattctttgctgaagggcccatgactacaggagaatggggaactcctatctgaggcaaaaaggtttctgcaaccacagagctttgtttcctgcgttatgatccttattttctaaaatgtgccaacttttacaatcttgatcacttttagagatttttttatctttgtcttatgccatactttttattgtgttacatgttttctttctttgagttaattccagctatgcagaattgttttctgtgtaacttaattttcttttgtgaacactgtccggatatggctcagtctaaaagatcatggtattttaattgaactgtcttatttagatctttcaaatacatttttcataatattggtttaaaaaaatcctcatgcttttaatatctggattaaaagaaataaaatctgaataaaacttttttatgcagaagaggttaagtcatgaatatgcacagttttgatgatataatgtagtttccagttacaaggacaaacttttgcttacttgatcttagccaaaaggccgagaagcgattccttttgcttactcttctttgagaaaatactttacattaaagctcattacagtttgcacttggaccgtgtatatttgagtaccattttcaaatagcagacacattttgtaagctaacttacaaaattgttgagtgatatggggcatgattctaaagaaaagttagtttcaagagctttagaggtttagtagcattatagttgagtaaccctagcatagcataagtaggtagcatagcatactgtgtcatgttcccacattgaggtttgtagagctctacaaagaatgcaatctaagtatctctagcaatattaacattccgcttctaaatctttttcttttctaatagctttattgtgaaagaattcacataataaaatttactcgtttaaagtatctaattcattggttttagtttattcacagagttgtgcgacagtcactattagctaattttagaatgttttcatcacttcagaaagaaaccccttttgatgtctaaagtacaaatcctcacactgaggctgaaaattacctgctaaagtggcagagtgaaagatattttatgtttatataaaacttggccagtatttacaggctattccccatagtttggtaaacagttatgttttctgttgttgtctctaggggtaagagtgctaattattttgttttcgtgttggtgggagtggtggttttggaaaggttcttttatggtcacagttgttctcaggccatgctgttggtttgcagggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtaagtctgaaaatgaattggtttctgtattttcttgtatattttaaaaataaatgttttcctttttttccctctcggtttataacattatgaaattctaggaggtaattctgtctgaaaaatgatggccccctgcaggaagatagtgctggggagaagaaggagcatgttcacatttgaaccctgggatgtaaagtaatcaaaatgaaagcagagatgcaggccgccagtcaggggaaaaggaagaaacttacagtccgctgctgcagcttctgggtttttttttttttttctcttccattatccttcaggttgttgcatacttccttttgattttcggtttccataatgtctgtttctccttgtgcataaacaattcctttggattatggcatctagaaatatatatattttgaatcacagtactgagtcacttggccacattaaattctttcttagaacaaaatggaatagagaaaaaataaacattgttatcctgattaaaaacctaattccagccgggcatggtggcttacacctctaatcccagcactttgggaggctgaggcaggtggatcacctgaggtcaggagttcgagaccagcctggtcaacatggcgaaatcccatctctactgaaaatataaaaaattagccaggtgtggtggtgcgcacctgtaatcccagctactcggagaggctgaggcaggagaacctgggaggcagtggctgcagtgagccaaaattgtgccactgtactccagcctgtgcgacagagcaagacttcgtctcaaaacaaacgtgattccataaaaaattatctttcaaccaggtatttttcttataagctaattgattaattagttgactgagatcagtagttctgatttctgttctcattctagactttaggttaatttgaagatcacagtaataaaatctaacatctgattcatggggaggttctttaacagtttaaaacaaaacatgaaaattgtggctagagtttcttttcatctcttcatcctcagatagctgatgataggtgataaagtgaaatagatttcggagggggcagtcaacagtaattcagggtgtctctgatataattaatgataagctaagatacagaaatactctggttttacttactaggtttcctattaaaaacaatgtattgcctttcttttagtaagttttagccacaaggctggtttttgtaaggggaaaggttttggaagatttttaggcaaataggatagtggtccaagaaaagaaagaaaaatccatatatgagcaaaggcgaggaagagcagaagtgaacactgcagcagcctccacatgactggggccgttgtttgtcttgtccagtgtgtgctcacaatgtttagcctttagttaaccagctaatttaagtggaacttgctctgaatccctgaagatctctgtagccaatctttggtcaggacccaggcgttaaaataattcaagggtgtttggggtcgaacacagtggctcatgcctgtaatcctaatgctttgggaggccaaagcaggaggattgcttggtcccaggtgttggagaccagcctggcaacataacaaggcctcgttgctactgaaaatttaaaaattaaccaggcatagtggtgggtgcctatagtcccagccacttgggaagctgagacaagaggatcacttgagcacaagaggtcaagcctgcagtgagccaagatcacactactgcaccccagcctgggtgacaaagtgataccctgtcttaaaaaacaaaaacaaaaaacaacggtatttggttttcttttggctttcttccaatgctacaagaagaaatctcatagtggagaaaaggtcaaatgactagaggcaccccatttctcctttttctctcaaacctggggtcaataatttttcctgtaccatttaattcattttctcttattccattctgccatcagaatttcagttgtggagctattgctgatttagtttcaggaggttgtgaccttactgctgagaaagttttacagtcgttaagtaacctgctactgttaaacctgccaggatttctgacctaatactctgccaggcagcccatcactcttccccccagacttctccctgtctttcctcaccacattgatgttctcagtaaatgattttgatgaggctaaaccatgaaggatatcagaacataggagaagttaccagtatatgatcttgatcaagtttacttaagtattttctagttctacctctcagctcaatctagggtaaaatacatatatatattttatagtttgttgagccacttgagaataaaataatttattactattgtcattgttttatttatttatttatttattttgagacagactctcacttagtcgcccaggctggagtgcagtagcatgatcttggctcactgcaacctctgcctcccgggttcaagcagttctcctgtctcagcctcccgagtagctgggactacagggacatgccgcaacacccagctaatttttgtatttttaatagagacagggttccaccatgttggtcacgctggtcttgaattcctgacctcaggtgatccacccacctcagcctcccaaagtgttggcattacaggatgagccactgcacctggcctgctttctaattaatattgaaaattattggttaggtgtggtggctcatacctgtaatctcagcactttgggaggccgaggtgggcagatcgcttgcgctcaggagtttgagaccaacctgggaaacatggcaaaaccccatctctacaaaaaatacaaaaattagctgggtatggtggtgtgtgcctgtagtcctaactgcttgggaggctgaggcaaggggatggcttgagcccaggaggtggaggttgcagtgagccaagggagatcgtgccactgcactccagcctgggtgacagagccagaccctatctcaaaaaacaaaacaaaacaaaaatctgactctgcatttccttgcccttatatatagtatgtgccttcacatataatatttgatcacaatgataaccctaaaaagtatgcagactgtattagccctgttatataaatgagggaactgagattctcagaaattgaacattttgcttaaggccatatttctaacaaaggagatagaacctgtccaaagctaccatttatctaaaggcgagatggagtctcactctgtcgcccaggctggagtgcagtggcatgatctcggctcactgcaacctccgcctctcgagttcaagcaattctccttcgtcagcctcccgagtagctgggattacaggcacccaccaccacacccggctaatttttctatttttagtagcgacggggtttcaccatcttggccaggctggtcttgaactcctgaccttgtgatccacccgcctcggcctcccaaactcctggcattacaggcatgagccaccgcacccggatggctttaggttttttaaaattaccttctccgtgccttcattatcaccaaactaactgggtgacatgacgtgtcactcttccatggttccttgtctgcatgggttttttgttttgagacagggtctcactctgttgcccagactagagtgcaatggcacgatcatagctcactgtagcctccaactcctaggctcaagcgttcctcctgcttcagcctcctgtgtagctgggactacaggcatgtaccaccacactgaagtaattaaaaaattttttttatagatagagtcttgctcttttgcccaggctggtctcaaactcctaatctcaagtaatcctcccattttggcttcccaaagtgctgagattacagcataagccatggcaccaagcctcagatattttttaatgtagttgttaacacactatagaattaaggctcagactggagtctgaacaatgattttgttcaactcccctacagagaagagagaaaaatggggtgcagtgatactgtgacttgccttagagcaccctgaaaatagaattttctattgtaggaaattctatgggtagacttggtaccttctttcaccagtgtgcactcagcataattcttttgttctggacccagcttatacaggaggagtctgtttttcttttgcttggtttttgttttgccagagtacatggttttattggattaaaccagtgttttgtaagcccctactgtgtgtcctagttgctgggaacatgctggccagcaagacctcatggcttctaccactgtggatcttattttcaaattgtggggagcaaggaaataaatacttttaggtgagaataagtgcaataagttcattaaaacagagtaatagtagagagacagagagagagaaaccagtagaacaagatggccagggaagaattctttgagcagatgacttttggaactgatgtagatgatgagagccatgtgaagacctaggggagaggccttccaggctaaaggaactgcactggcaaaagtcctaaggcaaaaactagcttggggtttggaaggtgtgcgaggggcgtcgtagctgaagcatggggagaccataaggaaaagcaagcaaacaacagattaagcagaagagtgacgtggttgatagacttatctgtgttatctgaagactggaatgtaggggacaagaatggaatcctggagatcagttaggaggcttttgccacgggcaagaggcaatggtgatttatatctggtggtgataatcaatgtggaggacagattagattcattctagcctgtattttgggaaaaaagtaaaaaggacttgtcagtagattggaaataagaaatgaaaaaggagtattaaggcttttcacatgaataactagatggatggtataagtgtatactgagatggggataacaggaagaggaatggttttaaaggagaaattaagagttttggtgattttgagagtcctagtagatttccgagttgggatgttaaggagacagggatgactacgtttgactgaagctcagaggaaggatcgatcagctctggggcagtttggatatggagagcatgtcttaggggcaagcttagctataaggagtacagtgtagacccaagccttgatgtgatgtgacatttaaaggtcaggcaaaagaggagaagccagaaactgaggctgacaaaagtgaaatggcagaagattggtgtcctgctaccaagaaaaagtgtttcaagaaggagggaatgctccattgtttgagctgcttttgagagatggagtaagaatatggcagaacagtgctgattagatttgatgtgatgagcttttgagtgaccttgacaagcagtttcagtatagtgatagggacaaaatcctgattggaggcttggaagaggggagagaatttcaagaattaagacttacacaggaagaggtgatggcagccagaatacggcttctggtagatgtatttatttagaaagtcattcattcagaaaaggtagtcagttgtcaaaaggatgatagtctttttgcagtggctatttaaagcacagtaggccaggcacggtggctcatgcctgtaatcgcagcactttgggaggccaaggctggaggattgcttgaggctcctagttcaggaccagcctgggcaacatagtgagatcctatttatatttttttaatgtaagtagatagatagatagatagctaataaatttttccttttctgtaaaatggaaaaattattatgtaagagaagatttctaacaaatttggaagcttaaaagatgcttttaccagtctgatgattaaacagtatttttaaacttggccttttcctcagtgtctttttgaggttagcctccttttaggttaggggtctgcagcacagatggggtacgtgtcttgaaggttaactggttgcgcagtatgctgtgtcaagccttttgaaagtctgaatgatggctcatgaaaacttttggtttgtttccatctatttttatttgttgcttgagtagattgacattcttacttaagcaaaaaccaggatttggagtataattcagtatagttatcaaaagaaccaaatttttaaaaagaaaaacacattaaaaatatagttatcaaataatcttagaaaattttggaattctaaaactgacaaggtaaacctgatacatgttgctatgtgtggatatgtaaagttaatctgattccaaatgagatgtgtggtaatgtgcttgatagtgtgcacgtgaactgtaaaccagtcatctagatgactataattataaacttactcagtaaagcccaagttagaatttttttcttctctttgttggattttcagtgtctataaacattgtttttaaaaatgaaaataggccgggcgcagtgactcacgcctgtaatcccagcactttggggggcccaggtgggcggatcatgaggtcaggagatcgagaccatcctggctaacatgatgaaactccgtctctactaaaaatacaaaaaaaaattaaccaagcatggtggcgggtgtctgtagtcccagctgctcgggaggctgaggcaggagaatggcgtgaaccctggaggcagagcttgcagtgagctgagatcgcgtcactgcactccatcctgggcgacagagcgagattccgtctcaaaaaaaaaaaaaaaaaaaaaggaaatagtctgattttcttactgtataagtaatagatgctgcttgcgagtcaacaatgcaaaaagacttaaaaagtaaaaattactattaattctgttacccagtgatgaccactgtgttcaacaacactatttttaaaatcttttttttttttttttgaggtggagtcttgctctgtcccccaggctggagtgcagtggcaccttctcggctcactgcaacctccgcttcctgggttcaagcgattgtcctgcctcagcctccccggtagctgggattacaggcatgtgccaccacgcctggctaatttttgtatttttagtagagacggggtttcaccatgttggccaggctggtctcgaacttctgatctcaagatccacccaccttggcctcccaaagtgctgggattacaggcgtgagccaccgcgcctggccctatttttaaaattttacacaagtaatacatgctcttagtaaaaagaaatacaaacaaaacagaattgtgtacatttgtaacagtgcaggaggaagagggaagaattagggtacctggtgcacttgaaacaggagaaccccaaaatagctaacaggtatttgcaagaaagttcaaccaggctgagagcagcaatagaaataggaaagggttatgctctctgcagtactgagtgagtacaaaggatctgagagatttggagcagtccagcccctatgaactcaaaagactggcccaacaagccttccttttgggacagggcttcatactcaggaaaaatgactgggagtggaatcaaaattgagcagtatagggacatggatacaaaggaaagagatggtccagacaaaagtaggggaggagaatggagactggaattcctaagaagcaaggctcacataaaaatgagcaacagaaagtatcaagcaaggtcaaatccactgcagaaagtgtcaagcaaggtcaaataacacaaagttattattaggaaaaaggagaataaagggagaaataacacccctgtggacagtgaaagcacaccagtaaatcactacttcaaaacaagctcaaagagaataagaaaatgatacaagacttgaaagatgaaaatcagagtttttaaggctcataaataaggtgacagaaagaatgagaaataaaagaaaaattcattctagaaatgaggatgcaactagaagcaacacaggggatactaactgaagaaaaatagaagttacaaagaggaaaaaaatttaaattaaaaggaaatgaggctgggcgcagtggctcacgcctgtaatcccagcactttaagaggccgaggtgagcggatcacctgaggtcaggagttcaagaccagcctggccaacatggcaaaaccccgtctgtactaaaattacaaaaattagctgggtatggtggcacatgcctttaatcccagctactttggaggctgaggcatgagaatcgcttgaacccgggaggcagaggtggcagtaagctgagatcacaccactgcactccagcctcggggatagagtgagactaggtctcctaaataaataaaaggaaatggaaaagatataaaaagaatttgagaaacagtaacaagtatttaagacaaagaagattgaatgtatgggcagcaggagtccctgaggaagaaaactaaaccaatggaatagaacaaatgataaaaatgaattcaagacaactttcttaaaataagagattctaaactatatttaaaagagtatcatgtggccaagaatatcaatctaaaaagtccaacactaagatatattctagttaaaggagaaattatttagacatgtagaaaaagaaagcatatgacttacaagggggaaaattagattatgttcagatttttcaacagcagtgctttctgctagaagaaaatggagtaacatatttagaattctcagggaaagaacaagccaaggattttgtgtccagaaaaactgactttcaagtagaaaaaacagacaaaacgttaccaatttataaggcttcggggtatattaacatgagcctttcttaaggaatctattagagaatgtgcttcagacaatcaaaatagctagacctaggtcatcataaggactgatggtgagcactaaatatatagttagctgtagagctaagactgaaggaaggctgaggaggagagagtatcggatgtaattcccatgcactgtcaattggatacgataaaactttaaggggagcaggactgcatgcaaaaaaataatttaatgcattcagaaattagtattagtattgttattctgaaactgttgtctgagatatgtggtaaaaacaaataagtaattacggaatagtctaattctgtcattttctatacctttgaaatctgtattcttggtgtggaagaaaggagataacaaatataatagtatcaaatgtaatgaaaaagcagtatagtcttggatttgaattttcaaattgaaagtattaatatgaactcagaaggcgtctctcaccacaccccccattctcttcatctatccatctatttgtctcctagttctgttcactgaaaagactagatacaatcatctaccccagcagcactgagcatccttagcgtccagattgtgaacttgaaatatcatttctcaccaaaagaaaccagagtttcttggagaaatggctgaatccaggtctagatatgaaatgtgaagagcttgaaggacccatcttgtaatactggtcagcaaggaagttatcaaagcatagtaggaggatatcagaaattctcagaagccaacccgaagaggcttacattggccaaagagaggacagtttgaacttcaagaatgataatgtgccatgaattaaaactcaataaatatttgtaaatttatgactcaataatgatttaataatgtatttaacaagaataatttaccttaagaagatcctaagaaaccagttcattaccttgaaaacaggtaaagggaaagaatcaggcatttattatgccttttgtatatgagctgtacaactggatagccaactagtatatcctcattagaagcacctctttataaaattattacagctaataaatgacaaagacatagtaggattagaacatcactattttcaactccccataaatgaataaatataggcgttaagcatcaatgactgccaagatcacaaaaagacagctacattttgtgtgtttcctgtagtcttgccaaagagatccaccgtcagcttgatccattctttggatgtagctgcgtatttgcaggaaatacagaatatagagggaaatgttgaaccgcaccatgagaatgcaatcagcaaaatccagactgggaaactccacaggtcacatggcctgggtctttcaacagaaaagaaaatgaaaaggatggagaggggactgtggattaaaggaaacctaaaagacatttcagcagtgagatttccgaccatgcctgagttgagatgagcaaattcttccctcaagggcagaattgacagaataaccatttcagtgctctggaaattaaccaaaggtatataacatctgagaatcatttatgcctgaaaagctgctgagcttcagatatgaagcagaagtctgttgcattctttcctgggcattttcctatcccccaacacttcagcttggtaatgtggagggacaggttgtaaatattagcagtcttaactgctgtcactgaagggggcttacttgctttgggagtgggaagtcatgcctgtgcccagcagctttgtcagtggaaatgacaattctggccacagaagagcaggtatgaccagccactctattatcctgaactcgtggtcatggccagggcaagtatattcttggctgaggctatgcacatgtgtcgcggagaccagggtgggcccgagtcagctgcaaactcctgactagccctcaaactgcatgcacgtatagagaatatgcagaaaggccctgtgaaatgttaaagttgaggaagactttaaaatggtctgaactttgaatgcatttttgtgctgacagattgtcagagaaaggaagccttactgacttgaggtgtttgagcacaacttccgtcccatcattggctgactactgtgctacaaagatgcaggtgcaatccgtaaaaagccaggcttaaagataaaaacgaattttttaaaaacccaactgagcagaaccatcaggggctgcacaacaagggaagacagatttttctgaattagcctatgccggttactaaataaagatagaaacaacaaccttcagggggaaaatcagagccagagtagctacaatgtattatctgaatgtccattttcacctaaatttgagacattaaaaaataacaggaaagtattgtctcaccctcaagaaaagaggcagtcagtaggaactatctctgatccagctgttggattcatttagcagacaaaggcttcaaagcagcaattacgttcaaagaactgaagaactaaaggaaaacgtggaaatgaatcaacagacagacactctccaaaaaacaatagaaattacaaaaaagaggaaaattgaaattctagaaaagtatgacaattgatgtgaaaagttcaataactggccggccacagtggctcacacgtgtaatcccagcactttgggaggccgaggcctgtggatcacctgaggtagagagttcgagacccacctggccaacatgatgaaaccccgtctctgctgaaaatacaaaaaattagctggacatgatggcaggcgcctataatcccagctatgtgggaggctgaagcaggagaatcccttgaagccgggaggcagaggttacagtgagacgaaattgcgccattatactccagcctgggaaacaagagtgaaactctgtcacagaaaaaaaaaggaaagttcaataactaaggctgggagcggtggctcacggctgtaatcccagctctttgggaggctgaggtgggcggatcacccgaggttagaagttggagaccagtctggccaacatgacgaaaccccgtctctactaaaaatgcagaaattagctgggcgtggtggcagatgcctgtaatcccagttattggggagtctgaggcaggagaataacttgaacccgggaagtggaggctgcagtgagccaagaccacgccactgcactccagcctgggcaacagagtgaggccttgtctcaaaacaaaaacaaaacctgaaaagttcaataactaaaatgaaaaatttaccacagggtcttaatagcagattcaagatagcagaagacagagtcagtgaagttgaagattaatcaatagaaattattcaatctgaagaatatggaacaaaaagattgaaaaaaaataacaaagtttcagagacttatggaacaagaccaagtttaccaatatgtgtgtcatgggagtcttagaaggaggatcatgagagaaaggtacagaaaaatatttgaagaataaaagccaaacacttgccaaatttggtgaaaagcaatagtctacacaatcaaaagctcaacacacctcaagtagggtaaatacaaagagatctacacccagacacatcatagttaacctacggaagccaaacacagagataaaaccttgaaagcagcaagagaaaagcaactcatcatggataggggagcatagatataaataacagcagacttgtaattgaaaacaatggaggttagaaggcagtggaatattcaaaatgccgcaagaaaaaattcaacccaaaattctatattcagcaaaactatcatttaaaaatgaaggtgaaataatgactttttcaaataaacaaagactgagagaattcattgctactagacctaccttagaagaaatactaaatgaagactttcaggatgaaatgaaatgacaaaaggtggtaactttaatatatggaaagaaatgaagagcatcaaaaatggtaaatatgtaggttaatttagaagaccacataaatctatttttcttcttttctctcaagtttaaaagatataagattgtataaagtaataattataactctattattgggcttataacatattataatgtatgtgacagtaatagcacagaagaggagaaagggaattgagctatatttgtgtaaagtttctatattctgccattagaagttgattatgataaattaatttggagattttaatccctacaacaaccacatagaaaattacttttggatgcatacagtggctcagccctgtaatcccagcaccgtgagaggcttgaggccaggagtttgagaccagactgagtaacatagcaagaccctgtctctacaaaaaaataaaaacttagctgcatttggtggtgcgtgtctatagtcccagctacttggaggctgaggcaaaagaatcccctgagcccaggagttcaaggttacagtgagctgtgatcacgtgactgtacttcagcctgggtgagagtgagaccttatctctaataataaaagaaaaaaaagaaaattttaattactattattatgtaataatactcttttcagttagctctctcaggttgaaaagaaaatttacttttaaaaaatagtaaaggtcagacatggtgactcacgcttgtaatcccagcactttgagaggctgaggcaggacgatcacttgagcccagaagttcgagacgagctcaggcaacatagtaagacctcatctctaccgccccaccaaaaaaaaaaatacacgtatatatatatatgaaactgggtgtagggatgcacacctgtggttccagcaagttgggaggctgagctgggacgatcgcttgagcccagaaggtgaaggctacagtgagctatgatcatgccatttcactctagcttgggcaacagagtgagatcttgtctcaaacaaacaaaaatatttaaaaaaaatcaatagggggcatttaaacactaaaatttatttactccacatgaaagaaggtattaaagttgggacagagaaataaaaaagaaggtaagcttttttacttttttttttttttttgagacaaggatctcactgtattgcccaggctggagtactgcggtgtgattgtggctcactgtagcctcaacctcttcggcataagtgatcctcccacctcagccttccatgtagctaggcctacaggcgggtaccaccatgcctggctaatttttaaaattttttgtagagatgggattttgctatgttgccctgtctggttttggactcctgccctcaagagatcttcctgccttggccttccaaagtagtgagtttacaggcataagccactgtgcccagctggaaacatttatttttgttttatcatttcttctttattggttagaatatttttgtataaagatgcttccagggccaggcacagtggctcatgcctgtaatcccagcactttgggaggccaaggcaggtggatcacctgaggtcaggagtttgagaccatcctggccaacatggtgaaacctcatctctactaaaaatgtaaaaatagccgggcatggtggtgggcacctgtaatcccagctattcaggagactgaggcaggagaatcacttgaactcgggaggtggaggttgcagtgagccaagatcacgccactgcactccagcctgggtgacagagcgagactccatctcaaaaaaaaaaagaaaagaaaaaagaaaagaaaatgaataaagatgctttccccatcaaacatgtggtttccctgaggtataataaacataggaaaggcaggttgcagtttgatttttctaccttttatttactagttttcaaagtagtaaattgattgccttagtgtcctccttttttgaccagttaggattttatttatttttaaatatcattttgaactcatggatttaattatatttgagcctttaagtccactgcagttattattctttttgattctcatcttgtttgttctgtcttcaggttgagtcttgagtccttttgatgtgatccttgacataatttttgttactctttaaaatgattaacttgaagccctattttaattggaatatattacagctggaaagtgattttctttaagcagtactgggttaattattattcagtgttgaaatgtgattggatgtgaatggtgttgagctgttttttcttcataggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctggtatgtgacttgctgaaaccataggctgagtttttactacttgtattttgctgttcattattaaaatattttctcttcacgttctgattatgtttaaatgatattttagtccagaggaaaatatctttatttttttcacttgatttcacattttttccactgtattaaatgggatatgttagtgtggagagagtcaaagagaattatagatttctgggtaccactgtggacaaaggtgagctcagcagtgaaagccacaaatgtaattttctttcaagggctgagaagagcaattgaagttgaactgtagttgaacattttctatttttatgtatcagttactacttttctttagccactatgaattgctaataagcaagccaatcccctaggaatagaactatgttgggggttgtgggaaagaataaaaaagaacagtttatactattttatggtattacatgcctgcttaattgaaggaaaggatttaaaagtttctggtttaattaattccactttgagactttattaagtcttttttcctttagttaaagtataaaactgtagatgtagatagccttggtctaacatcttaatgaattcatatcaatatggaaagtattatttttaaagtactttgactacatctaagtaaattcagtattgacgacatgggttttagcatcatacttgaaacatttctgcgcctttggccccctgaatttgttgtatatttatcaggatatatatttaagttatggccaaataagctaaatgtatctcctttttttagattttttcttgtcacatgtagttcatcttgcatatatgaccatgactgtggacatgatggtagcccagaaagtgtgtgcagttgtttttccaggagcataagcaaatccacacactctgagtcttctattcttttgtgactaatggcacatgttgcaagtcatttgccatcaggcaagagtgagggaatgtggctaagacgcagtgttttttttctgacactcaactaaccaaccccagtgataatcagacacaaaagctgaccttccctagtgtcacatgttatctggccaagactacagtttgtgacttcttggctcttacatctggaactaatacttcagctccttcagtgcagtgaataaaataccattttatatatttaagctgttacctctttaactgttggaataggtcctataaaatgtgatacaaaatgtttaatgaagagtaaaattttatggaaatcagcattactacatagtaaggtgattttcagtagaacaagtaaatctagaaacctttttggcaggaggacagagggtaaggagggaaaagctcttttcagtctaggctggcaagaagggggaattatttctgcctcagatttgttgactgtgcattttaatttttgtaaattggggaaagtttcttatctttgtagaattaaaattattcaacatttatttttacagcagccacattgccaaagagttcttcctttagtagatctggtccagggtcacaactaaacactaaattacaaaaggcacagtcatttgatgtggccaggtaagtttgcttgtttttaaatgggaagtttggttaaggccattacctgattaaatcataaatttgaccatgaatcatctatattctttttgttgttgtcatcttttttgtaggcttttgtagagtgctaataataattttcttaatttctggatagtgtcactagtttttatcattaatttgttgcagagatgagagaaatcaaggacataacatttccttaaaggctttgtgtatttttttttttttaaagaggataacaaatggatagtaataaaatgtttaaaaacagtaagataaaattctgggtataagggaaaaaagcaaatgaactattttatgtgtttatgatttacaagtttatgtataaaatttttgtatgaagattggagttatagttggccttatttttaattctatctcagataatcttgtggagtttatatgggtaattagtaaaatcctattaaagacgatttattatgaaaagaattatccagatagtggacaattcacattaatcaaatgtgtggctcaattttattaaagctgacatgacattattgcttatgttttggccaaccttggtttcaattattacctttcatatttttattttactcctatgttttacccttgcatactgctacattaagaagagaaattaagtctcttttaagccatctcagaacttttgggccgggtgtggtggctcacacctgtaatcccagcactctgagaggctgaggcaggaggatcgcttgagctcatgagtttgagaccagcctgggcaacatagggagaccttgtcgatacaaaaatttaaaaatgagatgggaggatggctggagccagggagatcgaggctgcagtaagctgtgattgtgccactgcactcttgcctgggtgagcctgcctaaaaaaaaaaaaaaagcttttggaatttatcctgtcttatgtcaatcctcactagaaattgttaagtgaatcaagtcattttcccactttcaagagaaaagcatgttgaatataattcagtgatgccttcattaccttttaaaaatgatttaaagaaaatccataaactgaaaagcactgtgccaaaagctttacattaactcattcttccccatgagatgattctgttactctctgttatagatgagggacaagctcagagacattatgttactcgtgcaacagaacgtaactcataagtgacagagctgagtcaaactgagatgtctgattttaaggcgtgtgttcttaactatgcaagttttctctaaaaaacttaattgtaggatacaggtatttatttgtgttccatttaattgcggttttacccttaagatgcctcaatatgtattgggcatctactttgccaggcacatcattaatcctattcaaccccatagctacctatgcagtagatgtctcaagatggtgcatgaggaagcacacccagagaagctctagtcctcacccatagtttacagcttagtgcatggtggagctgagagttaaacctatatcatcttacactaagttcctttttaaaaaaaattctcctgggctgggtgcagtggctcacgcctgtaatcccagcactttggtaggccaaggtgggcagatcacaaggtcaggagttcgagaccagcctggccaacatggtgaaaccccgtctctactaaaaatacaaaaaattagctgggcgtggtggcgggcacctgtaatcccagctactcgggaggctgaggcaagagaattgcttgaatccaggaggtggaggttgcagtgagctgagatcgcggcattgcattccagcctgggtgacacggcaagtctctttcttaaaaaaaaaaaaaaaaaaaaaaaaaaaattctcctataccatgctgaagttttgagtttattatgactttgcagaagcaattttgaaatctgctttattgatttgtgacattagaatgaactatcagtattagtgaacattagtgctattgaaacaactgttttatgttgtcacctttttaataacttaaatttctagccaatttttgcaatgcagtattgaacttttgggtacatcttcatgagtttttagtctatttaaattctcaggaatttggcagaaaactctgatgtgataagtgtaatctgggacaacttgtgtatgtaacacccaacattcctggcgtgtagcaactagatagttagcttcttgacaaataggtgggagttggaatcagcaaaatattagttagttaacatgagagggttggtgcagaagtacccacagcagaatagatcatggtaagtgttttttattaagaaattcataaaaattgaaaaaggtgaattcatataagtacttctcgagtgtttgggaggtatttcctatacttgaactgtatataatagatataagtgcatagataacacatggaaatgatgattaaaaagttcagtatttcagtaagattgtgcttttacatgtttgaatagatatttttgttgaagtgaaattgcagacagagcattagctgtaatctgtcctggaaggggaatgccagttttactgtctgagctcagccattgggtttaattcagatgtcgaagcttaacaagccattggtaccagtgtgatatttgtgtggacagtggcatctgaggaactaatcactaaggaagtgtagacgcagcctaactactggcaagtgtgtccttgggccagctcaggattgtggcacattggcaaggagagatcagtattggattgtagtcgagaaagtgaagctgtctccattcccactctgcttatgtgtgaccatggaaatgttctgttctctctctctctgggaaactgtccaatgggtctgaatttaaacttaccagaatggagtaatttcacttcattaagaaatgggtcctgtatattcacgtatagaaagttaaaacattttggagaattagtacctttaaaggcagttattggtttgcttttagcattgctttttaaccaaaaaagaagtgttttagaaattagaatagcctggacattattgttttacctcagttacaagaggtttttcatacttttatagaacctttaaattattatatatacaacttgaaacagcctctcagtctattgtgtttatccatgattctggaaaaataattatctatttgagggaaatgtttatgatcttaaaaatgggaaatacccatggcaaaaaaaatcagaagtagtgataataaaatgaataaaatatgaaagttagagatgattatctagagaagttcttagtttactgtcattaaggaactttaccaggctgttccttatggataatcctctttctctcctttttcttttccccacagtgtcccaccagtggcagagtgggctgttcctcagtcatcaagactgaaatacaggcaattattcaatagtcatgacaaaactatgagtggacacttaacaggtatttacaaataaaaattagtgaaatatgatctttgttttcaatgtaaactgtttctagatattgggtcatagatattttccatgtctgtgtgcttatttcttggcagtgtttcctttgtctctgttatctcatgttcttatccactgataactctttacatagttatatcattctctcatgccccattgctttgtggtaaaatggaatatagaccagggatactcctgtacgctgaaagccactgatatgcaaatcaaggcactagcaaagaaacacttctttgaacaaaaactagcttcaacttctgaagtccagctttgaacttgatgaacttgaagctgtctgttcactaggttagagttggaggcagcaggcagggtaaaagcagggagttgagaacatggctctgtctcagataactgcctagatagggctcaccactttggatatttctttatctattaatataaaaggccagagttaacttaggtgatctcaatggatttttttaaaagaagaatgattctgttatctacgtcagaaggatagacaggaattttagcatactgttcaaaatttttctcacgaaggtttaaatacttgttagaaagttataaagaaggctgggtgcagtggctcacgcctgtaatcccaatcccagccctttgggaggctgaggcgggtggatcacctgaggtcaggagttcaagaccagcctggccaacatggtctctactaaaaatacaaaaattagccgggtgtggtggtgggcacctgtaatcccagctactgaggcaggagaattgctggaacctgggaggcggttgcagtgagtcaagatcatgccactgcactccatcctgggctgcagagtgagactccgtctcaaaaaaaaaaaaaaaaaaaagaaagttataaagaaaagcataactttaatgaaagaaaatagagacctctgatatgaatattaaatgttaaagggaaaaactaactgccctctaacaaatatgaaaggaagggaaaaaaattaggtttcctgtgtggtggagtggggtaaggggaggattataatccaaaacacttttaagaaatgattcttactattttttccttgctattacttaaaattgcaatttttactcccaaaagaaaaaaggtatcttatgtttaaaaatgtcagagttggacgagattttgaagggttctaatctaatcttgaactctggtccctttaaggatctcagcagtcaccccaaataagcatgtatttatgtttgaatgggtgaatagtaaatacacacagattctcgatgtgtcatactgcctcataaagcagtagctgtcaaaaccagcctaccttatgcaggctctgcttttttttttgagatggagcttcactcttgttgcccaggccggagtgcaatggtgtgatctcagctcactgcaatctccacctcctgggttcaagtgagtctcctgcctcagcctcccaagtagctgggattacaggcatgtaccaccacgcccggctaattttgtatttttagtagaaacagggtttcaccatgttgctcaggctggtctcaaactcctgacctcaggtgatccacccacctcagcctcccaaagtgctgggattacaggcatgagccaccacacccggcccactgaaggtatatttaatagcatatttttaagtactgttttacatggtttgtttgacaccagtgctccatacaaacccagaactacattgccaatgaatccaaaaatatttcttgaaaacgttggtgtttgctgtgagttgattaaaatagtattcaattgagacattgattgagaaattctctctttcttggtgggatgtgtgttttatgaatgaaatgcagtatctacattccaaatataatgacccaggcacttgagcatttagaacttttaaatatctgaggcagaaagtaaaatttgaaatatactggaaagaaagcagattttgatattgtttatctgcatacttattgctactttgatccagcaagaatttaaggtgggaattttacttttgagccagacctttgtatagtcatgtcaagtagaataatttattacagtaaattttaaaatgggaataaacaatagaaatttaattttttttccctttatgtacttaggaatcaatatgaagtatgttttatactaaattagaatgttgatggaaacagctgatttgttgaggtggatggaacataaaggtcattgtcttgatcacaattataaaaataattttatgaagtcagaatccccaaagcagttcactcagctgcaggagaagcaaaatatcaagaaagttgagaaaaggtttcagtatataacatggcccaaaagaaatatataatttatatttgtaatctcttgtttttcatccttcttgcttttgttttttgtgggtttttgttttcaggagctaaaaagcacttcttttctttctttttttgaaacagagacttgctttgttacccaggctggagtgctgtggtgcgatagtagctcactgcagccttgaactcctgggctcaagcaatcctctcaccttagcctcctgagtagcagggactacaggcgtgcatgcaccaccacacctggctaatttttttaaaaaagttttctttagaggtgggatctttgttgtccaggctggttttgaactcctgacctcaagcagtcctaccaccttgtcctcccaaagtactgggattacaggcacccaggctgaagtacagtgacataatcatggttcactgctgcctggatttcccaggctcgggggatcctcccacctcagcccccaagtagctgcgactacaggcatgtgccaccatgcccagctaattttttgtagaaactgggttttgccatgttccccaggctggtctcgaactcctgagcttaagcgatctgcttacctctgcctcccaaagtggtgggattataggcgtgagccaccgcgtctggccttaatagtggcactgtttaccccactgactatctgggttgatttagccgatacatcctgttggacaccctgttcttccttcatggcttgatgtgtaactgttgcatgcccttaaaagagactgccttataaaatagagagggatcattctttaattaaggttatgtaagaagctctagaactctggtattcctgttaataatgctagcccttcttctcaaagaggtattttattgttgcattctgaaacaatgaatatgctatttggtaattcatctattaatcagaaaagctaaagtcttagtcattgttttaaataaagctcatttcatgtagttactctctcctttctagccatacttccctgcccaaacatggatgccagaagtggggtttgtgtgcttgggatttctggttttattcctatgttcccttataagccagtactccaaaaccgatatccctttatgtacctaggtttccacagaagagttctgtgcactcaaagctcaactgtgtgttgtccaaatgtgctaagatgctatcttagctgttgctgatctatttttaatattttgcaacattgatttaggacatatgtagacaaatagtagaattacaagagataattgtgatcttctagtgtggggattggcaaacattttctgtaaagaatagcacaataaatattttaggctcataggtcatatgttctctgctgcaactactcaactttgccatcgtagcatgacaacaaccatatatcatgcttatatcagtggatatggctgttttaataaaactttgcttaccaaaacaggcagtgggccagatctggcctaagggctataatttaccaatccctgttgtagattattttcctcatttcacagatggaagaacttcattttagaaagttaaagtagttttgttaatgtcacatgccattagggagtcaggactagaatccaagtcccctgatatccaggtttagagctagttcttcacatttattgttaggctttttatgtgtaatagataaaatattaacttccttttttatagttctggagtaagggcaattgttacaagtgtaaattaaatcacccactaaagttttgttaattctactttgttaccaacattctagatacaatgttacagactaaagaaagtgatgcctgaactttgctcattccattgtaccacagtcctttagaatcttcacatgaattcagtagattgttttttattcttagatgctcccaaaacacacacgtgctcatgtatgcacacacatccagcaggaatgtgttcatatattcaccaaaagttagaatgctcactattaatagtagccctaattgaagactaactgaatgcctatcaacagtataatggacaggccgggcacagtgactcatacctgtaatcccagcactttgggaggccaaggcgggtggatcacgtgaggtcaggagttcgagaccagcttggccaacatggggaaaccctgtctctactaaaaaaaatagaaaaattagccaggtgtggtggcgcatgcctgtagtcccagctattcaggaggctgaggcagaagaatcattgaacccgggtggaggaggttgcagggagccaagatggcgccactgcactccagcctgggtgacagagcgagaccgagactccatctcaaaaaaaaaaaagaaaagaaaagaaaacagtagaatggacaatgaattaggatgtaatgacacaatgatacactccatagcagtgaggattaatgttctacaactctacacgacaatatattgagcaaaataagccaggtggaacagcggacaggctatttggttagaagttaggctaccttggtggtagctgagtctaaaagagaggcaaataggggcatctggggtgcgattatactctctttcatgacctccatagtgtttgagtattttcactttggaaaattaattcagctgtgtacatgtgcacatgtatatatccacatgtatccgtatgtgtgcttttctgtcaggattttatatgtaaataaaagttgaactattgtcagtaatgttacctgccattagagcacctctcatgtgctaatgtgatgctaagctcattgccccaatggatcatagactggtttatctgaaatgagcaaactaggatccagactacctggcccagtcactcagcaaagtctagactaagccaggactagagcctacagctccttggttccctgacctctactgctggccatgcaaaaacacatccagttttgtggtttttgatgaggtgacgtttgaataaagaaatagcaaaaagcaaaaacatatacaccagaatcttcccaacaaaattgccacagccttccattcctctgtccagcagtcttcctgggaccacatcttgagaggcagtgctggaaaggaagacgtatttatttctccctctctgactgtagtttatttaaactgagtctcctactgtgcgtttgtctgatgtctaaggccactttcataccagaagtgaagatgtttatgattattttaagaaatgagagcttattttgagagaagagtagaaattccaggaattcttcttttttttttttttcttggctaacataggaaatgtgttttgttttgtttttttaattgagacagtgtctcactctgttgcccaggatggagtgcagtggcataatcttggctcactgcagcctccgcctctggggctcaagcgatcctcctacttcagcatcccgagtaactgtgaccacaggctcatgccaccattcccagctaattttttgcacttttggtggagatggggttttgccatctggtcttgaactcctgagctcgagccatctgcctgcctcagcctcccagaatgctgggattacaggcacgagtgaccacaccaggctggaaatgtgttttaatcctggctattagcgcttcctgcaactttttttttttttctttttaagtctgtttagtgaaacagtttcccggagatctctccgaggtcccttcctcctctaagattctccgaatcttccctgaatttgcctgaggttgagcagggtggagacagcaggtggtagcagcggcaaaagatgttaaacttaaagagaataactttcaagtttgtaaataaagcccaatacaaataaagatggtaatgtggacaaaaggtcaggttatattttgaaactctaaatctttcacatggtcattctttatcaaacatccatttaacaaaaatttattatgtgtcagatgctgtgctctgtgtttctcctctttttcattggggcttaatttcctttttacaaagccctgcggtagtagcaaatgttatttaaagcattgtgattgcatgaggtcatggagtagtccacatacgcagaaccctggtcctcctgtacagtgagtatttgctgactcatctgtatgtccttttcctggttcctgtttaggtccccaagcaagaactattcttatgcagtcaagtttaccacaggctcagctggcttcaatatggtaaggaatgaaaagttctttggtttggataaagtggaaacttggttagattggtgtggcctcatgggttttagattaataccgttttttatgggggaatatgtagaatttgcttaatttcagtgagttgtaatgattgcctcttttataatactatttcccctctcaattttgaaaaatacaaaagcagattaatacaataaattctgaaggagtgataatacaacttaacaattctcaactcgtgaccagtcttggctctccctgtctttgatttctttttctttttttttttttgagatggagttttactctagttgcccaggctggagtgcagtggtacgatctcggctcaccgcaacctccacctcccgggttcaagcgattctcctgcctcagcctcctgagtagctgggattataggcatgcaccaccatgcccggctaattttgaatttttagtaggacagggtttctccatgttggtcaggctggtcttgaactcccaacctcagatgatccacccgcctcagcctcccaaagtgctggaattacaggcgtgagccaccatgcccagcctctttgattattttaagccaaatcttagttattatataatttctactgcaaatattttagcttttatcttcaaaagagagggattttcctttttttcattcattattattattattacttttgagatggagtctcactctttcatccagatggcagtggtgccatcttggctcactgcaacctccacttcccaggttcagcctattctcctgcctcagcctccttagtagctgggactgcaggcatgaacccccacgcttggctaatttttgtttttttagtagagacagggtgttgccatgttggccaggctggtctcgagctcctgacctcaggtgacctgcccacctcagcctcccaaaatgctgagattccgggggtgagcactgcgcctgaccgactttcttcttagcacagtcataacagcaatagctcacctaagtttttcagtagtcatccttatcattaaattaatcagggaatgttcacattccttagagtgcctcagaatgtttttatagttcatttgttcagctcaggactgaaataagcctgtattttgcaatacttgagttttccatcttttatgtctcctttaatctataaatttccccttgtcttgttctctgcttcttttcccaagtcccccaggccgccccccaaccaaaaaaaaaaaaaaaaaaaaaaaactccgttaaaaacaaaccagatcatttgtcctgtagtttcttaatggcttaacttttgaagagtgcgtcactgtgggattgtctaatttgtttctgtatttcctgtaaattgataattagatctagagcaaagtttcccaaccccagcactattgacattttgggcccgataaatctttgttgttgggggatgtcctgtatactgtaggatgttcagtagcatctgtggccactactcactggatgctagatgccagtagcatgagctccacacccagcatgacaatcagaaatgtctccagactttgatagatgtgccttggggtacaaaatcttccctggttgagaattgcggatcagatttgatttttttttttgttttgttgttttgtttttgataagactgtgccagagaggtctctgtgtactctcctcaaaaggcacataatgtctctattgtgtaatgattttgaatagctatcgatgagcattgcctgggtcctacaggcttccttaaatttaaatgttaactagaatggtttcttaagaagtgtgcatgttatagctgtatgttggtgattgtccctggaaaataaactttgtctacaagactcactgcaaagttcgtgattttcttgcaggccacattgatagggttgtttcacaaatgatcaagctctaatgcagcttcctttgcccttctcttcccttctgttttgtatgaaagagcttgcctttggcagtagaccagaccagttaataaacatcttatatctttgacacacccagaactctttaaatcagggtattgaacagtatcctagggccccctgaaatataaacttaagatctaacattaatggaggttggttgacaatttattaggttgttctcatgataccagattatattgaaatatttattttaaatttctcatttataacttatcctatttgagaaaaacgcttgaggcttcttctgttagaatgttatattctggtgctacacactaaaaaagatattttaattaaatgcttataatcataatttaggtaagtgtggtgaaaaaacaagaatttcagccaccttctaactggtttacctaggactggctaattgtgagacacaaaaaggaacagaataaggaagagcgggcaggggtttcattttatttcatttgcatttctttttaaaactgggtatcttgcatatgggtatcttgcaaaactagaggaacagaaaaaagatcagcagttgccaggggatgggggcaaaggagggagttgctacaatcagatgtggaattttaggtagagctgacactattctgtatgttgtggttcatgtttgtcaaaactctcagacctatactctagaaggtgtgcattctactttatggaaattataacaaaaaaagtttatagcacctaaggaaatttcagaattaagaaggtttcttaatttttggcattggcaaaaccagtttcccattgcatttgtcctgttgacattctagtgaatggatgtgttgtcatgtatcttcttttgatggtccagaaattgtttagtaaaatcacattcttggacttgccaggagaatgtttgctgtaattagctacttgggcaagttcattatgaagaatgatggagattgaatcctgagattgaggaagaggaaacacttagactctgtggctggagttcataaagatccactgtgtaggcctagattaaggggtggccagctctgcccagtgggccgaatctggcctgcatctgtttttgtgaagaaagtttttatcgtacaaatagccatgcccattcatttatatgttgtctatggctactttctgccaaaatgacagaattcagtatgataaggattgtatgtcttataaactgtaaaatatttactacctgaccctttactgatagtttgtcatttcctggtctagagcagaacatttaacaatatagagctgggtatggtggcttatgcctataatcccagcgatttgataggctcacttgaggccaggacagatcagcctgggcaacacagtgagacccccatctctacaaaatattttaaaaattagctaggcatggtggcgcacaccttgtaatctcacgtttgggaggctgaggcaggaggatcatttaagcccggaaaggctgtggtgaactatgatcttgactgcagtgaggctgcagtgaactgtgatcatgactgcagtgagtctgcagtgagctgtgatcatgactgcagtgaggctgcagtgaactgtgatcatgtcattgcacatcagcctgggtaacagtgagagctcatctgttaaaaaagattcatggaatatgagtgtattatatgttaaatatgcaaaggttggggaagagtatcattataatcatagcatttgttgaatgaggaacactgtcccaactacctgtaattttatctttgcagcagtataaaataggtactattttgacaaaatgagggacaaagagactcagttggcctgtggtcaataagaaaacataacttttaaatcactaatgaatagtaaaaagcatgaattttcatgaaaccggattacagttaactttttgttgaataggaatctttctgacattgatcaagatggaaaacttacagcagaggaatttatcctggcaatgcacctcattgatgtagctatgtctggccaaccactgccacctgtcctgcctccagaatacattccaccttcttttaggtaaggaacatgggctctgatcaggaattgtatgcggagtatatgaattccaaacttggctttattgactatgtgtcttacctgattttcatccctgacaaggaaactaagtatccgtgaattctagagactctcatctaggtctatgttaatcttgggcccattttgttcttcaaagtacttgaagtatattagtgaaacaatgaagtaaaacatcaatagattgttgattttctaccaacctatgtcatcaatgcttaccagaaattttcacaacagatgccagcagcaagagagaaactgcatgagcctatgcatagagaagaaaccaaggagatcacacttgtgaattccacacatttcagtggtaacaaaagctgctagcaatgtagaaattataatcaggaagacaaagaaaattaccctggactgaaagacagtctcagtaaagatgtcaagagagtcacctgaggtccagtattgtgactggcatcctcatttacatccatgcatgcatgcacacgctgtccaggacagctctgtctcctggctttgaacataaaaactgaatatgagatcttacaagtacaaaggagaatgaaagaaagattaagatttctgacctgagtcctcaaactgcaggaaggactggggcaaaatcccctttaaatgaagagaaatagagccattactgtcagcacacacgtggtacaggagcaagctgaggaaactgtgactatgtaggaagcaacagatagctgaggcactttgcctgtgaaatcccacaactgcaacattggaagctgataatgaatgcgtaaaaaggattgggagacggtttaaacacagcaaagttaaaagtgtaaagtggggagggtggtgcggtggctcacgcctgtaatcccagcacgttgggaggccgaggcgggtggatcacttgaggtcaggagtttgagatcagcctggccaacatggtgaaaccccgtctctactaaaaatacaaaaattagccaggcgtggtggcaggtgcctgtaatcccagctactcgggaggctgaggcaggagaatcgcttgagcccaggaggcggaggttgcagtgagccaagattgcaccattgcactccagcctgggggacaagagtgagactttgtctcaaaaaataaaataaaataaaatgacataaataaataaataaataaaagtgtaaagtggaagaaattagtaaacaaagtgatttgttttacgaactatatagacattgcatgtgtttcttagggggtgaaatggagagatgggaaagggaagagagatgctcctagtgagctgagctgctgatcttcccttggaggaatttaaggttacttgagagggcaatggaaatagcagctcccacttagtgctcaccatgtcccaggcattgttcttaccactttttgattattaactactttcatcctttggaattgtttcaattttggtggtgattcttaagcttggcactcagagtctgatgacattccaatattcattaaaaaactctttgtaaatagagaagaccaaatctttatattttccttactgtaaatgaaatttgctccatggcatggtaaaatctttaaaaatccttcttcataacttgtccaactccacccagacagctctgtgtgaatctatttttctttttccccgcaattgcagaagagttcgatctggcagtggtatatctgtcataagctcaacatctgtagatcagaggctaccagaggaaccagttttagaagatgaacaacaacaattagaaaagaaattacctggtaaggcagcctttatgttgagttaaatcatttagattaaacgaaattagagatttcctatctctaagacaaagatagaggtaaacataaatttagtttttgacatttttgccttgtaacttaactgaccttagttggagataattgttaattaagcttgtggatttgggtctggatagagaaataagaacattatgcactctgctaatgcaccgttgttctaacttgtaacttgaaatctgattataaactgctaaacaaaaattatgtaaatgttatccatagaatatacagcactaaaaactgatgagtattaaggtgattgcttaataccaccagtgcagaaatagaaaatcaaatcatctactgttgttttctcatgttgttataagagaattggaaactccttaattgcaggaacctattttaaatttaatgtgaacctattttattttatttattttgttttttgagatggagtctcactctgttacccaggcaggagtggagtggcgcaatctaggctcactgcaacctccgcctcccaggttcaagtgattctcctgcctcagcctctggagtagttgggactacaggcacatgcaccacgcccggctaatttttgtatttttagtagagatggggtttcaccatgttggccaggctgatctcaaactcctgacctcaagtgatccacctacctcagcctcccaaagtgctgggattataggcgtgagtcactgtgcccagctgaacctattttaaataatactcatttacaatgataaatccatcatactattaaaatattctaaggtggctatgaattattaatgatgagatgataatgatactaagaagcaaatgaaattatggagtcttttatgataaatactttgtcagtgtcattttgctgcatttaagatgctcagcagttaattggtctggtcagaacactggctgtcccagtttattgtctaaactaaattaccttttgttcactgatgaaatactattggaaatattttacgtgcaagcctgcatgttgagcaaagaatctaaatgttaatacatggttcatactttctagaacctttaaaatatattagaggatttaagacatccatataagcaatcacttcagcagtatgtgagtgggataaattcctggagagtattatagatgcacaacagacctcacttatggttggttggtgtagactggggaagatatgaggaattaaatgtctgtggaagaggtcacagttgagttgagagttgaagatgaatagggtcaccacaagtggaagtgagaatagttcaggttttgataacaatgagaatgaaatttcaatggcagataaggacaggaatgcttggaatgcagaattttctttttctgtttttagtagacattcatttaaaattttgaacaggaagcaacattatcagagatttcatttgtgcattcattccttcaacagccgtttattatatgcctcctacatactaggaatattgccagatgctggaattaaaaagatgtatagagacttggagagttttttaaattgagatgagattcacataatacaaaatgtacagttcagaggctgtcttagtctgcttggactaccataacaaaatagcatagaccgggcagcttgaacagtgggaattttatctctcaccgttctggaggctggaagtccaagatcacggtgtgcagatttggttcccagtgagggccctcttcgtagcatgcagacagcagccttcagtttttttgctcacatgggatttccttggtttgtgcatgcagagggagacagatctctcctctctctgttttctctatctctgtctctgccttttttttttttgagacggttgtttcgctcttgttgcccaggctggagtgcaatggcgtaatctcggctcactgcagcctccgcctcctgggttctagcgattctcctgcctcaacctcccaagtagctgggactaaaggcatgtgccaccacacccagctaattttgtatttttagtagagacggaggtttcaccatgttggtcaggctggtcttgaacttttgactttaggtgatccacccaccttggcctcccaaaaagtgttgggattacaggtgtgagccactgcgctcggcagtccctgtctttttataaggatattaatttatcataagggccccactctcaacggctaattttttttgttttattttgtttttgagatggagttttgctcttgttgcccaggctggagtgcagtggcgcgatcttggctcaccacaacctccgcctcccgggttcaagcgattcttctgcctcagcctcccgagtagctgggactacaggcatgtgccataatacccaggtaattttttatttttagtagagatagggtttctccatgttggtcaggctggtcttgaactcctgacctctggtgatctgcctgcctcggcctcccaaagtgctgggattacaggcgtgagccaccgtgcctggccagctaatctaatcttaaccttccagaggctccatctccaaatatcacattagggtaattagggcttaaacatatggattttggtgaggcgacacaaacattcagttcctaacaatgacatttagtgcattcacagtgccttgcagccacaacctctcttgtcccaagatactttcctcacctcacaacaaaactccatatccatcactccctccagcccctggcaaccaccaatctgctttctgattcttgggatttacctgttgtggatatttcatataaatggaatcatatatgactgtttatgactgacatctttcacttggcacaatatttttgagattcatccaccttgcagcatgtatcattacatcatccctttctgtgggagggggactttgaatttttttttttttttttttgagacagagtctgctcgtcacccaggctggagtgcagtggcgcaatcttgtctcactgcaacctctgcctctcagctttaagcgattctcctgtctcagcctcccaagtagctggggttaaaggtgcctgccaccacacctggctaatttttttgtatttttagtagagactgggtttcaccatgttggccaggctggtatggaactcctgacctcaagtgatctgcccacctcagcctcccaaagtgctgggattacaggtgtgagccactgcacccagccaggactttgaattttaagatatcagagtagaggataccatctcctctgaaatcaccaaaggtgagcaagaaaaccaaaacatacttgcccgctttcatctctaatcgctgactacagtacgtgaaggaagtctgtctaaagcagtgaagtccaaacaggaatgtgggaagaagccaaagatggatgctcacagctgcagatctcaaggcagagtgagaagcaatggttcttagatgtggaccagggactggcatgctgcacagggtggcaatgagtgctcccctggccggcgttggtaccaaggaggattgcgtgaggccaacacagaaatgaaatagacactgctgaggacagtaagggacaaggatgatgggattgtagaaaatgaagaaataaaatggacataaagtattagaaaaaaaaggatagaactgagtaatcattctaaatttataattgatgtgttaaagaaggaaactgaataatgggttagaaaaaattgttgactgactgtgatctccatagggatcagggcacagcttgttcttcagtgtgaaaagccgaatgctcacctttcactctgctttgagaaatcttgttagaatagaggactcatcagcacggttacaaggcaaagggaaggagggagagagacagagactcatggtccagaagagagggggttaattcctagggcaagctcatgggaagaagggaaaggatggagtaacagggaaggaaaggagtctggatggtgatgtagaactgctagataaggatcttttagaaacagtgtttggcgtggaggagaagatataaacagagaggttaggcaaagggggttttcgttgtgctcattaacaaggacacagaagcttagggagttctgggtttgggtttgtactacaaatttcaaatacattggtgagttttcctttgaaaagagtccgttgaaaatcttgagttttcatagttgctgtgttccttgtctgaagtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggtaagcaggcgagagtggagccacccggagttagtgtgcgatcaccccttttcagaattatccaagtgatctattcacgccatctttgtctttttacaattcagtagttttagtatattcccaaagttgtgcaaccatcgtccctaattccagaacattttcatcactccagctctttacccattaagcagctactccccatttctttctccctccagctcctatcattaattttactttctatctttctagatttacttattcaggacattttttataaatggaatcatcaatatatggacttttgtttctggctttcatttagcataatgttttcaaggttcatccacattgtaaaatgaatcagtcctttattcctgtttatggctgagtaatatttcgttatatgggtataccacattttttaattcattcagcagttgatggtcattgtggctattataaacaatgatgttatgaacattaatgtacaagtttttgatgatacaattttgtaacaaaccactgataccagtaaagtgtttttccagactgttttctctgtatacacctatataaaaatataaaggtttatatggcggagagtgtaagggctgtataattttttaaaaaccactgtaatagtatcataccaattacattgttctgcaatcttcttttttttttttttttttgtttgagacagagtctcgctctgtcacttccaggctggaatgcagtggcatgatctcagctcactgcaacctctgcctcctgggttcaagcgattctcctgcctcagtctcctgagtagctgggattacaggtgcccgccaccacgcccagctaatattttgtatttttagtagagatgaggtttcaccatgttggtcaggctgatctcgagctcctgacctcgggtgatccacccgcctcagcctcccaaagtgctgggattacaggcatgagccaccgcgcctggcccatgcaaccttctttttaaactcttttaaaaatatgtctgggacatcctccctatattctatggaaggcttcgtaaatttagcgccatacctggaaaggggctaagcaaatcttgtctctctttccaattttagtacattactgcagaagcaacacatggttctttcatgtgaatgaaagataaaaatgaggaatttttcgatgtaaaaaaatagcctgagtgctgtgcctcaagcctgtaatcccagcactttgggaggctaaggagggatgatcacttgaggccagtagttggaggccactgcattccagcctaggtgacagagcaagaacctgtctcaaaaaaagaaagaaacaaaacttatagccataactcctttttttttttttgagacagactctcgctctgttgcccaggctggagtgcagtggcacgatctcagttcactgcagccttcacctcctgggttcaagtgattcacctgcctcagcctccggagtagctgggattacaggcgtgagccaccatgcctggctgatttttgtatttttagtagagacagggtttcgccatgttgcccaggctggtctcgaactcctgacctcaggtgatccgcctgcctcggcctaccaaagtgctaggattacaagcgtgagccactgcgcccggccccgtaactcctttttgttcagacagacactaacaaaattttaattttcagaatgaacaaagataggcaaacttttcttcaacgtaccaaaaaaatgatattctagagtatttattcagaattatttaatagacatttaccatgtatcaggtgtagttggatgacccatgagtcagaggcaattcccatagactgtcagatgctctgatatgtactctatctagcagtcgtcagagccagtcgttggagggagcaaaagcttttgtggtaaaaaggaaatgaatgattaggaagtggggagtcgcagacttttaaaacgagttaagtaataatttctcttttggtggagtaaaatcaactcttgtttgtttttgttcaggggtgttttagtttgattttactacataaattttccttcttggcgtgtcagtaaataagaaggagcatttttagttagcacatcaagcattcttgaaggcataaagaatggaattctaatggggaaataatcctgtcatcttacgtaaatatagtattatgtaaatataatacccagttctgtgtattccctttattcccatagaaggaatactgtatttttatgtaattttttgttttctaatgtgatttcttgtaatgtttaatatttcatccctaaaaggaaagacttcctagatgccatttttgtgaaaagacattgtgtagtgtaagaactgaaaaattagtaatttgtctctgtaaatgtcacaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctagtgagtgaagtttggttatactttgaaaatatactaagatggaaccattaaaaacagtaataatttttattatctttcatttgttcaagaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggtgaggaaatatgcctcttaaaagctattatattaaactggcatccttttctctaattcatttcatttacttacttattcagtaaacattaagcaactgtcttgtactaggcactgggaagcaaaaatgaagtagacagggtccttgtgtgaaaagtagcctgtcaaggagacaaactcagcaaatatttactgagcactgcttcgggccaggtgcttttgcagtttctgaggctacagcagggacagacactctgtcttctgggagcttaccctctgtttgcaggaggaacagagactaacaaaataaagtgtgtactgtattagaagatgaaaagtgctatggagagtgagtagggaagggaatagagagtcctagggataggaaatgttgtgattttaactaaggtagccaagacaggtctttctggatggtgacatttgagcagagacttgaaattaatgacaggctaagccatgtgggtatctggcagagcaagatctaggcagggaaatagtgccaaagtcctgaggtcgtagcaggactctgagatgccagttacagcaaggagactactgggtagagcaggtgggagctggatcacacagaacctgtagtccaccaacaggactttggctttactgtggtaattacaataaataagtacacttaagtattttagggggtcatatgagagctatatgtatactaaatagttggagacatacagagcacttttagtagttctgtcttcattttaaagcctatccaaagttgttataatatcacctggtttggtatcaagtgctgaactacaggggcatcaaattcatgtaaatattgcctgtggatgatcatatttgcctgtgattcctttatgttaggctttttctcagcatgatgtttttgagatgtgtccatgttactgagtgaatgactcttttgtttcttttcatcactgagtagtgtttccttatgtgtccattcacctactggttgatattcaggttctttccagtgtggaacttttatgaataaaactgcagtgagcatttatgtacaagtctttatgtggaaatggtttatttctcttgggtaaacttttaggaatggaactactgtgtcatgtaagtgtatatttaaccccataagaaactgtcaggctgggcacagtgggtcacacctgtaaacccaatactttgagagggcaaggtaagaggattgcttgagctcaggagtttgagaccagcctgggaaacatagcaagaccccatctctaaaaaaaaaaaaaaaaaacttaaaaattagctggcatgggggcgttcacctgtagtacctgcctgaggcaggaagaccacttgagcccacgatatcgaggctgcagtgagctatgattgagccactgactgcctgggccacagaatgagaccctgttcaaaaaaaaaaaaaaaaagagagagaaaagagaaaggaaagaaagagaactgacaaactgcaaagagtttgtaccattttacattctgatcatttaatttgtatttccctgaaggctaatgatgttgggaatcatcttacatgtttattggcgagtattttttactgtgcatcttcgttgaagtgtctgaacaaatcttttgcccattttttattgggctgtttgtcttactatttacttgtaaaagttctttttatattcttaacaagtcctttgtcagatacgtgttttgcaaatattttctcccaatctggcttgggtttaatttttgttagtggtattttttaaagggcagaagttttaaattttgatgaagttcagtttaccgttttttttcttttggtgttcatgctttttatgttctatctgagaaatctttgactaccccatgactgcaaatattttattttcttctagaagtttttggggcttaaaaaaataatttttacaagtttttataaattgaaaaaaacttaaaattttaagtttcatagttgtatcttatatgtttaggtctatgagctatttcaagttgatttttgcagatagtataaggtaaaggttgaggtttatatttttacatactgatacacagttgttatagcaccatttattaaaaacactggcttttttcccattgagttaccttggtagcttgttgaaaatcagttgaacatatttgtaatggtctattctggactctattctgttcttttgatctgtctgtcctttaccagtacctcaccctgttgatacctaatttttgaagtcaagtgatacgaattctctgttattgttctttttagaattgtttttggttattccaggtccttaacatttccatgtacattttagaatcagcttatcagtttttacaaaaatgcttggaattttgttggaattccattgaatttataaatcaatttgggaagatttgacatctcagcaatagtaaatctatggcataaatctctattttggtagttataaatttctctcagcaatgttttgtagtttgcagtgtccaagtcttgtagatactttgtaaagtttatccctaagtattttgtggcttttgatgctattgtatattgcatatttttattttagtttccagttgtttggtgccagtatatggaaatagaatttatttttgtatattgaccttatatctgtgattgcttaactaacttcctttgtgtgtcttactttgttgaccagaacctcccatactatattggatagaagtgggaagagccttgttccctctcgatgaaggaaagctctctcaccatagagtatagtgttaaccagggttcttgtaaacaccttttatcaggttgatggacttctccttttgctgagggtttttatgatgaatgggtgttgaaatagatcatatgttttttccccgcatctattgagataagtatgtgttttttctttcttattttgttaatatgatgaagtacatggttgccatttgaatgttaaatcagccttccattcttgggataaaccactcttggtcatggtatattaccctttattaaaatatttcactacattccatttcccattattttattaaggatctttttaaatctgttgaattcaattcaacagagatattggtttttagtgttcttctaatattcttgtctagttttgatatcagggtaatgctggcctcagaaaatgagttggaaaatattccttcctcctctattttctaaaagtgtttgtgttgaaatagcatttcttctttaaattttggtggcattcaccagtgaaggcctctgggcctggagctttcttgaagacttaattataaaattcattatgcagatatagggctattctgattttcttcttctccttgaatctgttttgattatctgtcaatgaacttgtttatattatctaaattattaaatttacttgtataaagttgtttataatattctctttttttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctataatattctcttattgtatgtaagtctgtagtatctgtagtgatgtctcttctttctttactgatattggtaatttgtgtcctctcactctgtctccgtgcttccttctccttttccttcctaaccccttcttctctcctttctcctactctatctctcctccttcttcttttcttgatcagtctatctggagtttgtttatttttaaaaaataagttcttggctctattgatttttttttttttagtaagcccttggctttattgattttctctgtggtatgtctgttttctgctttatttttgttctttttctcttgtttcttccatttacttatttggggtttaattttcttttctcaagcttcataaggaggaagtttagataattgattttggacctttcatcatttttgatacaaacattttaagctttaaatgtccatctaaacactgacattgccatatcccacaaatttttaatatgttgcattttcatatttattcaattcaaaatcttttttaaattttctttgtaatttcttctaattctttcacctttattgagatttatggctcagcatatgctctgtcttggggaatattctatgggcgcttgaaaagaatgtgcatgctgttgtaattaggtagagtgttccctaaatatcagttagatcaagttgattcatggtggtcttcaagtctcctgtgtcttgactgattttgtgactacttttattagctactgagagtggaacactgaaatcctgatcattgtggatttgtatatcttcctttcatttctgttcaattattgtttcatgtactttgaagtcctaagaaactccttatacatttgaaatttgagatttgtaaaggaaaaagtaccagaagttgattgctggaaattattttaaaatattacaaaatgcatgcacctttttaaagtatatttttcttttcttttttttttgagacaaagtctcactgttgcccaggctagaatgcagtggtgcgatctcggctcactgcaacctctgcttcccgagttcgagtgattctcctgcctcagcctccccggtagcagggattacaggcaagcgccaccacgcctggctaatttttatattttttgcagagatggggtttcaccatgttggccagcctggtctcaaactcctgacctcaggtgatctgcccaccttggcctaagtgtatttttctatgtgttaactctctttatgtgtcttttgttaactcttgaggtaaagtttcataaaatattctcctggaaaatttagggatgaaggccatgtgtttattaaactaagtattatcacctaatactatatgaccaagtacaatttttattaaagattgatgtttagactgttcacttattgataatatgataaaaatcaagattcccaaaaatgtaatgaagtgaaaaataaaacattctttgaagaaagaaaagtatgtagtaggtaatcagatattggttccctttctgtacagggattagcagatacttgctttggagataagtcagatctgatttgtgtattctgttttatcaagatttttttttctggtatggattattcataggagaagatgcttctaaattctagctattgagttaactctttctaccatttagacatgcattacacagagatttattccacataagccagtctgtatctaaaggtggttattccaaaatggactggtttttagcttctgatgaaaaattttaattaaggcatttttagtttttcaaacaaaaagtcaatacatagagctcattttttatcaaggtaaaaataaaagtcaaatattctttattataacctaggaaggctgccattttactgaaacatgcagaaactatacaggatattttcggctaaatttaagcagatactgttcttggcaagttaaccacaaaaattccaaacagcctgtgcagtgtggcttaacttttttcttgtgtcagttaaaaaaatagttgcttcaaaacttttgtgtacctgtttaaaattccatccagtgtggtggaaaaatatatacagcagctaagattctagttgttaaaaatctttgatttctgtttctaacttcaggtatacggtaaacctaagttcagccttagtaagtatcaaagttcaggatagagtaatagggtagctcctatttagaccactgagttagtttacaaacagtaggatcactgcatttgcatttgatcccggtgccattggaagatcattgcttcaatttatctctgtggagtagtacttaatgtacattttttgaagcttataaatatccggtaagtcaacaaaaatataagaaatatcagggaagctataactgtgtagggaaaagcatttggcaaacagagttaatttcttggaaagaaagcaggagccacacctaattaataattaaatgcagcttcaccatgcaggatttgggaagagtctgagaaaactgacttaagctctgcctggatcttaatgtagatgtggtagccttccctgtcattcattactattttcctccttccttcccaggaatctcagcaaatgcttggaagacttattccagaaaaacagatactcaatgaccaattaaaacaagttcagcagaacagtttgcacagtaggtgttttatttttaaagttgaccttttctttattctttctttttttgacatggagtctcactctgtcccccaggctggagtgcagtggcgcaatctcggccaactgtaacctccgcctcccgggttcaagattctcttgcctcagcctcccaagtagctgggactacaggtgcatgccaccacagccagctagtttttgtatttttagtagagatggggtttcactatattggccaggctggtctcgaactcctgaccccaggtgatccatccactttggttccccaaagtgctgggattacaggtgtaggccaccgcacccagccttttcttattttttaaccagcaagaatttccttaagtgaaatgagaacattaaaaaacattttcctcactgcaaattaaagtttttcttatctttgcgacgtttttctaaaataggagattcacttgttacacttaaaagagccttagaagcaaaagaactagctcggcagcacctacgagaccaactggatgaagtggagaaagaaactagatcaaaactacaggagattgatattttcaataatcagctgaaggtaactcttctatgtgtgcctgcatgtgtgtcctacctttaatttttttaactgtccaaatgattagttgctatttaatcacaggcagaaaaatttattatgccattgtgagacaatctaaattgcacttttctccttgaaaatataagaatgaatttggcatctataaattagggctgaatgagtggccccagcatgacatctatttttaacctgaatcatattttgacacatctccattcttttgtctgtttatagtcacatcaagttgattccaaaagctttatctttcttatgttctttgaatactactaaaagggattgttttcttttttaaaactaagaatttttctgccacttcttatcttcattgcgcttaaatgtagatctttattttgttacctcatttttaaatcttactgttttagtggagtaattgcttttgtctcttgtggcagaagtggtgtatggttttgtcacatttgcacagtaaaattgggaaaatgccaaaactctgaggaaatgtaaaatggttagatcacagcctttttcagatttggtgtttctgatttaactttacaactgtatcatcttaagaatgttaattcttggccgggcgtggtggctcatgcctgtaatcccagccctttgggaggccgaggcaggcggatcatgaggtcaggagatcgagaccatcctggctaacacggtgaaaccccgtctctactaaaaatacaaaaaattagccgggcatggtggtgggcgcctgtagtcccagctacttgggaggctgaggcaggagaatgatgtgaacccaggaggcggagcttgcagtaagccaagatcacgccactgcactccagcctgggtgacagagcaagactctgtctcaaaaaaaaaaggaatgttaattcttaaaatcagaacacaaacagtttatttcttataaacaatcatatactactttagatgtatgtagatattagcatttttgttattcttataagaaattggatgttatacttttttcccctccaaatatttgttttccttttctaacataaaattctttttaagccaattcagcttttgacagtgggaagaagtaaaactcctattctataattctaaaaacaaaattaaaaattagcatatttgaaacttttataatagttgacctttggattgagattctaggccaaattgtctagacatctgagtttgaggtatgtgtgctgttctttcagagtattaggtaatgatcttttctcaattgtacgattccaggaaagtgctcttaggggaaatattatttgagccaacttagtgtttttcttcactttgctttcatgcttacatggtgtgtgtttgtgtgtacactatatatgttctatattcatgcatatatgattatgtgtggtatgtcagtattggaagtacagctgtaaattaaccatctctagaataagtgcaattagaaacaaaaaaacaaaaaagaataagttcaattaaagtatgctcacattaactttcattgtcacttgtctcttttataagcaaaaaaaaaaaaaaaatagcactgttgcaaagcctatgttgctttttaatagtctcttgggatataaactgttaaatattaagctctcttctgaacccaggcagtagtccagatttgtgccttcacattgattctttttctagaaatttgactcccctaaaaaaggttcaggtattagaaaatgatactctagtgagaggcttttgataaatgtctagaagattaaataattttggtgattgaatttctgttgccattactaaagagaacacccttaatatgtggcgagtcacccctactttgtttaattgactatggctgctttcagtatcacagagtttcttacataaaggccaattttagcccccttttccactagccctttttccaaatatgcttatttttaaataagagtatttcttcttgttttttaattttaattttggctttctcttattaactttaattaatatgatgagtttaaaaaaaatcacaggtcaggtcgggtgtggtggcatgtgcctgtaatcccagcactttgggaggcaggtggatcacttgagcaagtggatcattcgagactagcctgggcaaaagggtgaagccctgtctctacaaaacacacacacacacacacacacacacacacacacacacacacactagtcaggtatggtggcatgtgcctgtagtcccagctacttgggaagctgaggtcagagaatcacttgagtctgggaggttggggctgcagtgagccatgattgtgtcactgcactcctgcctgggcaacagagtgagaccctgtctcaaaaaacaaacaaacaaaacagtaaacaaatcacaggtcagtataactatattgttttgttatttaacacgcatttggaggacttagtgaatatgttgtgttatggttattatctctagtattcctctcaaacctgataaagccaaaacaaacaattaaattggagaatcaaaagatttatagaatttgattgagacaactcagagatggatttatcatttagtctcttaagtgtcacttgcccacttttctttgttgtagccacactggaaaatgaaatactttttttgtaactttagagcatgtgtccattagcaaccatgttttcttggatgaagagataggccaggaggagccagtctcctgactcttggggtttcttcagtgcccctcttgatcggcagtgcctttagagcatccacgctgttgatgcaaaaattacttctgccttcctgggatgtgtcatttcacacatctaacctgatagtgtgaatttgttgtatcctaaaccttcctttccctaaaggaagccagctggagagtacagaaaagaaattagggcttcctgttcttttgtatttcatgttcacgtagattgttcacctggaagaaggaaatgcagttccctcattataggttagtactgtaacactggaggaataccttacagagtacagaattttaaaattagttgatcaggatactaaatctatattaagtggctggctccacaaatgaggataacatttaacaaaaattgattctcactattttgggtaaattgcaataagtcattcacctactttgatgcatgctcagagttatgtccagtttcttaggtataaaggtaatacagggaataatcgtaccctggttcagcccagattctgagttataagacagtgattaggaagtataggaagcgtatttagtcaaaaaactaaatacacttatactttccttttcttttaacatacaatctgatttagttctttctctagaatgtcttgctcagattaatttgtcttttgtgggtttctcccattttcttcagttcaggaagaattccttccttccctacccaaaatctgataagcaaagatagaaattctcaaagcattaattaaagaggaaaaagttacaggttaacaggtatttgtctcgtataggaagcaacctgttgaaaacataaggcatacttataatcgtgatcttctgttaaatggctccatattcaaagtcgtgggcctttaagtttctacctaatccatggaaattgaaggctcattttttgttttccaaaaaaggctgtttttccatgcgttttaatagatatttaccttttaggtgtcatatttatatattcaaaaaaagatcctaagatgtaaatatctttctatttaccacccaaaccaataattacttgagaaaggaaacaggaatcttactgtagcaaataaactttgcttttgggttttaaataagtctgtaaaaacagggagggtgggagaagaggagaaacgatagcaccctgaaatattgaagctcttatcctacaaattccccaattggcagcctttgtacttatgctgcccttgctatgcatgataaattttaggtttttgattatcaaatgaaatatttgaacagtgaattaaccaggaataattaattttgttgtgattattgctagcatgaattagtacatcttaaaatagttttaattcagtgggtaaaatttatttaccattaatttctgcttttaaaatgtgttctgtatgtaacaaataccttattaagaaatcggtagtcttctcagatccacgttctagaaacaacaatttaaaattattatctatgacttctacttcagtttacatgaaaattaaaactcccaacttttttggagactctgtgtaccaaaagggtagtttttcttacacacagtgcttacctataggcataaaattatgattcaaacaagtgttaaataacattactgctaggactttttggacagtagcacctgactttaccttgaccttggcgatgtcagtagttactgtagcagttttccttggcactgacagcctaatgttccatattttaatgtcttagctctaagatggagcagcagcacaaagtacagcttgtagttttccaggctcctttaagaggtcaaataaggagaatccaacacccaacggagctagattttatgtttcatgttgaaaagttgagtccttgttggttcctgtctagtcagtgtgtactggacaagtcctaatgtgaatggccgtttacatttgagcatttctttcttccagtcagtggcaatggaggaggcagtgttgcagtgcctggcagttctcctgggctgcgtcatccacttagacttctttctaaaggtctccatgccctactcaggcaatgcacatctttctcagactaagaatgatgaaccatctccagctctgtgcttcagtttcccctgcgcagatgagtgctcagtgtctaagatagcatttaccatgaagtactaagccttctttataaaagttaattactagttattattaatcgtggagtatgattgattctttcctattgacgagttgcgtgtgtgtatggtggtgtaaactgaattacaggctggacaaggtactgtatactgtagtcttgtctttttaacaagcattttagatcattgaatttgagcttgtctgcaaaaatgtgaaagcgctcagttgttatttgggtcatgtgcatgtttccatcatgggagacatactgtgatcagtatactattccaaatgtgtatagcattttattttctagcaaagtttgaatatttaagactaattcacaattatgatttaattccttagtatacttgggaaatccaggcttctaaaattagacacaagaggctgttagaaatataaattctccccataatgctacctgttctaaaaattgctcttagaaccgaatcgatgttgaaatgagaaggccagttgtagtaaatgaggttgtttgcttaactaaagcctttatactcttggtttcagacactagctttcatgggaggctcattcattatgaaggcagtgaaaggcaaaatgtttagcaaccagaggaaaaaagaaaagagctggagaaagaactgcagaacagagtaagaagtcagggaaaaaaatgcttgtgaagggaaacaatgaaggaaggagaaagactcagaaagaggaggcacagagacagtgagagaaatcagtatgaattcaaatagccatgttgctttgtcataattagtagaataatgtttggttctttcattctgttcaagctaaaattttatttttacctatatgatcctttggaaaagacctcttatgcacagaagtaataaagtgctctaactctcattctgtcagattctgtgccataccagtaggctgcttggttgagttttttagttacagcatgggttttttttctttttaaggttgtaaaaatttaataaaagataatttgggaaagggttaagaagaactcagtcttttgaaaaaatactttcttctcttaatggaatattgctttgtgactgaagcagacactttgagggaaattcagattttcaggacaaaatggaatcagttttctctttctggtaatgcttcccaagggtacttcccaaagcctcatggcagagggtgtctgattacctattactattgcagagaggacaagagcttctagctcttctgcccacctccttccacacacacaccttgctccaatctcccttagcacttgtgacacattgactaccattttgtgccatgggaaatagtcttattattttgttaaatactgacttcaaatttaaatttttgaacatgttttcaaacagtatatcccatttcagaatttaaataaccagtcaggccaggtgcagtggctcatgcctataatcctaacactttgggagttcgaggcgagtggatcacttgaggtcaggagtttgagaccagcctggccaacatggcaaaatcctgtctctactaaaaatacaaaaattggctgggtgtggtggcatgcacctgtaatcccagctgctcgggaggctgaggcaggagaatcacttgaacttcatcacggcagaggatgcagagagccaagatcatgccactgcatcccagcctgggcaacagagcaagactccatctcaaataaataaataaatgaataaccaatcagtatatatttttctgtatagtcctctcagttttaatgcatcgagaatgaataaatgtagcctggtacagtgacatatatctcaggaggctgaggtgggaggatcacatgaagccagacgttcaaggctatgatcgtgcctgtgagtagccgctgtactccagcctggacaacacatgtctctaaataaataaattttttaaatgaatgaataaatttataattttatgataaatgggctatcagtttaccttgatttgggtatagtttctgtgttctgaaatcgttatttttcaaaattttccatacaggcacaagttctcacctcatggggtttgttaactggccttctttaatagctcttcatttgtttcacaaccacttaatttgaaaaagttaatgtattttaaaactccaaaggccttctataaattttgataccgtatactacatattatccctaggtgagaaataatgtttatttacagaaaagcacttctactttggactttttatggatgtgatattatagataaacacctgaaatttctgatgctggtagctacatcattttttaatgaggtcaatttaatattaacagtatgaagattattataaatgttatatgtgagctaaataattttatcttgatttatggttttgagttcatgaaatttaagtaattaagttatgtttgtttttgtctctcatttccaagagacatcctgaggcgaaccaaaagcaaaatccttcaaaaaagttaaatatctaaatcagtaaatacatttccattaactgctggtctcctttcatagacccctgttgctatttttttctcttcatatacattatgcaaagtaatgtttgtgaaaaggaatcctatatattgttcaggcgcatgctactttatatttcaagtaatattgtttcacataatacatgtatttttgagtgtctctaagaccagatgaaggagaaacagtcacagttattaaatcaagtgattctgtgccttttagcttagcaatagaacaaacttcttcagtaaacctgagccacatttctcaggggaaaaatagttggattttcttgggtattcaatttgtcaaacagattgcttttgaaatactttggctctgtgccataggatgtccaaagatgttttatggttcaaatatcttagttctttaggggaaataagtgacttttccctctttggtctagggaagaaaattaaaagcaagttgattttcgtttatcttaactaatacaaaacagaatcttgatatgccagtaatttgttattgtggttcatgagctgtgcttgatcaaagaccccttgagactaataaaagctgtgagctttctccaccagaaaaatgcccatataccccaagtctgcatgcaacatagtatccacagggctgaagcttattcatggaacctggttaagaaactctgtattttcatgattctgcataaattgtgattttttaaaaaaaacttattttaatatttaatattaatatttaatatatgtgtgtagtatatatactacacattttatagttttattttttctgcataagtatttgttacatgcagctacaatttcttgactacttaataatttcttatttaagaaagtactgtaattatgttttattggaagataatatcaaattattacatactctacctagtgtaaaacatgtcatacacttgaatagaattcataaaagaaaaatcaacaaagttgtacactccgtactatattgctagattaatatccatccaagaaacaagtttttgtagaattactggttttagaaaaaaaaatcacttaactttaggaagaaccgagtgagatactgacttttgattcgtggtaatttgtttgttttctttctgttataatagcaaaataactgtgacaaattccatgtggatttaatagaatttgcagggtcatttaaatcaagttgcctaccaggaaatgttgatactttcagtgtggtgaaattttccttagccatttcccccaataatttgctcatttcctagatatgtaatttaatggcactagatttgtttgtcactttgaatttttttctttctgaaggagttaaaaggatacttcttaataactgtaactgtacttgagtctctttaatagtatggagaagaatgagagaatagtgtagccatctgctcccctatgtgaaaggactgggtattctacaaggactttgttctggcaaaggaaggagagtcattcactcatttttttaagagtatatatttcttcattctatagattgccttctcggaagttcaactttttaaaaagcttatcaacttagaaatcatccatgttctgcttatgttgattcatgccatagtaaactctttaagtccaagaaaagagaagacccagaatgcctgcctctgggcagcatgttgatttccttacaactgtgtatctcagcagtgtttgacttggatgaaggaaatgatagaaaaactttgccatcttgaaatctggatcataaggtgccagagccttctgttagcttatttgtcgtctgttattttatggttcctgcaagctccattccttggaggtgcttgaaactgcaacttacataatcagttcctaagatcggttcaaatactgctatactcaaaaacaagtgtgtttaaaaaatttaagtatcttttttcatgtatttgatacatttaaaaattatttttgaaactgtgtcataggtaggttttttttctgtagattcttcaaaatcactttttcttacaagcttttcaattttatagtctctcctaatgtattactagctttacttaaatccggtaatcaatgatctataaatccatatccagttacaagagcctagtatagaaaggaaatgtgcggtataattcttggggaaaaatgaaaaatcttcatttgtgcctatgggctatctattatagtatgttgatacatcatggccagtgtccattctggttgtgcagtacctgttgttgaatattttgaatatcactcatgaatacattttttcctggatgaaataaggacttttctttatttaatatataatcagattcctgaacatcaagctgaaatgttatttctcttccggcatttcttactcctttgtagggtttaatttcagctcagggttattttgcttatgcttttttcacttattcttgcagttaagaataaaattctaaataaaacagatactgaaataaataaatactttatttgtttgttagacattgtgatgaacaatgtctaagatttatcagatcccaaaactagaagaacacctaaagatcatccattctgattcatctgccagctcatatcagggacctgagattagaatcctggtttcttgattcccagttctgtaccttttttattttttatttttttgagaccgattcttgccttgtcacccaggctagagtgcagtggcgcgatcttggctcactgcaagctccgcctcctgggttctcgccattctcctgcctcagcctcccgagtagctgggactgcaggcgcctgccaccatgcccggctaattttttgtatttttagtagagacggggtttctccgtgttagccatggtggcgtaacttttaagtatagtcttttgctgtaaattattttttctgaacctatttaagaatttgatggtcttgaaaatgaaattttcattcatattattactgattatttattcttgattccaggttactatgaaaaccagtactactgattttttaacacattaaaattaagttttacatcccttggtatggcagtgagaaagatgatgaaaaatggacttctttctccctagggttgattttctgatctcagcactttaaacagtcagtgtgaggctgcatcattgctttccagtcttagccttcttttccccttccctctgttccacatgtcaggtctgctgccatagggaacagtccaatttgtgccttacaaaggtaccttttcctgctgtgtcctgcctggatgttcccagtgtcatctgctaggttccctactgaagccccttcttcctttctttttcctccttcccccttccttcctttccttttttccttcttcccttcttctccattttccccttccccttttcctccagtaccttcctcttcctaagtacctccccccagacccctatctccagttaaactttttcttttatctcattgttcttttaaagcctctcagcgtcacttacagtttataaaacatttgtgtatggattttaactttaaccttagcaaaattagtaggaaaaggttagcctaacccttaggatttttttccaataacaagtgcattttaatactgactttctacagacaaaccgtctacctttgttgttcaatctctgaatgaatctaaaggtaggaattttagggcctggaagaaacctacctgcccatctagtcttgccagtgagaaaggtgatagaagacgacagggcaaatcttagtccttaactctccccatagagatccctgggccatgtactgggaggaccagccctggttagatcaagaaatcagctggaaagataccttggctctactgggcactttgactcatctgatttatcgctggcccacataagacgagtttcagtgactcaatctattggtgaccatttgatttctatggaatcagggagtttcttcctcagcagacgtttccttattcttcctattttcaggtgtctaaacttgtgacttgagtactttaaatatcatagaatgcattttattttcagtagcctgctaaggaaattactgctattcctgcagctagtagtatcaagtgaggaaattggatccaaggtattcatcatcaaattatagctttttacttttaacctgattgctggtttagtttggggcagttagcgacttgaaggatagatttagtaagaaaagatgctctggaagaggagcaacttgaagaaaaatagaccctggggggaagaattgaggtcaaagaattgaggagcaaagagatgtccatttgttctaaggcagcttagtgaaaggtggaggtgaggtttgaatggaggtagtcagtgaagaagaggcatctgtattttcaaagccagtaaaggttggtgttgattgataatcaaaagaagcttaagttttattcatgatcatcgtcatatcttggaactggttacgttccattatgattgctgagcctttagcagcagagctcacctcctgcccttcgctagcaggtttcttctagagcagatcatggaaaatggtataatgtgtatggctcattagaatgtaatcttaagtggcctttggaaatcagtcatgtcaaaatgtggtgtgattctagctttccaagttgactttttccaactctgaaacgttatctcctaagtgtcctaggcttcccactatgaaatgttgcatgctgataaatagttgatgtacctgtcactcatgtcgctacatgaactgtttctcggttaattataggaactaagagaaatacacaataagcaacaactccagaagcaaaagtccatggaggctgaacgactgaaacagaaagaacaagaacgaaagatcatagaattagaaaaacaaaaagaagaagcccaaaggtgagtcttctttggattgtggactcatctggaaggaactttgaggatttactattctttgcttggcttctccaagtagttactgcaccagaaagagccttcagtctttagtgtgcatgtgaagtgtgagtgcaaacacaaacacgtgtatatatgaatctttgcatgtatcagtaccctctgaagtttttggttggttcccagagctctctcaagctactactatgtagataaatggaattatacaaggaaattgggacacttggtgtgctcatttgcatgctaatggccagttcacagccttttactaacagctaacaggggttggagtgcctggtttaaaatccaagccactgagctagtgccccacacagggcttctccagcagggtcagggtgggcctcttctgtttttcaactgcaaattaaactttagtacaaaagggggaaatttgccaccgctgcttagtgtgtaggatacagacatgtttttatctgtttttgtttgaagatttatttgtgatatttttatttttacttgtaacttactgtagtaaattgtagaaatttgtgtctgattttgttactgggtatttgccttttaaatgtcagttaattttagactccacgaaacaaaaatgaccaaatgtcccaatgacagccccgtaaattataaaagttggtaattgaaattagattaaggccaggcatggtggctcacacctgtaatcccagcactttgggaggccgaggtgggcggatcacgaggtcaagatattaggaccatcctggccaacatggtgaaaccctgttctattaaaaatgcaaaaaattagctgggcacggtggcacgcgcctgtagtcccagctacttgggaggctgaggcaggaggatcacttgaacccgggaggcggaggttgcagtgagctgagatcatgccactgcactccagcctggcaacagagcaagactctgtctcaagaaattagattaaaaaggcgaagaaacggatacttgaggcaagtcattgactttagtgggctgagttcagttaacctgccaagagctgtgcatactttcttatgggtatatagagtcttctgtttgtttttcagtgccagtggggaggtatctggggtcccagaccaatttacaggattgttttatggttttcttgggggtcagactaaggatctcctccttggatgttgattaactccatccttttcttacccccagagtttataaaatgcttttattattcacactataccacactgaactgttaaattcctacagtgtagaaataaacataaaatacagaaaaatacataaaatagcataatacagaaaatagcataaaaatataatatggaatatgtattccaattatatagataaaaactgcaaattaacgtcagaaattagatggttatacagtatatatggtgaccttcattggtagaaaatataaagtaattcttttttttttttttttaattttttattttttgagacggagtctcgctctgtcacccaggctggagtgcagtggcacgatctcggctcactgcaacctccgcctcccaggttcaaccgactctcctgcctcagcttcccaagtagctgggactacaggtgtgtgctaccacgcccagctaatttttatattattagtagagatggggtttcaccatgttggtctagaactcctggctggtctagaactcctgacctcgtgatctgccctcctcagcctcccaaagtgctgggattacaggcatgagccaccgcgcctggccactgtttttattatggtttttttgttgtcatgaataaccatatccttacccctccaaaaaatgtttttatactttcttaaaagacattttaaaaattgtaaataaaatgtttaagatttaagtttaaagacttctgcattaaaatatcacattcatacagagtagaaataaatgtaattttttgacaatggagaataaaagtataatttgtttcaattatgttcccgtggcagattcctaattctagccgatgacctgtgtgcgttagccatgtcacaggatggcagttcagggtggagactctgggaccaggctgcctgggattgaagcccatgcatgtatggctgtgtgacgtggacaagtcatttaatatctctgccccagcttcctcatttgtaaaataggagtaatactaggactaccaacctgattcgcagtttaaaggagttaatatatggggagctagttattattatgtcatttgttattacatattagtttcatttaaagtattttctgactttataaagtattatggaatgagaaaaatcattctcagtcttttactgtgggtttcaggttgaggccatcaaaaatttcaaggcctagatttaattacaattatctatttgtggtagctactttgaaaaacaaaatcaaagtagttgaagtcaataaaacaatcccttgctttcaacttcaggtttggggagcaatgtgtgtgcatgtaaatgtgttgttccctttgctggggggaaatttttacagtgttgggtgtattttatttttatagaagttatgttctctgtgttttatggctttgtttgtttgttttgtcagtttaataccagctttattattaagaagtatttttcttattcttgtaaccactttgtaaaatacatcagaaattttctgtgttttcctaaatcatgtgatttcttctcattcagaactggagccctgattcagttgccccatctgaacaacaatgttcccttgatgttcccatcccatttactggatggagctttttttgtgaaaagaggcaacagtagtgttaacttagagttgctttcttgctgtaatcaagcgtgtttgttggcagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcaggtattagaagccaaaaataattatagaaaataagtcatcttctctcccagagcctcctgaaaaatgcccctatctcatcagtacctgtcttggctacattaacagatgagaacgtcagtctcttattttgagcatggccagctcttctttccccagggtcatttgagatctgtgtaattctcccaccaccatgccagcctctggcccacgttacactggcatccacgagtcctctacggagctaacaagtggcgtgaagttccagtggtcttatatgctgcaaaagaacctgctgtttctctggtttgttatttccctccctggaatttctgagctgtttctgcaacagaaagtggcacctttcacccttgcctccactgatggggcattcgctgtcttcggtctgcattgcataaaactgcttttactttttgaaaaatgtaaaagcataatttgccttttctttacttctcttttctttcttctctttccttttcttttttctttgagacagtgtctcactctgtcgcctaggctagagtgcagtggcacactcatagttaaatgcagcttcaaactcttgggttcaagcaatcctcctgtcttagcctctcaaggagctgagactataggcatgcaccaccatgcccagctaattttttttttttttgtagagatggggggtctcactttgttgtccaggttggtcttgaactcctggcctcaggcgatcctcccaccttggcctttcagagtactgaaattacaagcatgagccaccatgcctagcctaatttgccttttttttttaaaaaagggataaatgaaagactgaacaaaaagataaatgaaagaccaatctaatcggaatagctagaaaaagctatcctttataatatctgatgtgagctagaatgtatttaagattcttgtgtggttgtgtgattgtacagttttgcaaataatgttcagtggaagcaagtcattgctttttctttgtgtggtaaattataccagttttgcttggtcatccatgtgcttctttagtgcttcagtatacagaaagaaaagaaagaaaaaacactttcaagctattctgtaaaggtttactggtccccagctacatagtgggcagagatgggcgtgaggtatggagttgcattaggcacctacctgccttcagatgcatgcagtccaggggaaagactggcaggtcatcagacctacagagtagcaaccatgtcataggaggggcaaattaattttttgatagttttttttttaatctgaaaataatttcaccattgatcttaggaagttagtttaagttcttcatgcgtcctcctagtataagatgaggatttatttttccccttcagtcagtaggaaatcttgcatgtcatacagttcaaaatcatgtggagataatacttccccctcgttgcttttcagataagataggtatatgtcaaaatacttgtagctcttgagtaaaaatgcccaaaggtctgttactagtttttgctaaccagaatccaaaatatcctccgctcatgtgcatttttaaacattttatttcatgtaaaatctaaattattttcatctaggtttcatccttaggctaattatttcccaaagaaatgtagaggaagagtgtcttcatcggggattatcagtataaccaaaatcagcacttagtttttatatgaccaggttaaagagcctaaaacatctgcattttcatgtttcagtatggaaactggtgcctctgttccctcccaaacaagttgactccttggctgattcagactttgggtcatatcctaactgctacattgtactcaacacactgggtagggaggagggcgggtattgatgctttacagatctgcactgctggagcccaaggaaagaggcagagacaagggacctttaggcagcctcgccgcacccaggcttggagtgacctttgtttagagagagtcactaatgaactctctcatgggtttttgttgctgacgtcagatttggctgtgctttggcattcagtatgtgtttcagaaattccttgaatggagggaaatagttcagaggttaagataggcaatagaggagaggttagttgtttggcttgttgtcatacatttgtgttctctgtaattatttatttttgtcccccccacctttttttgtaaacagaaaaaggtccacttaccatttctgcacaggaaaatgtaaaagtggtgtattaccgggcactgtacccctttgaatccagaagccatgatgaaatcactatccagccaggagacatagtcatggtaagaaagactccagtgagagggtcatttctgttgaagattagcctctgtcctctttttttcactttattcaacaattgtgagattgtcagtgagtatgaaacccaataatccagcatctagatttttaaagtataagctcaatcttctttcttttctattaaaatgaaagatggcatttaaaaaaatgtatcctaacatcattttaaaattgagttgataaagacagtgtgttcttatttttaaatctataaatgtctgataatttcagagtttagattactacttatatactatgagtatacatatatatgtaatacatatattttatatatgatgtatagacaatatatatactagtgtgcgtgtgtatatatatgtgtatgtataatatatactagtgtgcgtgtgtgtatatatgtacacatatatatacacacacaaaaggatcctccaaggtggaaggaggccaggagtctttaagaaatagttataagtgcaaaacactctatcaaatcattctcataattgcaataacttttgtatctttgcatcaaagcatcttttttccctttaattatgtgaacttttaattatgtaaaaagagtaatgaattatacagttaatctgctttcctactttgtaacagaaaatagtttagaattttgctttgttattgtttctttccttgaactaataatcattttatgatgtgactaaaactataggaaccagtttaagaaagaaaatcagacatggttgatctaaatcattttctaaaagaaaatagtagttccttgttctagttactctctttagagtcttagaagtagtcaactctgcattactcttaacattttttttttttttaaagataatttagattttttttttgttgtggttgacacaagttctcactctgttgcccaggctggagtgcagtggtgtgatattggctcactgcaacctctgcctccctgcaacctctgcctccctgcaacctctgcctccctgcaacctctgcctcccgggctcaagcaaagcgattctcccacctcatcctcccaactagctggaaccacaggcgtgcaccaccatgcccagctaatttttgtaatttttatagagatagggtttctccgtgttgcccaggctggtcttgaattgcctgggctcaaacgatcctcccaggtcagcctcccaaagtgctgaaattacaggcatgagccaccatgcctggcctagaatttgtaaagaactgtgaaagttaacaattgaaacaaacatgtttcttacccaaggactgtatgtctttgaagtataaagggtggtgtacaggtgattttactattactcatgcattcatcttgccatatacacatcatatctgtggatctttaataggctaaaatacctagaaataacaatatgtttggcacttagagaaatgaattcctgtgtccccttttttcctaatagctgctttctctgtaattaccatgggctagaagaagcaaggccaaacatcccaaattattttttcttttttttgagacagggtctcactctgtcacctaggccagagtgcagtggcatgatcttggctcactgcagtttccacctcccaggctcaagtgatcctcctgcctcagcctcctgagtagctcagaggcgtgtgccaccacaccgagctaatttttatttttttacattttgtagagacagagtctccctatgttgcccaggctccagatctttaaaagttaaaatcaccttaacagtagcaaaaacctcttcaagtatactccatggcttcattcagcacacagttattgactgaaacatgctgggtgccagccttactcatcctttacagaaagaactgttggtttgggcatgccactctgtacacacaaatggtaacttgagccagcggggtgtgtttctgtcagctttcctctgacttcaccacctgctgtttcctacaccgtggtttctgatagcctgaagctactttactcatactgcctcatatttgaagtagtgtatcctgtaaagcagattaattgtaaaatatgtaaacaccatataataggaatctaaaatttctgaaaatacaatgtcacatcagtgaggacctcattacaattttttttttaatgttaaacaaaccagcctaatatttttgaaactggattttgttgcaacacaaggtgcagagaagcagctcgctctcatcctaaagtaagggaatgttatgaaatgtgatgatgaggaaatgttgcaggtgatctgtatcttaatgagaaagtgttgctctttttcgggaacatatctgggcttcacttgtaatcctaggcctgttgaaaccttttcctcgaattggctagttaaccaccagcttgatgagatgcgtagagtttagatatgctgtaagaataaagcatgtcattaaacatatattttgccttgctttcaaacctttgctttcctggtggaggttaaaggggaatgggtaagtgttgcctaactgtcaggaagtctgcatcttattcaatgttttgtccttttaagtcacttgaattctgtgtaagtacacgtatctctgggtgttgttgcggcagtaaaaatgtgtttgagtctgtgtagtaggttgtgctttttaaaaaaaaagtaagtcgtaagtcttctcagtttgtgtactgggtttctttttgttagattccttttaaggactaacttgaatgctctgtgtttggcaagggattaggtcaagtctccatctcaggccatagacaaaaaggagttccaagtagattaaacataaaagataaaattctgggaaaaaaatttttttaagcagactattggaataattttctggctaagaaaggccttttgaagctataaaaaccagaagtcgttaagaggcaaaaatggacagtcaacaatatgcaaaaattaaaatgtctatgtttcaaaatatatgagaccaagggttacataaagggttacccctgttacataaagattccgaacagttcactttgaaagacacccacaagccttaaacaattggcagagggtgggaagggacattcacagatgaagtaaaaagtcagttatttaaaaaatacatgaaaagatgcttagcttcttgggtgatcagaaaaatgcaagttataaaacaaaatagcattgttcctctgtcaaatgagcaagtttaaaagtctggtaatatccagctttgtcaagagtataggacagtggatataatatacattgttagcatggttgtataaattggttaagcgatttggaaggcaatttggcagtgcctgtttagatttaaaattctcgttccctctgccccagaaattctatttttctccttcctctcattcttctccttcctcttttgggcacatgcacaaatatgtgtgtacatggatgttcactgcagtggtgttggtaaaagcaaataaacagcccaatgtccatcagtaaagggatggcttaaataaattatgatacagctaaaaaatacaatgaagattaaaacttatgtagatcacatatacacataagatttccatcaaaaaagcagaatatgtgcagcataattgcattttggttcgaaataaaactatatatgtattcatgtgtttatgtatagttaacagttttgaaatatatatatcaaactgttaacaatggttaccactgggcagtaaagaaggggctttcgtgttgaattttatagacttctatgttattttcatttttataaatgtatctaatttgtaatttttaataaaacaaaataaattcaaggacaagtatattagagagtatctactcaggactgtaataatgtttattatatctcagacctcccaaatatgtaatgaaatgtagaatgtactactaggcataattcgttggcttgcagaagggacagcagtgtttcgattttgtactacaaaatgcattgtgatactccaggtgccattcagctgtgttatctttgtgaggataacagtcaatgcaaaaagatagatattgacatctaatagcaacaggtttgtatttttttaatttcatgaattttgcagttaacaaatgatgagcatgagacatgtagtacaacattactgtcagtctccctaggttgaaaaatccggggttcacttatacttttgtgggcacagtcatcagattctcagattcctcaaacgtctttgggacatagcttactataatatgttcgatttttagaagtctaacattgtgacagtgttttttaatgtaggcagtcttagccttaaaaatattttgtttttagaaaaacttagcctggttttatccaaaactataatttttcatgtttaacaaaaatttaatgtggtaccttgtatatagcactattctcagcactgtagataatagaaaattatcaagtctgccattcatatgtttaaaatctttttagaaaaatctagagaaacacatgaaaaggccaacatgtgatgaagttctcaataaacattcactaactctgctaggaatttaaaagaggagaggaatcagtgtaaagtgatgtgctcagggaagaccaaatgctttcaattgagtctgaccttgatggctaaggcttagatgcgtagaaaatacatggcctctcttgatctggaactcccaatacttggagggtgaattaaatcaaatttgacatccgtaacatgttagtagaacataagaaatgagaagacctatgctcactgctgttttgttgaagtttatcttgagaacacaggctgagtgtctaaatcagtacaatcttttggctttcatgggccacattgcaagaattgtcttaggctgcacataaaatacactaacactaataatagctgatgaacttcaaaaaaaagcttgcaaaaaaaactcataatgttttaagaaagcttacgaatttgtgttgggcctcattaaaagctgtcctgggccacatgcagccagtgggttgcgggttggacaagcttggtttaaatgcttatccttggactggtacaggcctgaatgcatccagattgctgagggagcttccaaaaaataaccatgccagggctcatccccagagattctgagaactctactgcatatacagccttcagaagtctgaccaggtggttctgttaggtagtcaatttcaggaaccgctgatctaacctaatctctttttcacgtcaggactaatcctaaatcatttctagaaaatatcctcttaaaaatatccaaagaagaatggacttctttagtagttatcagtcattagccagtcagttcattctggaaattgtttgtcttagtgttactcttataacaatttttaactcattcttttccttttcttctcctgacagacatttttttaaatgtagccaacaatacctttttcctctaccttccatagatttccatagattaaacatcagaaagtatctcatttagtaacaactggccataatatcactgcagttttgagggaccagtatacacgattacagggttggctcaaatctggcccaatcactgcctgttttataataaagttttattggaacacagccaggctccttcattcacatattgtgtgctacagtggcggatttgagtagttgcaacagaggtgaaatttgccagcctccaggttggagctttagaaagagtttttttgtttgtttattttttgtttttgagacggagtctctctctgtcgcccaggctggagtgcagtggcgcgatctcggttccctgcaagctccgcctcccgggttcacgccattctcctgcctcagcctcccgagtagctaggactacaggcacccgccaccacgcccggctaatttttttgtatttttagtagagatggggtttcaccgtgttagccaggatggtctcaatctcctgacctcagaaagagttttaaggccgggcgcggtggctcacgcctgtaatcccagcactttgggaggccgatgtgggcggatcacaaggtcaggagattgagaccatcctggctaacacggtgaaaccccgtctctactaaaaatacaaaaaaaaaaaaaattagccgggcatagtggcgggcgcctgtagtcccagctactcgggaggctgaggcaggagaatggcatgaacccgggaggcggagcttgcagtgagccgagatcgcgccactgcactccagcctgggcaacagagtgagaatccttccaaaaaacaaagacttttaatatcctcatctaggaatttggggagaaaccttatatttcaaaaccggcaaatccatggaaaatgttttactacctgcactcctcaacacatcccatgcagccactgtcagctggtctgaatacacaggctaaacctgtttgctacacttgtttatcatgttctatgaggggaaaaaggaatttctgcttcccccctttgtgacaaggtcagagattttagaaatattaatcttacctaatgaagatggcagccatggagcatataaaaattgagaaaagaggtgtaatatcatcggcctttgccaaacggacttgaagctgaagtggctgctgtgtatatttgactgttgcatcagcgagctacaatatgcagtgtgtaattactaacatttagtagagcagctctgtaacatagtcccagaaatgtgagcaatatctggtgtttgtacttcgcttaaatgatgtttcactagaattacccccaaatacgttggggtgttacagtgtgcctgataaatgaaattgtattgagaccaaaattgttaataataacatctcccttatagcccccagtaggtaaatgtacattgtgtaaaagtccacgttggaaccagtcatattacaaagcagtttgtgttcctatttcttggtctgccataatcttatgttttccaaaattggattggcattttgggtagttttccaaatccaagaagaaatatttttcattttcatatgttgacctttgtgccctttctaagtggttaatttaatttaggtgttaagaatgaaagtctcttacagcccctgaaccttaaaatgtaataatttattaaaattgatgtatacttgtaagagtaaattaagctaattgagactattgtttggggggctgttgagaccaacagatttctttgcttaaaagtgaaatgctgatttcactgttatccttagggatgggagaagctcttgcttaaggggataagaggctgatatggccccctccttcactcctaggtgtacactgcaccagcaggctttctatcacatctgaggacaggctgggtgttatcagtttactggagggggaggacatttccccagggcttcaggtcgcattccagatgtccaccagtgtctcgctctgttactcaggctgagtgcagtggtgtgattttggctcactgcaacctccgcctcccgggttcaagcagttgtcctgcctcagcctcccaagtagctggaattacaggcatgtgccaccacgcccggctaatttttgtattttttgtagagatggggtttcaccagcctgaaactcctgacctcaagtgttccatccaccttggcttccagaagtgctgggattacaggagtgagccactgcacctggcctaaaagtcttattaaccagtcaataccctgtgtttcaagggagtaacaatagatcatgggacataattaagcaaagcagctgacctttgaggaggtccaaaatgagcagacgagtaggagttcccgtcgatcaagggatccacttgagcccctaaaggattgcttatggcaagaaggtaaacctagagggagcagaggaccaggcagttagagcagggaactcctgaacagagaagcagattgttacctagagtgaaggtaaagtcaagaccaggcttttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcatgaacccgggaagcggagcttgcagtgagccgagattgcgccactgcagtccgcagtcccacctgggcgacagagcgagactccgtctcaaaaaaaaaaaaagaccaggcttttagaataggacagaagcccaagtaggagaactacagcgcaacatcagagctggacagcagaagagagaatttaaaaaaaatatctggcctggcacggtggctcacgcctgtaatcccagaactttgggaggcctaggcgggcagatcacctgaggtcaggagttcgagaccagcctggccaatatggtgaaaccccatgtctactaaaaatacagaaattagccaggcgtggtggtgggcacctgtaatcccagctactcaggaggctgaggcaggagaattgcttgaacccaggaggcagaggttgcagtgagctgagattgtgccagtgtactctagcctgggtgacaagagtgagactccatctcaaaaaaaaaaaaaagctaacacttttagtatgccaggcattggtgtaaatatttgtcagtcctcacagtgagcattataataagacaggtatttttattatccccattttacagatgaagaaacaggtgccacgagattaaacttgcccaaagtcaaccagttaatagattgtagaactagctcctaaattgagacggtctaactgcagagccctattcttgatcattacactttgcagtcttgacactaagttattgtgtgtttggctcaagctcctaacccactcctgcctgacatcacctttggtcctagaaccaaggtggctgatcttgactattgaacctactgagaagtctggcaggacctggcttggatagagacagctatgtttccagtgtggagcaaagttataatgtgtcaccatatcaccaaaatgtaaacaaggaaggaaagacatctagccatttgagttcagcataaaagaagatccaaatgggggaaaatttatcttaaatcctcatctagagaaacagttggggctgcccagaaaaagaacagtaagaacaaaacaatgactgcaaagtggctagtgtgttcatgtgggtgtaagtgtgagcagaaatgatagaactgtgaagccaaaaattcaacctttggaagtgttattgcattttatacaagggaactccttttttggttgtttggagaattctcagctttaaaaattgcttttatctgtgacaataaagattccctaaagtggagcagcaagcaggcatcccctacttgctgaatatattgtaaataacaggtagaaatcagaagtaagccttgccttgcattctgttttctccacctctaccccaaacatttgttaattcaaataagctaataagtattgaaccctattactcactgtccactgagtacatacagatagatgtttggtttgtttaatgtaatcattttttgctttatttttaattaatttttactgaatacttgaatggattagataactggtatttttgtcagatttttccaaaatcattgttaagaccctgcctactcatgtctgatttctaagaagcaactttaatttccagtgaagtgtttgatgttttactccttaggcagcataggaaggggtaaaaataagatataaggtttcataagataagacccttataagaattatagtaatgaaaataaaattttttttttgagacggagtttcactcctgttgcccaggctggagtgcaatggcatcatctcagctcactgcaacctccgtctcctgggttcaagcgattcttctgcctcagcctcccgagtagctgggattacaggcatgcgccaccatgcctggctagttttgtatttgtagtagagacgaggtttcactgtgttggtcaggctggtctcaaacttccgacctctggtaatcccccgcctcagcctcccaaagtgctgggattacaggcatgagccaccgtgcccagcccaaaaataaatttcccaatagcaaatgtgattgtcctccaaagtcattctcctgttgctcataaaatagtagggacaactcgtaaagaaaagtagaatcgttttggccattttggatgatccatttgagtcagaattaaaatgcaaaccttaaaagcatttggcgtaataaatggcctctgtgaaatttttaaacagtataatcctggattttcctgtgcactgaatatgcaagttaaatttatacaaaagaaaactacaggaccttaatacaattgattattgctgtaaataatgacttccttaattttctcatcatgtgtctgtggagcttttaaatgcctaaacacagcagcagtcagctttgcttctcgtggaaaccatttaaggccatggtttttttttttaaatcttccttgtccttatactgaataaatactacttagttattggaggttttcagagtactgaatttatattgattgcaccctttgctttcaactttaagtaataaactcaagtcaaattatttttaataatgacatgactttctgatgaagcctgttaagtcacttcccaaatcaaaatatttaaattacatgcctcaggactccaggcactttgtctcaactgccattattaggacagttatggggtaaggcttttttaaaaagtgcagagaataagagcttgaattatagtgcattttttttttcagcattactgcttagactcttttcccagacacttggactaagatgaagagattcctatgccatatgtcaatctaaagagggcagaggcttgggacttcactgtagttgggtgctgggtctattcaggggttaatttagttctacttaaagctgtgactttttccacaggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtacgtgttggtgggctctttctgatgatttttgaaatcccaatttgatcatttcccccccacccccttaagtattttcatagtcttggattgtccttctatgtgagggagctggctcattttcagtactcctttctctagctggcgaattggagattacagtccctgaactggatttaatgatatcattgtctaacagtgacttaccatggtacaaaatgaagcctgttatcttgttttgttcaataatgtatttgtatctatcattcttgtggaagaagtggagaaatacagtttcctaataatctattttgacatccatgtcagtcagcaaattttcagagttatttcctgcatgcaaatagcacttttttttgccaggcagaagcaaaaattgaattcagtcatgtggttctgaataagatagaaagctgtttcctttaaagctttccactttcattaatcttatacaaatgtacagtagaatgaagaggtgtttgcacttggccagttagttctgtgccctggttcatcaggaaatggcattttaaaaactgtgtgtaagcagaggtttgaaatgatagatgaaatggttgttcagacttccagttatagggccatgacctagatgagcaattgtctaaaaatattttatactaggatacaagtatgagtgatttgaataagaagtgtttaaattttttttcaagtctaatcatctttcagaagaaacaaattgaaggcaaggaatccagatgtattgctggagaaggatcagatggaacaaatagagggaagaaagaataattactcagggcgggaggaagtggagggaaggatgtaaggaatagcaagtttttcatactttattttcacataaaaggctgaaggcgctaaagaaggtcccctcatctaatctctgctttaagaaaaaaaagccttccattagcttgacttccaagttgaaacttttccttactcttttggtcttgactgaaaagttctgagtttttaaactaaagcttaggctaaaatagaagactaataccatattttccaggatttgttttgctggggatcaaatcagtatgcctcttcttcaatatatgtatggtgtgcagttctcttgctataattatgggcaccttattttccaaatgaaaaatcaggaattattttgattttcagatttgtttgtatatcttataaggatgtaaaaagtaaattgcctttagatctgcagtcacacagacatgtttatctaaaattattttttattatttattattattttgagacagggtctcacttcatcacccaggctggagtgcagtggcatgaccatggctcacagcacccttgacctcctgggctcaagcaatactcctgcctcagcctcctaagtagctgggcctacaggtgcatgccaccatgcccagctaatttttaagttttttgtagagatgaggtctcactatgttgcccaggctgatcttgaactcccgaactcaagtgatcctcctgccttggcctcccaaagcgctgggattagaggtatcagccaccatgcccagcctgtttatctaaaattattaaaatcacaaaactagaactgtccctgggacccaggacaactggttgctgtcaggatgccacttgtaattgctgtggcatctaggcatactaccaggtacttgctgtagagtgcatgggtctgagaaatggtgttgagaagctccagctccataggtggcatgtagcttttttttttctcatttaactattgttattacaaatgataatgatcatgtgaggatgtttctccggggctttgcagttacagagtatttccctagcctgtatttcatgtaccctcacaactaaccttaagtggcacagtattgttcccattttatcaatgaggaaatcaaatgccttttcctctcctccttgttcttttatttatttttctttttgagacagagtcttgctctgtcacccaggctggagtgcagtggcgtgatctcagcagctcactgcaacttccacctcccaggttcaagcaattcttgtgtctcagcctcccaagtagctgggattacagactcaatgccaccacacccagctaacttttttttttttctttttgagacagagtctcactctgtcatccagtccagagtacagtgatgcgatcctggctcactgcaacctctgcctccgaggttgaagcatttctccttcctcagcctccttagtagcttggattacaggggtgcgccaccacacccagctaatttttgtatttttagtagagatggggtttcaccatgttggtcagactggtctcgaactcttgacctcaggttatccagccacctcggcctcccacagtgctgggattacaggcatgagccactgtgcccagcctcctccttgttctttcactgtagaaagccacattaagtatactaggtttgtgttgcacaggctcattggttgccatctttttcttttttctttttttcctcttttatttatttatttatttttttggtactttactgtgggtaaaaagctggcatattagggagtgcttgcttttttttttttttggtactttactgtgggtaaaaagctggtatattagggagtgcttgttattcatggtgttgtgcttttccctccaggtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccaggtaaaggcagccagtgagagtgtgaagacttagcatgctatctagtgccaaaaacttcagcaaatgctttttggcaatgtcattttgaagcaagccttgttatgtgtgtcttggttggctggcagtatgggaatccagtgcaggagccagaaatctgctgtgaatagttgggagttgggggtgggggtgggacacagtcaacttctcctgcctgggttgatgaaggaagcttcattgcagaagtggcacttgagctgcatcttgaccagtgggtaagatcttactagaaaatggagagagcctgcctgtcagacagaaactgctgggaaggctcgaaggcagacagtcagaatgtatttaaggaaaatcacatacccctccatttgtctagaccattgagttttttttggaaaaggtagaccaattaaaggttaatgggaggctctgaaatgccctgctcggaaagaataatgtctgaaaggataaaggtggttattctgaatagttctcttttgcttaatacaataatgataaaatactcaaatttctatcaataatcatgccaaacagcaagtgcccatctgggaggcactggaggttccagcatcatttctgatctgagaacacccagatggaacacagggtctaggcagatccatctggaggagcggtgtgcaggaagattagagtggagggccggcagggcggtgccaccagtcagggggctgttggtgtcacccagctgagacctagggcaggcctggacccagctgagttcatgttcaccaagtagggaggtgccggtggaagcagaagaggcgagcacgtgggagagactgcagaggagagtgaagaggttggagtcacaatgcctatgggagccgaaggaaaggaaagagggctgggattgagaataagggcccaccttaaagcgggaagggagaaaggcagaaaatgaaatgaatgcgcagttaaagggaagagttgtgttttagttgtgttgagttgaaggtgaacgtgggaccctgtctggcaggctgtcggaatatagatctggaggatggaagagagcacgagactgggattatagattggagccattcccatagagaacattatcggatatcaggaaatgtgtgaggtcatccaaggagagggaatacagggagaaaatagcaaatccacaggcacgtgtgtgttctgtggtctggaagaagaagaggagctactcagcaggaaatggtactttcctttgcatctgtcctagctcagcatttagcacgtgtcacatgctcagttaacagtaactcagtgatggggtgggggtttgttccagagagtggaggtgggggatgggaggttgcttatgttactaagtaccgtggtcagggcaaagaagagaccattcattgtgacaggtagagctttgtaacctgggaaggagaaggatgaaaccacactgcaggggcgtaaaaggaaatgagcagcaagaaagtggaaagatctgcaaaaggaaagagaaggaccagagtgaggggcctcgggaaagcaagaaccagccatgttgccagtggagatgggaatggaaaagtgaagtgtcagaggatatagttggtataaggcagaaaacattaaaagcacagaaaagacaggagtctttttcttctggatgaggaagagtgaagagattggagaagataaagccaagaaaaatgttcaagttgggctgcatgatattgttctcagtgaggagggagcctggaggggctgcggagtgtagaagaggtttgggagcaggcgaatgagggatccgacaaagaagaatgaagaattgggccggcgcggtggctcatgcctgttatcgcagcactttgggaggcaggcaggtcacctgaaatcaggagttcgtgtccagcctggccaacgtggtgaaacctcatctctactaaaaaaaataaataaatacaaaaatcagccaggcatgacggtgggcgcctgtaatcccagctacttgggaggctgaggcaggagtatcacttgaacctgggaagtggaggttgtggtgagctgagatcacaccactgcacttcagcctgggcgacagagcaagactgagttctcaaaaaaaaaaaaagaattgcctggcttaatttaacctgagtccgtaatagatcattgcacattgcctcagctttctctagcaatgcttcacagcttgggactaggaataataatagttatatagctcaccactgttatttctatcatagcaatactgtgcatggatcttactaaacttccttccccctccccacctacacacatcttgcattaccatgggattgctaaactttaatagccttttggagaaagtatcatctctactttacagatgtggaaatcgagattcagagagattaaacagttgccaaagccagaaaattagtaagtgacagacctgggattcaaacccagagtccacatccagcccaggctggggtcattagggcccatcaatgtgaaaaggttgacaaagcagacacggggaagatttctcagggggagagattctgaaataccagtgagggcacagttgaaaggccaaccctggggtccatacgtagagaaatcagtgaagtggcggagaggattagacagtgcagaagggctgtgggatgaggagctacgcgggcagcaggtccactgcaagagggggaaaatggaaggtcgagaatatacaatcttaggggtgttcgaaatccagggaaaccccctcagctctgagggacttgaaggagtgaatgtacagctaagtggaaggaaataggatagggatgttgtgggtttaagaaggcaagaacccatgaagaccaggaattagaggttatcaacatagatgctgaaactatttgacctgttgtaaattctctgctcatcagacataatcataacttaatgtcagtataatataaatgacttctaaaggcatgtacaaattggttctgaagtaactctctctaggcattatcttttgttcttgtccattcatatatatgattgaaagttggtgtttcattttttactaaatgctttaagatactgtaatggtttaatgctatagcttaaaagataataaatgcctcaccctgcctttccagcctgacttcctcctccacccctccatgagactaggccacatgcagccccggattgtgcttctcttcccggaccccctgcagtgttccacctcgaggcttttgcccatgctgcgccctcggcctggagtgcccttcctccgaagccctagctgtcaaagtccttctcatccttcaaggcccatctcagatgctgccccctctgtgaaatttacgctgatgcccccaggcagaattcatccctgttttctctttattcctgcagtgaatagtaggaactcctttttagtatatttcattctgccaggtggtacacttggttgtttttatctctgtcttccccattacttgtgaattacctgctagtaatactgcccatctttatagtgctttgtggttaataaagtgcttttccctaaattatctgggggaggcagagactgtttttttcatctgtaatctcatggggcagtgcatgtagatgtacaataaatggtaattacaatgaatttatgctaaccaaatccctgttttctctgaaaaggaactaaaacaagcataatccagatagggcctatttccctgggtctacctaatctaaaatgccagttaatgatctcatgatagttcataaaatgtctgctccactgttaatcctccactaaaaatgccagtcaaattggaaatggggaggtgtcccgggcaacttgagagtgaaaatagaaccaaaatataaagggcacacagccagatgcaacagaataattgtgacctcctggctttttgaaatagagagttctagatggtcagacaatgactttgtgaagaggctggaaggctttggcctccacttttggaaataaacaattgttgggaaacagtgaagcatccagccctcctgctgtgctgcctcagggccctttgtggctgtgtgtgcttgtctggcctgtgcttgttggagaggtgccatgctcacgtctgccctaattgataacaaagcgcaacataacgagaggtcctttatgttattccacacaagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaaggtatttttgtatttatctgcttgtatttgatgaaaacaatattaggcgttatattactgtttgcactagttaagattcacagacaggagttgcgggattagtttgtcttctagatcttttaactgcaaaagttatagtatatagagtaccaaaagggagcctcttatagataagtgcattctttcttctctcatgaaaacctatgtgccttgtttttcattgccttatgcaagaaggaattcagctctgagacctggaacactcttgtgcattagttggagattatgactctctttatgcttattacccagtgctgtaccagatatatgtgaatacttggaaacccaaaggatctggggaaatgatcagaaggacttaattgtctttttcattagggtcttatagcatggaacctaaggttgttaattcctccaaccatattgatgttcaaaacaaattatgagctttaaaaggatgaaaatagcaaaaatattcaatgagcatctctcagtcagtcatgccttgaaataaactagtacataagccatgtgtccagtatagcaaagtgctgaaaaataagaatgcgagcttagagtcatgcctctgtagtaccttattatgtgtttttaacctagctaagtacaactatttcagctgtgggtcgtttaaagttttaaaagttaagcagttttaacagaaaaatcagtgtcattgtacgattttctttgaagataaaaattaaaatactctcttcttccattattgcagcatggattctggttcttcagagagtcctgctagtctaaagcgagtagcctctccagcagccaagccggtcgtttcgggagaaggtgagggcctgagttgtattatgttcttcagaagggtcaaggacattgtgtaaatgtttgaaatgagattgaatttcatcttaagatagactgcatttatgatcagtatattaaactacagtaaaatgtaagtttagctctttacagaatcggagtacttcatggaaaatactgtcaggtatattaatcatcaaaaactgaattttctaattatattttattataagccctttgacttttaaaagagacccattcagttcactaagaatcgagttttccgagcatctctatagctaaactatggtcattgcttcacctaacatagtctagtctcatctgacttcatagataagtatttcgttttaaaagtaactacaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaataaaataaaataaaataaaagtaactacacagaccactagagttctcatagtaacatgaatgccatctgtaccatcccaaatgaaactgaaactcaatttctgtgctccatgaaaacaatcaaaccagacaatttaggactaaaaaaaaaaaaatcattttgagtatttattatgcaaataattgccttctttctcaatctccacttggtgacataatcctaaatattgtatggatgccaactgaataaaacttaggtaattcaggccctcatggtaaaaatctcacatcttttttacattcaatacagccatcatcacatcctaactggagagtgctccctgagttagatgggttttctgtgtagacatctgagcagtgttgtagttaacagatgccataactaaccaattctatagtaattctttatgggttccttgaatacattacaggagaatagaatgttttatttagtttgtctgccataatgagattgttaacattccttagaaaccttgcccagtgaaaaacagaattattaaaacagctgttttaggtggagacagcaaggattaaggtataatggtatttcagactcacagtaacaatgttcttttttcaagaggttttttaaagtaagaattttttttagttcatagtatagctataaaaccttatcactaaacaaatccagcatctaatttttgctattaccatgaaaatgattaacagagttccctttatacattctcattatcttaatgactttttatccactgttagggtaacaaggcaaaaagctcctttaaataccacatgcagtcagtttagtaaaaagcaacttatgcacctcaccaaaagataaagaaaaaaactttggtgtgttacatccaatcaaggctcactggagggctggagtttgtatcttgactcacccatctagtaacagtattattttgtttatgccttagcttctttgtctgtaaattggccgtgataactaccccttgaggtaggaaattattacaaggataatgagataacatgcagaaggcttttagaacaaagctcagtaaatgtctgctacttttatgtcgtttttgcttcattccctggattagtgataaagccacataaagtatgagcatcctcatccaatagcagtatggaggagtgtttgtttgttttgagacatgtactgaggactcaataaataggtcacaagtgaaccatgcatgtacttaaaattgggcaacataatagagttaaattctgatcttagtttgtatttattacagccaattttgaaatgacttagttattagaaatatttggaaaggttgctggctttgtgaaggggtgggaggacattagaaattctgagaaaagctatttacatatattaatgagccttttgtaaataccacattgaacataatcaaatttaaagtaaactgtaaaccagataaaatagatgattggcttgggttgcttttaaaatatttaaaatattggcttggggatggccagtgccctctgtggaatgtttcctgagaaggggtagctaaagaggaacctctgcctatccatcatcatgtctctgggtttcattgtcaccctaaagccactctcagatgtctttgtgcaaggcaggcagggcaaggccagcctcagtcttcccagtctcctttatattttatactgcaataccaagttcagccagagttcatgtttctgaagtttcttaagcatttggaaagttacttcaaaatttggatcaattttaaagaaagtaactttgaagttgaggaatcactggggaaagtattgatggccaaggatcctgtcttaaatggccaaatatgatctaaagaacagtaacagggagcaaaatgaaaagggaagggtgagagtatggagaagtcagaaaaatgagtctgttaatgaagaaagaatgaccctattaaagccaccaaactttgatttccttgtgtgggaaatcatttttccaattttcactgtggaggtatgtgttaccagcgcctcagggctaaagacagagagtcttctgttttccctgggacgtttgaatgacctgtgtctgccatggggcccagtgctctccaccagcaattgctgctggcctcggcgctgacaggtcaacactggcgctgaaggaggcccttgttgctccaggggctgcccacgtgagcacaagagttagaggtttttgtgtttttgtctgtttgttttagttttcattagtacctcctgcagaggctctgataatcaaccgaaggagttctccataaaaaattcctacctcttactcaacacgaggctcgacattaaaggaacatcatctgaggtttagagagaaacatacattgtccatcataaaaatgaactttttgggtaaatggtgatttttctgttgctttaaaaaaatacatacaaaagcctaggataaaatggagaaaaaggggaaataagaaacctgtgcatctttctgtaaatcttttatcctgtacctagaacctccatccaggattttgtgtctggtgatctttctgagagtgtgatttggttctaagccttaataaaatccaccaagagtgatgcaaagttctacatctaattaaaaaggaaagtttcttctgtaatgcacacccttcaaattcaagacacaaaggaacattagttcttatcctttaagactaaattacatgaataataaaatgtgataaactgtgatttgtctttttaacttgttgaaaggctttctgggattgggttagacattccttttatcatcagtcctctctacctgtttgtgctcttgaatgacaactagatgcccatttttaactaaacaatatgtgtaactcattttgtgttctaacagcttcctatcatattgtgtatatggcacaataggacataagttttcaggcacttcaataaggaaaagtatgtcttatttaatttatgcgaaggatatatgctatctaacaattttttaaaaacctgtgacgtagtaccctcaaaactgaaatacacatatttaatatgcttaccaagagcctgcatatgaatgcatctgacccagtgctcagcacagagtaggtattgtgtaactcttagttaaaaataaatgtaaaaaccattttcattcaaaaagaaatcatgatgctaaatggtagatcactcttaaatactcaagtgtcggtaaacatgcagttgggttttttattcctgtgtctgggtcttcccaggaattgtctccctgtctgcagctactgaacttttatgtgcactgggggaatgtggagcccagggcattctgcagctctgtattttatctgtgactagcctttctcttgaatggatcttgtcctaacttccttattcgtaaacttgcttttgcaaagctgtctgggatttctttaaacaatcaagctctctccgtatctcaatatttctccccaccagaatttattgccatgtacacttacgagagttctgagcaaggagatttaacctttcagcaaggggatgtgattttggttaccaagaaagatggtgactggtggacaggaacagtgggcgacaaggccggagtcttcccttctaactatgtgaggcttaaagattcagaggtaaacccacattaactgtttcctctccctttctgtgcggtgattctctttgtggggagtcacgatgtttgacagcggaactttgttgggttttgctaagttctggaatgtgacagtaaatccagtgtgacctgtcattgtttgatcttgtcatttggcactgcgcagtaagcactggcttcccccaagcagaatgccatcagggctaagtggaggctgagtgtgatggggctggtccgcatcagctgggaggataatgttcagtattaagctctcttcctgcctgtaactgacttacgctttggagtaaactttcttgattagatcattatggtcattgatttttaaatgcccaagaatggtagcaatattttgcctgtataaacagaagtattctggtgataatcgccccagaatattggatattattagaaagtttttagaatttctggttttgcccacacagtagaaagacacaagatctaagggatgggtacacttttggctaggccttagaatctccgttgatcaggactgaatttaagtgctgttatccgtatgaattggaagtgctctcactgttgttaaatagagccctaaaaatttgatcacataaactgtggtcttaagatagtgcaagttgaatggaatggtggggtggacctaccacagagcatgggagtcagtcttgtaggagccacttgcacgttagtggagagtttcagggtataaatggagtcatttaacagatccaatgcacatttaaaaaaaccaacaagaattaactccttttttttttaagtgttgacagtcaattcacagttattttctttttctcctcatacctcctaggtactgagagagaaaaggctggcagggagcctgtaggggccgctttctcaggagtgagcaagtggacaaagttctctctctctttcaaatgccagtagtagagtgtatactgggctcttacatgtgcggctccgtgtactcggagctgctctgggagcgaggctgggcctggtgccctgctctaggagtcctgcccttggcctgctcacctctcctgcagctcccagaaatgattttatttgcttgggttttgtttttttaaggggtggcattgttttgctttttggtttttcttgctgcggtcttgagagcagctaagtggaattcccatggatggatttacataagtctgcccacccttggagaatctggcagaagcccggaagaaagtaattttgccctgcgagacagctggcatattggacttttcagacctggaaacagagaattcaattcttctccaggccagcaagtcgagtccaatgagagtcatacagatgatatttcaggggaattgggtaaaacactaaaagccaaactcaatttctactaccgtgcatgaaaactcttaaagtgactttaccttttggatcagttaaaatacgaaagccattacttgtaatgtattttaataagttacagttttctactttaataaaaccatccgaaataaattttaggaaaacacacagtgacttttttttttaaggtaagtggagttgtaaggtactttcttaaccacagtcttaaattattagccacagaagaactagcagtactagaaatttttagatatacatctagctatactattcaataataatgaaaaaaaaacctgaaaactcagctctttcgtcctacttgaatacagaattcagtgtaaaagcaaaatatccgacccaacctaacaccagacccagcttcagataccagaactgacgtctgggcatggggagagtcgtcccatcctgcttcccttctctgtatgggcaggtctggggcacagtctgggggactttataggtgcagggaggacagaacatggccttctgaatccatctcagcttatggggctggctgtggtttttcaaagggagcacattgaaactacttgaactctagggtactgccaattgccttgttctttttatggagtatagggagtagattctaagcctgtactaggaaagttaactggtcactggagtcttgtttcattggtattcctttttttgatatgcagcctattgaaaaatagtgagagattgcttttgtataactttgttcgttaataaagcagaatcagagtaaaaatttaacccgaacttttcctggtaaatgtttcttaaatttcaataagcaaaataaagagactgtaagttgtgttcctggtagataaatggcatatttttattctttcagtaactcatgttttgtttattaagccttttgttttgttttaattggaatgcttaatttactgcaagatagactcaagcataaattaatttagaataaagtactttgtaacaacagattccgttctggctcctgtcctgcctctcgtggtctctgttgttggcttacttggctggtttaaaattccatgagtatcccagagaggaattcaaccccagagcactttttaaacacttgatagttgggaagaaatatgctctgcctctatgcattgatagagaaatttcaatgtataaactctgtgaaattgggtggaaaggccacacaggacagccactgcctctttggatagagaggggtgaataggatgggggaagagaggttccagttgtccctgttagttttttaaaaaagaaagctcctgaagcaaatgtgcaaaatattaatattttaatgtgttaaaaccgggtagtaggctcgtgagttatattccctgtactttttatgtgtgaaatatttcataattagccatgtgaaaataagtccgagcttagtgtttaggatgtaaactaacagtcttcctagcctggaacctcctcttagatttgaccaggtccgagaagtgcctgtgcttggagccctctgggctcttacaggcgccatactctgctgtttttttctcttatagaaatgagtaaaagccacatgttttaattatttttttccatgttttcctgatctatatccttgtgtcaggtgatacagtgctatgttttcccagaatgaaaagtggggctttggggctcaagcgggtttgtatcatcattaatcgtttttaaagttgcatgatcaaaacttcagcatgcaaatgagaccttttgctctgttttaagggctctggaactgctgggaaaacagggagtttaggaaaaaaacctggtaagttacaaaccctgatgcttacttttcaatgttttgaatgtaattgatagttgctccccatctttgtgtattagggccagaagcctaaaataaaaagaatctttcctaagagtggtgagagtaagtcctttccttggaatccattaataattttacttggttatgagatttgtctgttgcttcacacatgaagagtggagacgttacctaacagaatgttctcttgggttgtcgagaaataattcaggtgaggccaggcacggtggctcatgcctgtaatcccagcagttttggagaccgaggcaggtggatcatttgaggtcaggagtttaagaccagcctggccaacaggggaatcccggtctgtaccaaaaaatagaaaaattagccaggcatagtggcatacacctgtaatcccagctactcgagaggctgaggcaggggaatcacttgaacccgggaggccaaggtggcagtgagccgaggttgctccacttcactccagcctgggcgatagaacaagactctatctcaaaaaataaaataaaataaaataaaataaatatatagataaataattcaggcaagatgctgggaagttataatacatggagctgtaggattatgggctcagctgcttctccgtcttcctcttaggcttggttagccctttttcatttcataacaatgcattcccaggacacaaacaatggagaagattagagtgtaggtcccattaatgtagaagccataggatggttttcctcggtacacattgaaggtacaaaattgtagtcatgcctctgaatccaaagtgttttagtttatttcagtaaaatcacatgtgctataaatagcacgaaaaagaaaagaaagaagcggatgtgaaataatacggtttctgtggcacgtcttcctggtctaggtcatttgaactttttggctatcatattcttagaaaattataggttgaaacagtcactgaattgccaagagacggatttgcttgtctgtctggtgcccagctccaactgggcttacatggctagggaaaagaagggaaatttcacgtagtctaggattttattttagtcagataaatactggatggagtatttagtcagataaatacagtggatggagatacattggaccaccccaccaaatctccgttttaagtgtaagttttctaagttttgtacacttgtcattccagagggtccagatatttcatagatgaagcccaggtgggctttgctttgcactgaaactagcaagaaaggacacaaaagactgcagagaatgttggggcagattgctggctgcgtatgccaggtcccttgaggagcaagaacatccagtgccaaataggacactagtttggtctttctccaaaccataaactcttggaaccaagagctggtctttggtgtgttgcaggagagtcctcatcccagcgtagacatcccagctggagctcccagtcagagcctaggctgggccagtagaccatgctgtggcctttcttgcttgccccaagctctgcaaagcatcaggcagggccaggcctgcaccatgaccgccaggtgcttctatcctggtggccgacccctgatagcatgcagaacagaatgagagcggcttgcttaagggccagagtcttacttgttccctggagtgagtagaaaagtaggaaatctcgtcagaacatgagacctttttgcgttcttcctttccattcttctttacttcattccctctttcttcttttttttctgtccttctttccttcttttctcctttcgttcacaaaccacacttggagagcaagggtagaggagcagaacagtttgttctctattgcttctagaagttcagaaagcagtagttgcagatgagccagaactcaggcagagaagggttctgtctcttcatactcagtctcctgggcccgtggaaatggtgtgtttcagagcctggtctgtggtaccgctggagtttttcccatgggacttttcacattcaggaaaagtacagaactgttcacatttttttccctgtgctgaattgtttttgcataaagttcccttcttaactccaggtccctcctgtaacgtgaaataaaaagaaagaaatttgccctgccatgatttgcacctgatattcagggatcactctcaaaatgtgagccataaagaagaaggctgtgtcgttgggagtgagaatctgcagcaacaacatagaaataagcccctgccgggctcccagtggtttctgaggaaaatgggcttctctttctactgtacttggcagctagaaaagctattgagtcctttagtcacttcaaagtagcactttagccattgggtgctactgtgctggggtgggtggtgaatgaggccccacccttggcctcagggcattctgggtaattatgggaggggtgtgacagaaggtgccaggagtgggcaaggagcggacttcgtggagggaagttggtaagtaagtttcacgggatgacaagggagtctgcagcccactgagggctcaaggatcagccaggcccttgaatgccgtgtctgcctggtagctctgggaacgggcgattcagggagccttactcgttgggtagaaatccagctcaatacattggttttgatgtgttcatctgtgaacctgggaggcgcctgcatcttcttggccttttctcctgctgactcttaacagtgcactgccgtgtttgatcttgtttttcagaaattgcccaggttattgcctcatacaccgccaccggccccgagcagctcactctcgcccctggtcagctgattttgatccgaaaaaagaacccaggtggatggtgggaaggagagctgcaagtcagtgtcttttttgtttatttacaattctccatccaagtttcaatacacaaaatctcaaagggacgctattttattgtaaagtacaaaccacccctcaccacctaaattctgtatttggatagtgagagatgccaaattttctgtgtttgtttggttcctaagtttcagacagccggtaacagatttctgagagctaggagcgcatacgaaaacatatctttcccattcctgaattcagatagagtcggcatagtgagaactcatatgacgagggatgcctgcatatccttatgtgccttggcattagagagtggagcttttcatcagtggtattagaaggtgtggcacaagagcagatttctttgcattcaaagccacatccatacatcacagtatttttagttcccgtgtgtgtgcgcgcacgtgtgtgtgtgtgtattgttaatcatatcatcttgtttacacattttaccattccagatacttcctataagtctcatttccagagacaaagatgctttaaaaagattactgttacgcagttctcatggtaaaacttcttagaatcattggtggatgcccaatctgcaagaaaattttcagtaggagcagaaaatgtgcatggtcttgaagtgacccccacagatcactcatgatctgcaggggaaaacacaataattatagagtggggaactaggacaagacctgaatgaggtgatcagaatgatgagcagtggggagaccagaggacatggtgtgtgtacagctgtgccgggagggaggagggagggagtgactggtcttcaaaaccgtcaggatcataaaagacaaaacctgtcgaaagggggctaaagaggcgtgaggactggctgcagtatctagactcagtgcagtatctagaccctgtgtgaaagaaaaccacgctgtcaaggacatttttgggataatggacaaaattgggttatggacactacattagacaaaattactgtaccagtgtaaaatttacagaaagcaataactgtactgtggttatataagagaatattcttatttttaggagatacgtgttgaagtatttaggggtagagttaagatgtaagcaacttgcaatcagatgaatcaaaaaaagaacttgcagagaagagggtggggggggagggagggagaacgcgcacaaatgagggagcagctgctgccaagtgttgacagtaggtgaattcgggtaaagggcctatgggtgttctgtgtgcttttcttattcttgccaattttcctgagtttgaaatcatttctaaataaaaagttgcctttaaaaagttactactatagcagttacttgagaggtaagccagctgacttttcatacagaaagtgtgtctccctccccgcatcctcccccatccaaagtgaagatcagcctcagactgccaggcgggcacctggccacctgcttcatagcttagtgaaggacagggcttgctccctggcttgcccacatggggcctatggaaggactgaattttccagcagccgtccgtctctctggcgtttgttgaacgtgggcctctgcgtaacacaggggggcctcagtaaggcttgaacggatataggaaggaatggtttctggaatgctttgtgaggaaggggcccatgggaaccctttggtggctattagtgggcctgtagactgacttacccaatctgctggtatttgtctgcccatgagcaggacggtatggaactacgtaagtttgagggggaagagggaggcaggaaacctttgccatgcagtggactagccacggaagacagaccctcaggtgctcctgaggaatggaggttggaacagcaggagcaggaaggaagaaggccttgctggggaaggcctcgggtctcacacagtcccgtctaccactctgtggaagtgagcctgaggccaggacaggaagagccacactggagagctgaatatataagaaacgcatcttggccagaatagaaggcacaacctggagtgtaactaaagatgaaactttccctggagagtttgctgatggacacccataaatgtccagatactactcactggttaaggaatctgacctctggaggcctggaaatccactcctttttgtcagcatgccttctcctgtgctggggagggagaggcctccttagaccctcgggtcccactccctgcttagagttgtgctgtatcacccattggtccttccagcatcatgcccctgtcctgttctggagacgtgggagactcccatcgcctgtcctccttgcctgccaggggaaggcttcctgcggggcccctctccccggtgcagcctcacgtcttaccgctgagcaatggcgtctccactccagcctctttgaaacaccagcaccccctgctctcctgccttgctgcctttgttcatgacatttctcaccagcggccaaccagctccaacctctccactttcgcaagagctgggagatcccacttctggaagctctctgtgaccatcccaaccagaagcaccgtgtccctcccctgagctccagcactggccccgtgccggcaccactctttagtattttatattactttgctttctgtgcacatttcttacttccacatgtagctgactagcaccttggaggcagcagccgtatttttcagtccccacacctctagcactgtgcttaagtgagtgtttgagtggttcttaggattctcaataaagtggctgagttgccatgacccaggagagctcctggcgctgtcaccagagtgactctcagcgtggatccacaaatgaggaaacaccagtgagttctgtgctgtgctgcagaggtgtgggaaagagtggtgtcattgcgagcagaatggtggtatactcggtagataaacgtggaaatttgtaaccagatggcttcagtcatcggcaggttcactgtaaacataaaagctttagtccttgagccaaggggatggaatctatcagacctcaaggaaagggaaacctgctctgtgttctgaaaatgacctagaggtatccctcttgataaactggcaggtgggagggcagaggtaatgtggtggaagttttcttttcttttagttttatttccttattttgggaataggtaattatagtcacatggtttaaaattcaaaagttacaaggggatataaatgtctccctcccaccttgtccccagaggtggctgtttcgatcagagccttgtttctagacgtgtgtgtgtgtatgtgtacgcatgtgtgtgtatgcacaagtagttttgggttctcttttcttggtggtgtacagaagggtagtcaaagcccgactcatgatccctaactcgagtcttttaatgggattgtgtcctaactgcaaaacccgcctcaccaactttgttataaactccccgggtttatagggacagtcatctactgtcccttcctaacagcatggtgcagaaacactccataaatgagtcttgtgttgaatcagattgaattaagtgagaaaggaatggcggtgaaaaatgtggctttagtcatcacatgggcctacgggtttgtgaaagtaacattgagtctccttgtgttctgtgtgtactgcatgtatgtcatcttgcatctaaggatgtatattacccataaaggagcatgcagacacatgagtgcatcttggcttgccactaactgcctgtggccttggggctgtcactcaacttttcatctggaaattgagaataataatactattatccttctggaattgtgtgcataaatgcacagggcctggctcataaaaagtactcagtgagggccgggcgcggtggcgcacgcctgtaatcccagcactttgggaggccgaggggtgcagattacgaggtcaagagatcgagaccatcctggctaacacggtgaaaccctgtctctactaaaaatacaaaaacaaaattagccgggcatggttgcggtgtgcctgtagtcccagctactcaggaggctgaggcaggagaatggcctgaacctgggaggtggagcttgcagtgagccgagatcgtgccactgcactccagccggggtgacagagcgagactccgtctcaaaaaaaaaaaaaaaaaagaagtactcagtgtgtattggtggccattattattattattattattattcctaaaacccatatacagtgttggcattaaccataatgtctacattacctgaaattaacagctgagtgctagcattacatgagtagaatttcctgtcccaggcaatccatggtatatcttaattttgtgatccacacagtctagccgaagcaaaaacattctgggctttgctgaccagtgattgccacaatttgaatttttagctatggtgttttacttttgtgacatagtaatccatagattttaccgttaatgtcatttgtttttcagttatatgtaagctttacataagtgctctgttataaagtgagctgtattataaaagatgcgcctttaaaaatgtttgatgtaattattttcttactaggcacgtgggaaaaagcgccagataggctggttcccagctaattatgtaaagcttctaagccctgggacgagcaaaatcactccaacagagccacctaagtcaacagcattagcggcaggtaaggagtttcgcatctctaactggaagatggtctgcatgccacttgagtttttccacttgattttctcattaaatatcttaggttgtttttcacatgtgctttaaagcacttcctgtacttgctgggactgacacccaactaatgtgatatggaatatgtctttcaaaaggaccagatatctaagtggcttttctgtgctggatacaacagaacccttgttggaatgctcttcttgcaggagtcatgaatgctgtggcattaaggccacattttcctcttgatttccttccagccatttaaattggggtttaggctagggggtgaggtgacagaaagggacacccaaaaataaacggctggggtctcagtaggtcatgagatggagctgggggccacgggggttggggggctataatgtggtgttcactgaagaccaaaatagctcccctgtgacattcactgtgggcagagggggcttcgctgggcaggcaggatgttgtactcactttcctggaggactggaaaagaacagagcacagcagttggcccagttggctattttctgattgaagggaccaaatgagatgcttcagcaagatctgagagaggtgaggtcagggggagcagatttctgctttaggtctttaagccatcattcttggttggcttttgtggaaagtgtagaatttttgttccaataccttgtggttaaatatctgtgctgtatgtacccagtgagataagattaaaaactggcagccttctcaagaaattaaaggatgggcaaactttgtgatgagccgcagtccccactgggcctctttgcttgagctgtggccttgtgtaggctgaggaatgtggttcccgcagggtttgctgtcccctggagagatgtgtcagtatccctccacttccatgtacagccccttcctcaggcccgctgaaattagttgctgaagtgattgaattagctggagaatttaaaaagcctaaacctatttattaataggttggttaagaaagattcatagggactgtgacctgttggtgcagactcatctgaagtagaagtgccaaagaatgagaacaattttacctcctgtaagcttgagagaaaatgagaaaagaaaaattgttcttgagggtggagatttctttcaggacaacattttgagatgcaaagatacagcagcagaaaaatcttttgaaacactgattttaggcctggcatggtggctcgcgcctgtaatcccagcactttgggaggccgaggcgggcggatctcttgaggccaggagttcgagaccagcctggccaacatggtgaaaccccgtctctactaaaaatagaaaaattagccaggcgtagtggtgcatgcctgtaatcccagctactcaagaggctgaggtaggagaatcggttgaaccctggaggtggaggttgcagtgagctgagatcgtgccactgcactccagcgtgggcaacagagcgaggctctgtctcaaataaataaataataaataaataaatcactggttttagttttccctaagatttggaattcttggaggtcaaatgatgattaccttccactttaaaccaaaaaggaaaaatgatagtaaagtccccatgatacatagctgtcctgtgcagcagaagataggatggggttgggctggtctttccagagtcagcagtaggaaggagttccgctgcactcaaaacgaaagccctcgattagcactgtacattttctgctgacaagtaaacatgaaaaagaggacgatatcataaaaactaaagacttagtgtgaaaattttgttgttgtcttagtttttaattcttcacctttattgcccacactgtaaaaagcccaacagaacagttccacctactgtcaccctcttctgaaaggacagaaatagtagctgggaatgttgaatggctgcgcggtacccgttgtgcattctccggcgggtgtgcagccgctcacccagccctgtctcctgcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgtaagtgccctggtggctctgtcgcctcgcctctctggtatcttcccgtaaaacatgcagcattgctctgattctgctgagctttgtttgcagaacttaaagctagaccattgctgcattcgcagtcgtctctttgaagaccttctgtaatgcaagagtttatctcatggggttttatttctctttaattttcattccttctgtagcatgtcccctccctcccctccctcctttttcctttttttttttaaatcattttggcaccatgctgtttacatgcctgactcattttcctagcttgaattttgctcattgttttgttttgcttatgtgttgttttcctcctttttctaggaatcatatgttgtccatccccccctcaggcttgaaagtcctcaaagagacccactatcccatatcactgcccagagggatgatgggagatgcagccttgatcatgtgacttccagcatgatcacctactgccttctgagtagaagaactcactgcagagcagtttacctcattttaccttagttgcatgtgatcgcaatgtttgagttattacttgcagagataggagcaaaaattacaaaaacacacagggtagtgggtccttttgtggctttcctagttactcaaattgactttcccccacctttgcacaggtgctttcaatagttttaaaattatttttaaatatatattttagctttttaataaacaaaataaataaatgacttctttgctattttggttttgcaaaaagacccactatcaaggaatgctgcatgtgctattaaaaattgttccaaatgtccataaatctgagacttgatgtattttttcattttgtccagtgttaccaactaaattgtgcagtttggggcttttcccccttaccatagaagtgcagaggagttcagtatctctgttttaaagacgtatagaatgagcccaattaaagcgaaggtgtttgtgcttgtttgtgtgtatcagctgtaccttgttgagcatgtaatacatcctgtacataagaaattagttctttccatggcaaagctattaccttgtacgatgctctaatcatattgcatttaattttattttgcacagtgaccttgtagccacatgagaaagcactctgtgtttttgttcggtctcagatttatctggttgagttggtgttttgtttggggtttttaattttgcgtgtttgcatagcataaaatcagtagacaacaccactgaggtcgttacgatcaacgatatccacagtctctttttagtctctgttacatgaagttttattccagttacttttcatggaatgacctattttgaacaagtaattttcttgacaagaaagaatgtatagaagtctccctgcaattaatttccaatgtttacattttttaactagactgtggaatttctacagattaatatgaaatggagctcatggtccgtttgtgtgttagatatgctgtagctgaagccctgtttgtcttttaaacactagttggaagctctcaataaaaatgcctgctgctcacagcacagaaaatggggcagggggagcctcaagcacaatctagctgtcctcctaaagactctgtaatgctcactcccctcgcgttctcccggcgctgtcgggaggctgtgctggtggtcgtgtagaggtccttctcctttcacatggtgcagagagcgaggacctctcctcctcgttcagttgcacttcagtattttcacggatatgaatgtaaaatatataaatatataaacctgcggctttaacaactgtaatacaaccttttgaattagttccgtgtatagataattaaattcttcatacaaaagttagatggaaatgtctctgtgttcttgatgttggaacctggcagtggtggtgaggaaccaagcagactagatgtcagcaatgggcctgctgcccacgtgtcaaccatgacctgtgctctttgaaatacagacattatcagaggctcgccgagtctttgttgaacagccctccctctccccgtgctctccaccttccctgatcaatatgcaaatgatcattccttataataccagtttcgaaacatagaactctaccacccagtttagcagttcagtctcaccgggcttttgatataagttgtcgacacattgagggtgtgtgatttggctcagggtacaaaccatttgtccaaaagatgtatcgtaatgtactggtgaacacccccaaaattatgtgggtaaagacagaaacttgcacatgccccacgttgtctgggatcggcttctgcctggcacactttgcagaaataaaccagcgtccacattgatgccactgtttgctacaatgaccacatgcttgattccatcctcatgagcttcacttattggacctctcctgccattcagtggaaaagtggtttccttcctcaattcagcagatatttggtgggggggatgtctaccatgagttgggtgccccattggcttctgggaggagtgtggtactccgtggaaacagagtccctgtcttcatggagttcatattgtaatggaaggaacaaacagaaaaccaaactcctgcaatccatataaatatgcacggtatgtgtgtgacaaggtgacaagttctgcactagaagtttggatatgaggcaccactgagcagactggcagggccaggggagggtggctgcagggcaaggatcagagaaccttcagggggtggggcggggagtgccatttgagctgagacctgaagagtaaggagggaggagccagatggagtgggggaagaggtgtggctattgtagatggagctgtcaggacaagcaaaggcccaggggtgggcggggagatccttctcactgtcccccaggccacccccgtgtggagcagtggttgagtctgcaagtcccatctcttccccaggatcccttcagctgtgtaagccagtgttgcttctccagtcttgagtttggctggaagggatgcagttgtcaaggtgggtactactccataacactctacctaattcactccagatgccccacgccctcactgtaggccatttccccaggcttgcctccagctttgtgaagttgacatgggttgttccccaggaagctgtgctttcccctacaaatcattgagtttgcatttggttgtatccattggaccccatgattctcagccagtgggagtgctgctggtgtctcatggttagagtcagggatgctgctcctcatcctgcagtgcacaggacagtcccccgcaacaaagaatgatctggccccagatgtcaccagagctgaggttgagaagcgcaggtctcaccccactggccactgtggttaatgttcacctggttattcaccaccagaaaggctgccccggtaactcctgttgaataaatttaatcacctaagctcatgtcgtgtatctgcagcatcaaacgtatctcagaaccttggttttatatttcaaaatcttattcttgtttattatcccccatactctgcactttggtactagattaaactacttcagtcatattcacaagagaatctggttaacagaaaattgagtacaagggaaagaaagcatctttcttctaataaattagtgaagggatactaggtatctcctatggcctcagagtttaaaggtgtcaggttttggtttgtttgttctttagctatttgttttttgttttttaatttttttttttgagacagtcttactctgtcacccaggctggagtgcagtgtcgtgatctcggctcactgcaacctccacctcccggatacaggcgattctcctgcctcagcctcctgagtagctgggattacaggcatgcacgtgggtctggctgcattttgtatttttggtagagacagggtttcaccatgttggccaggctggtctccaactcctgacctcaagtgatccacccgcctcagcctcccaaagcactgggattacaggtgtgagccaccgtgcctggcttactttttgtatttttagtagagatggggtttcaccatgttggccaggctggtcttgaactcctgacttcaggtgatccacccacctcggcctcccaaagtgctgagattacaggcgtgagccactgtgcccagtctgttttgttttgttttttaaactgattattaaatcatttaatttcatattggtctgtgtaaatatatttgcaagtgaactttgggtacagttttgctccagtagcattagacaagatgagtccaaatgagattgtcttcattgtgcacttacgaatcactctcctctggccggctgcctctccacactgcagagcaggcctgcagagttggggagccatggtggttgagttccccaagtggcccaggcctcagactgcctctgcataaaagggtgtctgggagaagccgatctaaagcagtaactcggccctatgttaagtcacaaaatatctaaccattacatgcatggtagaaactggtatcttccctgtttctggaaaggaatctgggcagacccaggccgcaaatagtaacgattgggttatctatgctttcagcgatgccatcagaagaaatagtaacactagcttaggaaaaccctctaaatattaggtttaaccatatgaaattgtcaattcttacctataaaaacagcaatctataattcaacctagtacaatatatcatcacctggcacatggtaggttaggttaaaaaaaaatgcctattgaatgagtgaatgaaatcaaccggtgactatagaaaacaccagtctcagcttttgacacagaccacatcaccctcagagaggagaccatgctgtctctccagtttccttttcctttagatgtgagcttcccaaaaacaacagtggccttggaaggggctgctcctggagtctcttgctcatttggtctaagaaggaggctgaggaccagggaccgttgtctgagccaagtctccactccagcacagggcgggggcaacaccccacccaggtaacagttgggcaacgggcacagcaaatcgcagtcctgcttcattaatcctattcattctctttagttccaaaaatacccaagagaatttttatggaaatgacattggatgccaatggtcccaaaaatgcaaggaaaaatagctccttctttgaaatgtctggtattcggggtctggtaggatagggagacgtagtgaagtccaagatcacagtagccttaatgtgaatgttccgcttcagccagagttctcttgggcacttttttttttttttttttgagacggttcacccaggttggagtacagtggtgcaatctcggctcactgcaagctctgcctcagcctccccagtagctgggactacaggtgcccgccaccatgcctcgctaatttttttgtactagagatggggtttcactgtgttagccaggatggtctcgatctcctgaccttgtgatccgcctgcctcggcctcccaaagtgctgggattacaggcgtgagccaccgcgcccggccactcttgggcacttctttacgaaaaccccacataggaaaaaccaggcttccagagtgtctcctgacgtctagttagctattccatttcagagggctccatagcctctcaggaagaatctattctttaaattaaaagctccccaggcatttttaagttgtatgacctgattctcaaaaatgtttcatttataaaaaatgagcatcagctataagatatatatagtgtccgtgcaacttaatgttgggcataccacctcttagaagctaccagctaccatgctgttgttttatgatgtcaacggtgtgtgtgtgtgtgtgtgtgtgtgtgtgtgtgtgacaggcagtgagcagcaactttcaggtgacttaactgcctacatctgtagcttggtgacagtaggtcaaacggtgagttcagggtacagccagaaggcagataaataccgctgtatagaagattctggcagaggctgacagctgctatttccacatctgcttggcacgtcgcttctgagtgatgttgcaagcctcaaaagagatgttccttattttgactcagactatcatgtctttaaaagctgaacagttccttctcttgatgccgtttctctgaactctgacccaggagaggggagaacacttttgatctgccagttttcatcaaggacgctgtttccctcagtgagaggatgaaacccctgacgcccctgctttcccctcccatttcctatgctgtcctgtccccttctgatacctgtccccacacactcatgcacgctgatccactgcgttgcttcccaggccccacccagaaagtgaggaaaggcctgggctgcggtggagcgcaggatgttctctgcggattattcagtgaagtcgagatcttagagaacattgagcataaggcctgcacctatacagctgagggcactgagggtctcgggaaacacagtgatgttctcaagtcagcttttcaaattccgacaagtcctcgttctaggcgtaccatttgatgcacagatctatggacatgtgtgtccataatagccccagagctcctgcctccacagaactggtggctgcatctttggaaagatcgggaaggggcccctcttgcctcatgtgatttcctcactggtggggttaccatgggagtttggagccattggtaaggattccaacacattttcaacgcacaagcttcatgctgacccgccccagccctttgtccttctctcctccactgggcgagtttgccaggcgctcaggcttacttaagacaccctcagtctgagccaaatgtaagaacatgtgctgctgtagcttcccaattttcattcctggcctccagaaaaacatggtgctgtatataacaacacggcttctctgcaagttcagcctaatattttactccatttctctcatcattttggaacattctatttccctgtagaccacctgcctataggaagatagtgattcagacggagcatccacataactgcatctggggaccttatagaggctaaggagcaatccaggatggtggctcagagcacgggttcaaatcccagctctgctacttactagtggtgtgatcttgggcaagttatgtaacctctttgtgcttcagtttcctcatttacatatggagagataatgatgacatctagcagaaaataagcagagaataatagctttgttgctgttgtttttattggagagaaaaggcatttgtgcctggtcagtgagcatcatggaatccaatcaagtgccttctttcattaaaccaaaacagcaggtaggttgtgtgcatttttaagaccttttagaaagtatgcttttatagattaggaatttcagagagaaaagattggacagcttccctaaaaactttgagctatctcattgcaagatttgccctaccaatccgtgcacgaaccctggcccccttcctgatagcaggaggcccaccggtggaagcaagcagctttttaaacgccttcgctgcactcctgcaatgtgcagagacctctggaccaaagaccagagcctactcagcagactcttggttgatgtggacaagctgcctgtgtttcacacggtcgacggtggggaggccaccagggaaaatggaatgtgcagggcttttaaatgtcacgtctggactgtgttggcaggcccatgcagcgctccacaataaacctgtcacaaatgcattgagtcactgggtcctttatttctcatcacggcattctgtggccttgtgttctcttgccagcaaagaatggaacgttcagccccctagacatgccggctgctggattttttaagcaatcatccagcttagataaggggcgtgggctgctggggaatgctgccccaaagcgctgtctccagagcagctgccccaggcatgcttaattccctccctgcccactgtgtgcacccccaagatgcctctcaatatccagacctgcagttccactctgtttgttaggccccccaggagagcgagcctgcagtccgccccagcagaggggaccaggccagggatgcctctttcctctctggagtgttaccttggagtcctgaggccccgtgacaagaccccacacggccgaatcctcagtaacagccctccactgacttggtatccagtgggattcctccctccatcccattctctagggggcagaagcacatctgcccgtcctgtccgcctccccttccatcctgcatcctgtcttctcctctccccgcctcctgctgtgtggcccatgagcccaggagggacccagtctactctgtttacctctcccgctgcccactgagagtcatggctgaggtacatggaaccggcctggtcatagggccgtgctcagcagaacacaagcagaggagatgcctagaactttcaggagcaggtgacaagcagcagagaaatgagtgggggttccagctagtgaaggatggggtggcacagagcatgactgggggccagggatccagccgagaggatggcccgagaaagctctctgaagaggggggatggagacctggctgcgggggaggcacgtccaaagatcaagggggaggagctttctcggcccaagggacagcaagtgcaaaggccagggctgaaggagctgctcctgcccctcacagaaggatgactgagtcttcgacctggtctctctgcacccactctctccttccagcttcccccacgctgcaggcagagagctattctaaaaacatcacttcttatgcttaaaatcatccaggggattcccggtcctccgagataaaagacccgaatctacttggtctgcaaaccctgcctgatctgcccccttctccagccctctaaccttccctctcctcatttattcctatttgtgctgaattttagcacggctcagtcgtcacctcctcgaggaagccttccctaacccatgcattcttctgtgcttgcagaggggaaactgggctgactggttacggagctgctctacaggagcctgctcagtgttctttcttctgccacctttgagtccccgtcatgacccgtcacgaaagtccaggcttttgttgcccccatggctttccaaatggccctgttgaaaacatcccctttgaccctccaaaccactttatggaaaggtccattttcatcatgggagtccctcctcagagagagtcagaacccacatctggtgcccactgtggcatcgtgggcccacgtcagcaggaagggatgggggtgcaggcaggcagtgtgggcaaggagcctcccccagccttagagactgaatgactcaaccccccttgtctacctcccagggatcttgtgtgcccacatgtccaatagggaggtggtgcttgggtccagggacttccttcatcatctagcctcactctgctgtccagtctcacccaacccagaaccttccctccatcatgtcagcctccaccaccaccccagaattcttgagtctcatttaagccactggtaggccccagctgcaaatgcctttgccccacctcccctgcctttcctgcccacctgccttcacctctcccgatttcgctgccacctctcctgctccattaacttgtaacaactcagctcttttctgaattccttatcacacagaaagatgactagatagaaaggctgatacagaaatacatagatactcttacctccccagttagactgtgagctccttggaggcagggcccaaatcttgtggtttgttacatccccattaagacctccatggtaacaacactaatgaacagcgatggtaccttgccttgtgtagttgtcttattgcagggcaccctgcctccctgctgattacaaaccagagggcagggcctacctcccacacgtgcatatccccatggcgcctcactcttgccagttgctcaggaagtgctgtggcagacagtcctgggctgcccttctacctgcctgttgttccacaggcttggtccttcctccccagctaggctgtgaggggcaggacacgtcacagtgttcattctccctgctgcgtgtagcctggaacccagcacaaaacctgtgcttgagtttccctccccaggaggaaaggaaattgtaaacgaggcaccatcgtttacaaaataagttctcatgaaaagaccccaaaacaggaagtgagcttatgaagcataaggattgttcttcatcgttcttataaccaccttcagtactgtctatttatgtatgtatttggttttctgtctcccctaccaaaatggaagccccacaaaagtaggggcccctgcggatctatgcagccgctgtgaatgagcaggaaatgtcatggctcaggttgcctcttgggttcctatgggatcagtttgttaagttaggagagaccgaccccagggagcaggctatgggtgcttagacccttctgaagaaagttccattgagatgagaagtccacctgcccctctggacagctcagagctggtctggcctccagagcttcctgtgggctggggctgtccaggaaccggtcagccaagggtcattttcagagaaggcctggctgccttggcctagactggccactgccatcccccaccagtccccaccagccctgcgctccaaggacaagcacaacctctcagcctgatcttgcaggcatctgctgagagagaaaagcttaaggaccaccctcaggcctgccctttgaaaagccggtggtttcctcctgattccatttcctgacatatcaccagcataggttttattcttgatagggaaggtcaccgtacatcgctgggatctgctgttccattcataagatgagggcgttgagcagagagagtagcctttgaagccatagcccatggctgggggtcagtggtggcagcgtggcctgaggtgcagcttcagagggcccgaagagtggagtgtcagatggtctctgggctcagagagatggcgttctgtggttacagccattgagcctcttggacaatggcttgagtgacctgccatgggctggattcagctcagcagttgtggcagctctcatgatccctgggcctggacggatcagtttccaaatcccacccgcttttcgcgccaggtgtcttgatttccaggccatctttcctctgatctcctggctgtacatgggaaccacacgggagctttgccgataacagatgcctggaccccactccagccagtccggtttagttggtctggggtacagcaggggcactgggatttttaaaaactccttgcgtgaccccagtgtgtggccaaactccagggccacagccccgtccatgccacacacagctgccgcactgatcccctgaaacacagccaagaccttcccagctccgcagccagcgcctcctcgactggacttccccacctgttagggctgaactgtgtccctcagattcacacgttgaagcccaggacatcagaatatgacttcgtttggagataaattctttaaagaggtgatgaagtgaacacgaggctgttagggtgagccctaattccatctgatgggtgctcttaataagagggggaaatgtggacacacagacgctggagatgtgcatgcacagaggaaagaccctgccgaggagagaggcctcaggaggaaccagccctgttgtcaccttgatcttggactttgtatctttagaaccatgaggaagtatatgttgtttaagcggctgggtctgtggcctttgttatggtcgcctgagcagattagcgcaccagcgaggaggaagaggcctccggggaagagcatgagctctagggtcagactccctctgccatttatcaactgacttacccgccctgtgcctcagtttccctgtctgttcagtgggggataacaacagtatagctaccgcataggattcctggtgaggattcaatgagtttgcacatgtgcagcacccggcattgtgagctctgagtggcgttccacctgaacgcccatgactcaccatcacgcagagactgcttccctcctctgcacctgcccccagggctccacgcccccgactccaatttctatttactcccattcttcctccctccatttgaatccctcaccgctgcctgccccctcaccaccgatattagcctgctgaagtccaactcaaattcctcctcccctgctaaatattttcaaatccttctcatcaaaacaacaggcccccttgaattagacctagtatttggccgagtgtggtggctcacgcctgtaatcccagcactttgggaggccgaggcgggcggatcacctgaagtcaggagtttgagaccagcccggccaacatggtgaaaccccgtctctactaaaaatacaaaaattagctgggcgtggtggcatgtgcttgtcccagctacttgggaggctgaggcaggagaatcacttgaactcaggaggcggaggttgcagtgagctgagattgcgccactgcactccagcctgggtaacagagcaagactctgtctaaataacaaaaacaagaacaacaacaacaagaaaaaccctagtatttggctgggcacagtggctcatgcctgtaatcccaacactttgggaggccaaggcagacggatcacttgaggccaggagttgaagaccagcctggccaacatggtgaaaccctgtctctattaaaaatagaaatattagctgggcgtggtggcgcatgcctgtaatcccagctactcgggaggctgaggcacgagaattgcttgatcctgggaggtggaaactgcagtgagccaagattgcaccattgcactctagcctgggcaacagagcaagactctgtctcaaaaaaaaaaaaaaaaaaagacctagtatttgataccacaacagagcaactacaatagtaatttaattgtacatttaaaaataactaaaacagtgtaattggattgtttgtaacacaaaggataaatgcttgaggggacggataccccattcttatgatgtgattattacacattgcatccctgtaccaaaatagctcaggtgcgccataaatatatacacctacaatgtacccacaaaacttaaaaataaaacaaaaaccaacaggctcctccttcatattccaataaaaatgcatttgtactttcattataacatgccagtctgcctttgtacccaaaaaacttattaacaggagctactcatactacaggagagggcacagtgagagcaggaagtcaggggtgggacatagaaggggcctggaatgagctgaagcatacctaccacagaggatgtaaagctgtgccaggaattccagtgcccattatgaagctatgaatgatacaccctttcactctctgaaatgtgcatatttatggaaaattaagagatgatttatccctgagaagaatttgatcttcaccacttctcagcagtaattaaactgcctggcaacccctgtggactggattcccctccttgggagaaaacaaagcttatttggagttacattggcacttttaagcatctgggttacatctgaatggaagcctcccgaggacccagctacatggggcaagatgtgtcaccaggacaggctgggtgggatacctgagctctgctggacccacgagggtctctggtgcctttgggggcattccttcccctctcacctctgtgcccaccggcttctccagaccccattaaaaatcgcatcttgaggatttgcaactccgaggtctcaaggactgataaccgcttggagtgatgccctgtgcaaagtgcctgcaactcagcaaggatccaagttggcctgggactcccaggtctagcaaccagcaggctcccaaaggacaaggacccggactgcctccttctcactgaaccccggggccgagcgtggatgctgcttcacagcaggagtacacaacttcatggcttggagaacgctggggtttcagacatcagctgcagggtaaagggacatagtgtttggccagagaactttcttcacgtcatatccatgtggcttcatctgcttttcctacacgacaggccaccccacacctaccaggagaggcccagggtgttgaagggagtgcagttagattaatttgcccaggagaagccagtgcagctctggggtgcatgggctcacctggcaggagagacttggtccatggggagaagcctgcagtatagatgggacctccaggagcccaagtagcatagaccctgctgatccggggccattgagccagaggatttgggctgaatgtccccagagacaaaagggaaaggtagatcctttcccttaaagatgaaagccatcgcccgggcttgcttattgctctctctcctggtccttccacatgttgtttctgaacatttgttctggcatcacaatccccgtcaccctgtcatctggcccttcccacctttccaccttatctcttgcagtgtctccgcgtcgacctggcacctgggtgaaggcttgctcttgctggtgcccatagcccccagtgtatggtcttgacctccccagccatatggagacccagcctcaggagggcccctcgaggaagcctccccttagcacgaggagttgctcccttctgaggtcctactgtctccaccatcagcacagcacacgggctcttttttcttttcttttttttcttttttttttgagacagagtctcgctctgtcacccaggctggagtgcagtggtgcgacctcagctcactgcaacctccacctcctgggttcaagcgattctcctgcctcagcctcccgagtagctgggattacaggtgcctgtcaccatgcccagctaatttttgtatttttagtagagatgaggtttcaccatgttggccaggctggtcttgaactcctgacctcaagtgatccacctgcctcagcctcccaaagtgctgggattacaggtgtgagccactgcacccggcctgggctctttttttaatgcttgctattttaatttcttttttttttttctcgttttttttcttttcttttcttttctttccttttttttttttttttttttcctgagacaggtgctcgctctgttgcccaggctggagtgcagtggtgcgatcatagctcactgcagcctctatttcctgggctcaggtaatcctcctgcctcagcctcccaagtagctgggattacaggcatgtaccaccatgcatggataattttttaaattttttgtagatatgggtgtctctcactatgttgcccaggctggtcatgaactcctgggctcaggcaatccacccacctctgccttccaaagtactgggattacagacataagccaccaagcccagctgcttgctattaatatttttaatttaattttcctgttgtgtctctcccaagattgtgagtttccctgaggacaaggacagtatcttgcttatttctgcgtctcttggacttcagaggaacttaataaatatttatggaccaccttattgcatattttggcccctttcatacaggaacaaggtctgtttatttgctttgctcaatgggcaacttgctgtgggggctggcttcgttttcaaaattctgcttctcattgggaaaggtagaataattggaggtgtggagatgggtgaggtgcactttttaccctgaatgctctgtagcccttgaaattttaataatcagcatgtgtttatgtattacttttgtaataaaacaagttcttgaaatgatgctgttcatacaaatatcagttgagggaagcaagatgaccttttattggtaaggtttttttttccccgtgattttctccagggcctagactcaaaaaatccttccagaaggccatcacatctctctccatttcgtaaatgtgtctaactaggcaacatctaagggacggcacacagattaggaattttatgtgggctataataggggatcatttgtaaccgcctggagtcatttgcaatattatttcagctgtgtgtggatttcagttagttttgagaatccttctgtcacaccaagatgttcatggaaaaccatttgatgtgttttctcctctcgtttttccctgggaaagggggccagaaaccatgtttatcctaggacccaaaagaggaaaaggccacgtccctccacccctaaagaaaacgcttttatttgaaatgtcttttccatttaccctactttgaataatggagtttttaaactcacttgtttttctaaatattaaattttcaaaggaagaatatttttgagttcaaaatgcctatttcaaatctttaatggttctcttggtctggcattcaccagcaagttttaaagcagcctcccatgggtcaatttgatggctaaaaagatgattccaagccaacatcattggcacataatgtaaagaagactctccccacaaaacttttgcttttcattgtgttctgcagtggccatcagggccatccccctgtctccaggcagggtggtaggtggacctgcgagaggtggaatttggtgggggcaagcagcccagacttgcccagcgcttcccctgacctccaagctccatcagctctgacttgggccttgcaaagtgtttggaccagaggccaacgctacctggagcaggaggccacgcagcagccctccagcttgtccccaactggccccaggctcctgggattcttggacaaatggcccaaatttaccctgaaccttctgctgttgctctggctctgagcttcttcacaacctgcaccgtgtaaaacttgaagactcagaagagcttctgaaatccaaagcaagccaggacttttccccataggtccttctttccgattcctcatcattctacgcgtgtctgctggtccctcgcacctccatgctgcagactggaactctggtcgggttgtcagtttcaagtaacactagtgtttctcaacagggtgctcgtctattggcatttggggtgggcagttctgtgtcctgcatgttgtgggtcatttagcagccctggccagcctgccagattccactatgacaaccaagaacacactctcagccctgggactggagtgggatgcagggcaaacctcagcctttggggagtggggacagtactgacctcaacatggtggggaagagcaccaccttcagcggagggtggggcagtagcaccgcctgctgaggaccaccagtcccccaggttcttagctatgccctggagggcaggagtctctcctcttctgtcctgaatccccagcacccagagtggttagtcctagcctcatagtaggacatcagtaaatatttgcccagtgaatgaataagatctatgaacagtcttcaaaagggcctgtgaacccaatgaaagtgtgccctaaaggtgtgcattgtacacatgtattcgctgcagcaagaacccataacttccctcagattcttcaaggcaactgtggggcatccttaaagggacattcagaaaactggtccagccagtggccactacgggcctgatgtttctgtagctgcaaacatcaccgcaccgtgtttgtgcagtgacttttagagctaccactctgtgtcaatattctaatctccctgcagaagggaccatcctgaacgctccagggactctgcttccgtgagagggcatccaagttgcctaatgcaggggctgcattcagcccttcaacaagaaatggcctgaggcccgggccctttcactcactcacaggagagtggggtaaaaagagggcaggaacaagatatgtttccccccaaactcgagtgtttcttgggtgaccttcccaataaaagtcaaagaactcggagacatcactcagcttgccacaaacccaagctcacacagcagcttggctgaactgaatgagtgagccccgtggcctgcctccttcctgagagttcattgttggtgcagctgttttaataaaagacaatctatgccctgaggcaggaagaacagttgggccaaacccgtggctgagcagagggctcaagctcagacacatctgcagacctgtgcaaaagtgcgagctcaccttgcagccctggagaattctgcttgacctcagggcaggggactctgagtgaggtcgagggtgttgatataatgatgactcatttctgctgctttcccagcattctcctgctggtcttgggttgttcctgtcccagcaagagaagctacagcatccagaaaggacaattggcccagagaacggacaaaaccaagggctggaagcaccacaacccgagagttaacctctaaagcagcaaagcatttgccaagaaatctctgatatcatttggcccagagggatcatacaatttgcagaagctttcagcatataggctagatcagtcatgaccccagataactcccttgagagaagatggaaactcgaggaacccctgctaggccagagcaggcttcttgaacattagtgcgccaaaaaacaatcctctggagagcttgttacatcacagatacccagcccccaactccagagtcacttcagccggggcatctctagcaagctcctaggtgacgctgatgctgccagcctggggaccacgctttgacaaccactggtccccagcagggggttttgcactgtgctccattgtgcccccttgaggggaacagaagggatgggaagaacaagtaaaggggattcagcccggactctcccacctacattcgggacacctctgggtctgtcttccaagtctggcttctgtgattaaataaagaacctctgataaaaaagagaggtgggtccaggcctgcacatgggatgctcccaagaaccaagcctccctcctgctcattccagtgtgtctggggcaggaggctcaaatgttcaaacaaaaccccaaataacaagctaagtgggcagagtcatgagtgagccccacttccagtgcaggcaccatctcagggcagtggagtggcccttcccgtcgggcagccttggcctccatgatggtcttgtgccaggctctctgcagtgggaaggactaccctctctgtggcaagcatgctgctcagctgccccaggggccaggcagcagctttgtccaggagagtgtgcccagtgctgtctggaggcaccctgcatctgcctggtccccaggaccatcagagcctcagcacagccacctcatcctccacaaaccaacctcgacatggataacccatggcctcctggagctcggggatagagcacagcctctgcagcccaagtctcagggtttggctcttgccttcaccacttccaagctgagagacctggggccagtcaacctgtgtaaacctcggtgtcctcgtctgtgaaatggggataattctagtataatacttgagcattaaatgcagttcaccacctgacatggtgtgagccctccagagttttggccaatcgtcattgagtgttttgttttcacattattttcgtgtttctgatgaagcaggagtgtgccgcctgtatcagtttctagggtgccctaacaaacgaccacaaacggggggacttaaaacaataagaatttattgccatacattcctggaggccggaagtctaaaatggaagatgctggcaggtgccagcctcactctgagggctcggggtgtgtcttggtttggaaacacatcactccaggttctgcctgtctgtctctgtcttcttctcataaggacactgatcatatagggtcaggacccaaccctgagtatgactttatcttaatttgattatatatgaaaagactatttccaaataaggtaacgttcacaggtaccagggggtagggcttccacatattactggggaggacacatttcagcccatgaccccactggactggagcaagccctcaggacccagcagccacgaggatcttccgtgtgaagttgtgtgggcttccccagactgtgctaagttctcccaaatggttgtgttttccagggtgttcagacttacatctcttggatatgttgaccccaactgaaagaaagcgacaaggatacatccacgagctcattgtcaccgaggagaactatgtgaatgacctgcagctggtcacagaggtaagggagctggtggggcagggggcacggcagggggcgatgacggagggagaggggagggttccgtcaaggaggtctatgtcctgattctgagcccaagaaactttctgatgtttgaggagcatctggatggcaaatgctataggagattgcgaccgcagagacggttcgttgcttatccatggccaacattgagtcattcccacagagggacagagatcacttagccaagggcaagtgagtccctgagcagttgatggatggagtcatgtgaactgagagtctggagtccacgctctactcagagcagctgcagctcagccaccaaccaggaggtgccatggagccagccacgccgccctcctggcccgcagtgttggcatctggaaatggggggccatctggctgctgtctcgagtcattcctgccatatgttaccctgagacaaacctgtcactgagaatggcaacgtttcctcccaggcccccacaaaagcccctgacctgagtgatgcctcctcatcttgtcagtcctcccagaagggccctggccacctcatccagaactatggggagatgcggagcccggcgctcctgctgctcagcaggccttttgtccacgtccatgggaagatgccatattgggagacagggatttgcagagatggacctgcagtttggagagtgctgtggtagtctggcaaccaccacaccaaacgggtgtgaaaccatcttgtctgatagtcttaacatccaggaaagacgcagcagggctcgccgctgttggaggagtacagggtgggttgttagctgcaggaccaccattaatacttaggaagcattgatgcaaactcaaaaaggtgcccctttctcaaggtgtttgactgttattaaatatgcagttcaggatgtccagggtgcaagtgtcactccttagatatggctcctttttgcactctgcaaaacgcaccaccatatgtggttgccctggtacatgccgggttcaacgtcggcttaaggactcctgtggaataggactcccagggagcagccgcagcccagccaagtttatgtcgaagatgggctgtccccttccctaaagagccttcagaagcgcctcctgtgggagaaaatgacctccttgcaggcgggggcttgcaagtggaacacggggttccactgagatctgtgatttactgagagttgctcaaccacacagagcttggaggggctcattcattttccagagcccaggaggagggcagcactcacccccttgtagcgggcctgcaagtgctgggtctgtccagggtcagcccaggaggctgaggacacagcgatggagtcagtcaccgaggtggccactggcttattagaggagctgccgcctgggctgctcctctcagaaggccctcggtttacctatgcagatgaagggactgtccacagccaccggcacctttaagccccgcttttcacaccggtccagcccctcccagtgcgcaggtgagaccgcttagcctgcgtgcatgacttggtaccggcctccctgcttgtctggtggagttaagacctgtctcctggagacttcagctgccctccttcccctgtaaaacaatgcaggccctgctggggacccccctccggtttccagggcagaggaggggctctctgcttcagaaactgcaggaaagcaggcgttcacctctgggcctctcagccaaggtacagacacctgagccctttccctgctctcagcggatcggcgtgtgagtgtgtgagttttaagctaactgctttctgaactgcttcgttttctgcatctgtagatttttcaaaaacccctgatggagtctgagctgctgacagaaaaagaggttgctatgatttttgtgaactggaaggagctgattatgtgtaatatcaaactactaaagtaagcctctcctctaatccccagcctggcttggcctcctcggctctcatgcactcgcacctctgtgggtctgtgtgtccttcttgcatgctgccctgtgcttctttctggctttttttttttcttctcattgccactcacaaacaccatcacccttttgtgccttcgtgctttctggaaacgcactccgaatctctcattgcaagagtaggtttcctgggcaccccagagcctgctgttgggtgaattactgtggttgtgaatttccagggctagggcgacgctggctcctgatggtgctggctccatgctggggcgtggggctgccccctctacgctttccctcggacgcgggatcccatgggggattattggtcttttgaggcattcttggccctgcagatggaaaaatgtggaactgttcactgcctaacatcagcagttcctcaggatcactccgggaagctggccctaggctggtcgtattttcttccaactttagtttgcagaggcagctccagggccaggagtcaagagacctgggtttggattctgacttactcactgcctttcctttttgagccttagtttccccatctgtaaaatgaaagggttggattcgatcatcacaaagtctcttccaattcttagaaaaaaaaaaaagtcaaaaaccaaaatctgtatccaccacgctctcattgtaacatcacttgctagaacacagattaagtcacagcctgcagggcgcgtgatattccctgctgggaggaagggccacccacttcctgggcccgaggatggagggcaggctccagagccttgcgtccattcctgatcttcatccgtgtcattgggaagtccccatttcctaaatgtggtctctgcattgttcttataaggtaatttcaggtccccactttcctgagcgtgtgtttgggagtggatggagggatggagaggaggtgtggagaggtggacatgaagaaagatacataatgtctgctggcttggtgctctagaagacgaatgatccaaggtgacatcaggcaggcttttagagaaggtctggactccgttgcccgcgccccctgccacccgatgccgtggaagcctttcgaacttaggtctggtgtcacacccttgggctcacatccgctattgcctctggctgtgtgtcttctggcaggtcactttggtccctgggcctcagtgttctcgtctacatagacgatagctgggcacagtggctcatgcctgtaatcccagtgctttgggaggccaaggtgggtggatcacttgaggtcaggagtttgagaccagcctgggcaacatggtgaaaccccatctgtaccaaaaatacaaaaagtagccgggtgtggttgtgggtgcctgtaatcccagctactagggaggctgaggcagaagaatcgcttgaacccgggaggcagaggttgtagtaagccaagatcgcaccactgcactccagcctgggccacgggagtgaaaccctgtctcaaaaaaagaaaaaaaaaaaaaaaaagaaaagaaaatatacctgtaagttaaaacctttttccttgggcagctatcagtgggggctgggggaggcgggagatgtttctgagcttcccaagtagcccttagagagggcttcccccacttcagggttggcctgagggaaactggtgctggcctcagctccccatacctctctgttgtcttttaacccccatctgggaagaagcagcctctttcttgagctgtgtggggggccaggcctgcgtgcttcttcctcctgtcggctctgacttgctccacagttgtggaggtgggaactgacagccctgttacggctgaagcagcaaagctcagagaggctgagtgacttccctaaagtcacacagtagggtggctgctctgtggatgatgcctaggtcccggaatagagactccgcccagtcctgcccccgtggaaaaaaacatgggcccagaagtcagacatcccaagtttttgtctgggctccggccccttctaactagttttgggcattaaggtggcagtcatggtgcttgtcctgcctaccatgcacggtcattctgagagcaagggaatcaggtgtcccaggggcacgccgtccatcagggggctgatgtgtacaggggctgctggcttccctccatcccaaggttctctatccccgttcctctgattcccggattagcttgtttggactaactggctcatgtcttcatcctccagataaaatcttatgttgaaccgtagccttctggggacctgatttctttttcttcttttctgcattttactagaaaaaatctcaaacatacagaaaatttgaaagaattgtagagtgaacacccacatcataaactggacaaaaaacattgtgctgtatttgggtggctgcatagacataatttcttcatgccaaggaataactgtgatgaggggagatcgagggctcctagcagccgagagagggaggcatttgaggataagaagttaaggcagcaatccctggagtgccaccagtgagcggccatatgtctgctactcctgatcctacagtccttgtatttggggggtggggcagggggtagggcagttatcaaacaagtcaacaataaataaataacatgaaaataaaaagggctaactggaacacatggacttcctactaatgatgcctcattgagggttagagcaaatggctggctctcttgcgaggaagctgagacctgagaaatgtgcctttcatagacaaggtagggccagacaggtctagaacctttttatatccagagcctggagcaggaccctcaggacagctgtcagaaatgatggcagaagggccgggtgcggtggctcatgcctgttatcccagcactttgggaggccgaggcgggtggatcatgaggtcaggagattgagaccatcctggataacacggtgaaaccccacatctactaaaaatacaaaaaaatagccaggcgtggtggcgggcgcctgtagtcccagctactcgggaggctgaggcaggagaatggtgtgaacctgggaggtggagtttgcagtgagctgagatcgcaccactgcactccagcctgggcgacagagtgagactccgtctcaaaaaataaataaataaataaataaaaaagaaacgtcatctctactaaaaaaaaaaaaaaaaaaaaaaagagctgtgcgtggtggcgcatgcctgtaatacaaactactcaggagtctgaggcagaagaattgcttgaacccggtgggggcagaggctgcagtaaaccaagatcgtgccactgcacttcagcctgggcaacagagtgagactgtgtcacaaaaaaaaaaaaaaaaaaaaaaaatgatagcagaagggaagcagaagtgaggtggggtgaccaacccaggtttggggaactgttttttatcaagaggctttcctgtcccctcgatggaaaaagaaaagaaaaaaaaaataagagcttgtcccaaaacagtgtttttcttaaatatctgactcatcttctttttaacttaagaagaatggattccattttatcttgtttaagcagaaaatgaaggaaaaataaaaaataaaaatcagtttggggtaatgacagatggtgagaaagaagaagaaaaggatgtggggttgggagaaggagaagagggaaggagagagggcatggagcagatggtgggaagtccagcagggcgggaagtgcagaggctgaggctgggaccagcagggaaaggcttgagggcgagatggcgggagcagggcagccgcgtctgggaagatgggcaggtgcccagagcagcttggaggcagtcgtggcgggaggtgggttggggcctctgaggctgtggtcccaaccatgggctctggagtcagacctgggttccagggttacctctgtcacctattagctctgagacttgggtcaagtcactgaatttctgcatgcctgagtttccccaataggaaatggggataataatatatgtaaaactctgtttgacacataggaagcattaataaatgctagttccatgactgtccacttggtctgcagacttcagagggttacagacactcatgtgttcagcaatcattgagcgctctttgaaacatttgttagccagttaattgccttttgcagttcaagtcctctcatctgtaaacctttctaggagactgccgatcagctcaccgcaagcagagtactcttagggctgtggctgcagcagccgagtcacatgatccctgggcctggtaacaccttgcggtcttcataagtctttgcctatacagtagaccatcctggacgaagacccatgactgaatctaataggtgcctagtccatagtaaatcaggctttaattttaggcctgtctgctggttgggtaactctgttctacaagtgtgggtctgcagaacccaggaactaattcctcaagacaatcactgtctgcagatgctctttcttcttttcttttcttcttgtctccttcatcctttaataaaaaacaggccagcggccggggccgggcacggtggctcatgcctataatcccagcactttgggaggccaaggtgggtggatcacttgaggtcagcagttcgagaccagcctggccaacatggcgaaaccccatctctactaaaaaaataaaaattagctgggcatggtggcgggtgcctgtagtcccagccactcgggagactgaggtggaggttgtagagctgggattgcaccactgcactccagcctgggctacagagtgagactctgtctcaaacaaaacaaaacaaaataggagaaggaaagggtgaaagtactttttattcacttgttaaaaaaactactcctcataggaaaatgatggaatgatggaatttcttcctgtttccattcattgcaagtttataacgtggctatccagggctctcatccccccaaattattggtgtcatcacccttgagcacatttttgctcgttgtggtatttcacaccaacccctcaatggggcagtggcctttgggccatcctgaggacaccaagctgccactgctccccacaccccagaggcagccagtgctgatctccccatgagggcatccacttcaggtggaatcgctgactgctcacaccacatcatttatggtccctaagtttttctccttggcttgcccggtccaagggactttattttagccaaaaatgtgggagaaagaaaagaaagtgatctgaagtttttaaagcctaatataaatattgcagagcttccttggaattcaatagcccgccccgtacctcaaaggcttctccaacatgaccatgaaagcagccaaaggcattcaatagggacatcctcccagccttgtgttaaagtcataggttataccattttgttccatctacccatccatccacccatgatcactaactaggatagctgaacacacccatggcttcatgttgtggtcctgccatgtagtaccttgctgtccttaccgtgtataagctcagtgccatgcccttcttccagatgctggtgttaagggttcacatgttgaagttgggagaggggaagcacagtcctagttaccatagctctgagcactcacactgcaggcagaccccagaacacacacttcccagtcccatcaacacctctcctgaattccaggatatacattttttgggttcattggcccattatcatagtaatagacctcttttccgaactcctcttaatttagttaactcagctctagcaatgaagcagcgaatcacagagatacttcaaacagtcatttatacctggcttttgctgaatctcatgggattattttgccaaggcatttgttttgccatcttaattatgttctttttagccaaaaatcatccttccccatcctctggcaatagcaacttcccttgggcagaagtgtctcctggaaataggatcagtgctcaggccacatcaacctggggctttcaccaccgataatctgtgtagtgaggcatcgacacaggggacccatttgagttgttcaagaaaaaaactccatatttctgcacaagaaaaacaaattgtaacaaacagccactctgccaaagaaaaatgctctggtgctacctctctgtagccctagactcatttctttctccattccttgtctcccaaatagatcctttagtggcccttaaggctgtgcccctcacacacattctgtttctgtgcaacctaagtgtgctgtggtgctgtcagatagcgtgaaagcagggggctcacctcccgtgtttccgtgcagagcgctgagagtccgcaagaagatgtccggggagaagatgcctgtgaagatgattggagacatcctgagcgcacagctgccgcacatgcagccctacatccgcttctgcagccgccagctcaacggggctgccctgatccagcagaagacggatgaggccccagacttcaaggagttcgtcaaagtaaggagccaggctgtgcagagactgggccccagagtggcgatctttgggcagctggatgtgtgaggggctaattcaaaagtctgcaagagtgttcccactagaggccaacagggcctagggtcttggctaagccttaggggactggcactcactggcaagtgtggctgtcaccaaaggggtgggcttggagaggaggggtgaaccctgggcttggaagctttgaaagtgtctttagggatctgttttccagatgctattggtgttatttggatgcatgtttaaatctttcatttcatttgcaaggcccaggcaggtcttagatttcctcttgtgtttaatcgccacatcctcagttctttgctggtctctgcccttcacttgcagagggaatggccaggactcccagtggccccttcattcctttcgcagttggttctgcttgatgtgctcccgccttagacagcctgtgggagtcagtgtgggatgccaggacctcttccttggaggtagcagggatctggagagttgggagtccaccaggggatgtttggggaggtaatgcggatactgctggaagacctgcagctctgggacttggccttggccagtgtgggtctctgctggccgtgctgggccattcaaacagcccccacatctcctggagaaaaaaaggaggaagagaataaaatagcttctgtgaaacaggtatcttttgatgaataaacaacaaaataataataacaggcatatctttggatctcatgcattttggagacaggccatcctcacctgtcctagagtggtgcttgtggaatcactgtggtgaggcacaagcgcagcctcttcttggtcagagcctcatgtgagcttgttgtttctgcctctcatggtgtttctcagcctagacttgccagccaaggcatggggcactctgaggtcattccaaggggagaaagattgctaagaaggaggccttgggtggatggagacgagagagcagatgctgagctgctgggcgccatggaccacctagggtttcagccaagggctgggctcttcctaggcccgagcaagatgagttcattgttggatgcacttgaacttcaggaaagtgctgacaccagcccagagcaggggcctcattgtccctccccgcccctctcctcttcacctctccccacctcctctcagtgggaatgtggcacgtcgttgccagctgcgaggtgttcctggaatgatggtgtccacagctggagcaggtcccggtccctggagacagttatcaggtctcagggctccagtcaatgcagctgcccgtttctaaggcattaaaccagaccacagcctttgacagctaagtggccagaccctgaaactggagtcttgacccccgttgtctgagctcctctttctcagccctgcctggagttcccagaggcacgtgcaggctccactcaaaactagacaatgagatttagcccttccagcagttctggggtgtaaggggaatttttcctctaaccgtatagtcttgtgactcttgttcctgggaatgttataaagtttctgcagacatccagacgaaatattctgtgtaaagccagaatctcatctctgtgcataaggaaccatgcatgccatggagggtatgctgaatccagagtgcagggcttaaccctgctggctgagtcacatctgtgggtctccattctccatctggaaagtgtgtcatcctggacagggtaactagtcaggcccttccaaccccaggtctctcagttgtcatccagataaatgagataatgggtggagagtcctcactgacattagtattgatgtcactaactttggattttgcaagtttcttaagtacatttaaaaacatctcatttcagagattggcaatggatcctcggtgtaaagggatgccactctctagttttatactgaagcctatgcaacgggtaacaagatacccactgatcattaaaaatgtaagtacctgtcttgccttttcaagcaggggacggctttctctgcattggagagggctggggtcatggacaagattcccagtgaacatatctggtaactgttgtgtagaaagcacgagacaacaaggtgtcacagaggtctgcttggtaactcagaaagaaaagctggtttatcacgcaaagagctggctgggcacggtggcccgcgcctgtaatcccagcactttgggaggccgaggtgggcagatcgcttgagcccagaagttcaagcccagcctgggcagcataatgagaccctatctctattaaaaaaaaaaaaaaaaaagagagctaatactgtgtccggaattggtgggttcttggtctcactgacttcaagaatgaagccgcagaccctcgcggtgagtgttacagctcttaaggtggcgcgtctggagtttgttccttctgatgttcagatgtgttcggagtttcttccttctggtgggttcgtggtctcgctggctcaagagtgaagctgcagaccttcgcggtgagtgttacagctcttaaggcagcgcgtctggagttgttcgttcctcccggtgggctcgtggtctcgctagctcaggagtgaagctgcagactttcgcggtgttacagctcataaaagcagtgtggacccaaagagtgagcagcagcaagatttattgcaaagagtgaaagaacaaagcttccacggtgtggaaagggaccgagccggttgccactgctggctcgggcagcctgcttttattctcttatctggccccacccacatcctgctgattggtagagcccagtggcctgttttgacagggggctgattggtgcctttacaatccctgagctagacataaagattctccacgtccccaccagactcaggagcctagctggcttcacccagtggatcccacaccggggctgcagctggagctgcctgccagtctcgcgccatgcactcgcactcctcaggccttgggtggtcgatgggactgggcgccgtggagcagggggcggcgctcgtcggggaggctcgggctgcacaggaacccacggaggcaggggaaggctcaggcatggcgggctgcagtcccgagccctgccccgcgggaaggcagctaaggcccgctgagaaatcgagcgcagcgccggtgggctggcactgctgggggacccagtacaccctccgcagccgctggcccgggtgctaagtccctcattgcccggagccagcagggccggccggctgctccgagtgcggggcacgccaagcccacgcccacccggaactccagctggcccgcaagcgccgcacgcagccccggttcctgctcgcgcctctccctccacacctccctgcaagctgagggagggggcttcggccttggccagcccagaagggggctcccagagtgcagtggtgggctgaagggctcctcaagtgctgccaaagtgggagcccaggcagaggaggcaccgagagcgagcgagggctgtgaggactgccagcacgctgtcacctctcaatactgcacagccttcagatgtgtgaccaagtggcttctaccttgtaagtcagaaaatgagagcttagtcgttgattctttttttaatttttttttttctagaagaaaataacatggaatcacagaaacagtctgtggtctgtgcctttctcccttgactctttcttaaagacaggcccagtgcctctaggccttgattttcttagcagaaaagagaaagaaacgtaatgctacgacctgtcttcagaaggccattgtgaaacactgtattagtccattctcacactgttgtaaaggactgcccaagactgggtaattaataaggaaagaggtttaattgactcagttccacatggctggggaggactcaggaaacttacaatcatggtggaaggggaagcaaacacatccttcttcacataatggcaagaaggagaagaatgggagcccagcgaagggggaaaccccttacaaaaccatcagatattgtgagaactcactcactctcactagaacaggatgggggaagccaccccaacgattcaattatctccacctggtctctcccacaacatgtgggaattatgggaactacaattcaagatgagatttgggtggaggcgcagccaaaccatgtcagacactgtgtgttgatattagatgattgttcttctcctgtcactttgagaaagccgataccaaaagaaaaaagaaagaacaaaattagggtttcagtgtccccacctgtaaaatgagtgaacagatttagatgtcctctgagcctatgtttgtaaaaccacagggagtatagctcctggaaagaggttttagatctggttccttttaatggaaaatggtgtttagaaactcagatgtgggcactggcgtgctcattgctactggggtgattttgttttgtgttcctctcggtggcagagctgggaaatatatgaatgtcttttcatgcacacatatttacatatgccaatgtatatacacatatatttatatttatttctagatccatctatccatgtatattagaactcatgaattcacaccagtacctcctattctaatccaatactgcagaattttttccagcctttccccttctgcctttgtaactccctactctgtgaagagcctggctctcattatcctcaatgtgtttccttatttgctcagtcttcttacatgtgacaaaactccctcccacataagccatctcctcagtccagccccagctcaactccacaaaatacactgtggatctttggctgagttaaatacttagttttgaagtaagttttcaacttactgttttctctcttccaacaccacagttactatttaattagctcagtacttctcttttttctcccaatgtttaattgcaaattgaagttgaaaacaagcttttaaaataggtgttctatatctagccaatgggagaaaaactaaaacaagaaaaggactgcatggcccaaatatttaaaagggggaaaaaaactcattatttgcagaaacacgattgatttcttccagagcacccacaaaaatgaactgaaaaccagctgaactaagaagagaattgaaaacagtggtcagctatgagatacatatgaaatctgctaaagtactaatactaaatatttttatgatactgatgtggagaaattcttagcatggtctcaaagacatgctaatcctaaacttaaaggatttagatcatagcaacctaaaaaatacccaaactttcatctgggcatagtggctcacacccataataccagcactttggaagaccaagacgggtagatcacttgaggtcaggagttcaagactagcctggccaacagggtgagaccctgtctctactaaaaacacagaaaaaattagccgggagtgatggtgtgtcaggtttgaggcccagctgaggtctgaggggagtgggtgaacgtggggcagggagctggaagaacacttgagagacagcaggtagatgggacatggcacagaattgtgcacctgcactctaatccccctgagtcatgcaggctgtttacatctgcgtatgcctgcctggttgcagcacagccatgttccctacatgatgtgtatctgtaatcccagctgctcgagaggctgaggcaggagaatatcttgaacctggcaggcagaggttgcagtgagccaagatcacaccacagcactccagcctgggtgacagagtgggactctgtctcaaaaaaaaaacaaaaaacaaaaacccaaattttattctggggaacaacgtatatgttcattaatgggaatggttaaataattatggtagatctgtactatgaaaatatttaaaaagatacagagcaacttctactcatgtattagtgtggaaagacactgagaaaatgctgttatgtgaaaaagcaacactaaactcactgagcaatcctatggtatgatgcattttgcaagaagaggggaaagagctatgattgagtcactgcactccagcctgggtgacagagtgaaactctgtctcaaaaaaacaaaaaaaaaaacaaaaaacaaaaaggccggatgtggtggctcacacttgtaatcccagcactttgggaggccgaggcaggcagatcccgaggtcaagagatcaagatcatcctggccaacatggtgaagcccgtctctactaaaaatacaaaaattagctgggcatggtggtgcatgcctgtagtcccagctactcaggaggctgaggcaggagaattgcttaaacccacgaggtgaaagttgcagtgagccgagatcgcgccactgcactccagcctggcgacagagcgagactcagtctcaaaaaaaaaaaaagaaaagatagaatatagaacttgaagttgctgagaggcagtaggcagtatggaatagcagtgaagagcacatagcctggagccaggctggctggggtttgaatcttgctacttaaccactgtgtgctcttgggcaagttgggcctcagtttcttgtctgtaaaatagggacactgatagtacctactgcatagtgatgtgggaattaactgagttaatgtatgcaaagtggctcatactaggcagtatataaatgttagttttatcattgagaacacttatgcgctaaatgtacaaaaagttcacactcacaggtaataaaagaaaatacataacaaaacaagaaaatactttgattttggcttgccagatgagcgtatattgaaaagattataggtcccagtgttggcaaagatctgggtggaagttaaattgatacagccttttttggaaggcgattatagatcaaactataattcctctttggctcagcaattccacctctaggaatttattctaaggaaataatttaagaaatattgaaaagttggaagcaacataaagttttatgggaaggtaactatttagacgcattgtgctcaataacgtgctcaatgaatattggggtctaccccaataatgatatattataaaaccctcaaaatgataatatgtatgaaatggacatggaacattgtactataaagcaatgtatgaaatagtacagtataaaatggtagtttttgtaaaatggtagtatgatccaatttttatttttatttttatttacttttttttgagacagagtctcgctctgtcacccagtctggagtgcagtggcacgatctcagctcactgcaatgtccgcctcctgggttcaagtgattctcctgcctcacccttctgagtagctgaaaccacaggcaggtacaatcacgcccggctaatttttgtgtttttagtggagacggggtttgaccatgttggccaggcttgtctcaaactcctgacttcaagtgatcatcctgcttcggcctcccaaagcaatttttattcttgaaataatggggagattattagtgatttttaggttctttataactttttgaattttctaaattttgtacattgtacaatattacttttgtcattagaaaaattgataaacctgtttgaattttgaaactaaacaaaacaaatgaatttactcaagccagctgggtgggttcctagcctgtagtagtggttctcagatttgactgcatgttagaacatctggaaacctctagaaaacccctaagcctgagtttcaccctccagggattttgatttagtcatggatgaggcctcagattttccaaaaggattctaacgtacagtcaggattggcccagaggttggggttgttgcttggaattgatttgtggactcacaagacatagaaaacagtgtgtgtttttctccatttgagcatctacttaggactttaaaccacggtatgcctttgggataagatattcagagtcagggccatttacattgtttgtatgtggacaaggcctgggcaaatatgccctcggcattctcctggtacacttcaaaggtggcttagggtctttcttcattctccagcacagggtgataattgtttttaggggcctggaagtcctttgaggatctgatggtaatcactgttgcttattgagcactttctaagggccaggtgctttgccaagaggtccacgtgtctcatttagttctccacacaccatataaaggaggctattaacctctccatttctcatgcgaggaacctgagactcagaacatttatgtgggccaggcgtggtggctcacgcctgtaatccccgcactttgggaggctgaggcaggcagatcacttgaggccaggagtttgagatcagtctggccaacatggcgagacccccgtctccactaaaaatacaaaaattagctgggcatggtggcgcacacctgttgtcccagctactcaggaagctgtggcaggaggattgcttcaacctgggaggcagaggttgcagtgagatgagatcgtgccactgttctccagcctgggtgacagaacgagacaaaaagaacatttatggctgggtgcggtggctcgcgcctgtaatcccagcactttgggaggccgaggcaggcagaacatctgaggtcaggagttcaagaccagcctggccagcatggtgaaacccccatctctactaaaaatacaaaaattagccaggcgtggtggctgtagtcccagctactcgggaggctgaggcagaagaattgcttgaaacccgggaggcagaggttgcagtgagccgagatagcgccactgcattccagcctgggcaacaagagcaaaactccgtctcaaaaaaaaaaaaaaaaaaaaaagaacatttatataaccaacccaaatcatgggtggtctgtggtggggcagggatttaaattcaggaggtccagctccggagctggcattcttagccaccaccccaaatggtctgcttagaaaagcgcacacttgctctgatgcacccgtctgcatgtggttccagaggcgcgtggacccaggaaggagccacccttgctgcagccaccgctcctcttatgccccaggctgcatgctaagcatagactgcgctgtccctgccctgccctccaagggcacctgttggctcttagaccctcatcagtgggttgatggaacactgcacatcaaatgccagaattgcattgtatgttccccaagtgagtgaacaggtgggaaaatagcacggaactgggcctgggatgcctgggctctgctcctggtctcagggactagtttattcctctgtgaaacagggtgaatattttctttttctttctttttttttttttgagacggagcctctctccgttgctgggctggagtgcagtggcgcaatcttggctcactacaacctctgcctcctgggttcaagcgattcttctgcctcagccccccgagtagctgggacgacaggcatgcgccaccacgcccagctaatttttgtatttttaatagagatggggtttcaccatgttggccaggatggtctcgatctcttgaccttgtgatctgcccaccttggcctcccgaagtgctgggattacaggcgtgagccactgtgcccggccaagggtaaatattttcaaagagaaactctaagggccccatggttatatgtacacactgtgatcctgtgagtctgcatgtgtggcttggggtccaccctgcgatgttaacattttgccggacagatcacatagcttgccctggacattcagggtgtggggctggactgagacctcaaggatgggaccattcactgcttcccgcaatgccacccactggagccatcaaggagtggccgtcatctgctacgtgattgccatgtgggtgctcagagctgcgattgctcaagtgggcgccgtccatgaaaggatggtgccctgccccgctgggcctggtcctgcaggaccctggatcacaggcccgcccacattgcctaaaaggaggtggttgtttttattctcctgtgtagatcctggaaaacacccctgaaaaccacccggaccacagccacttgaagcacgccctggagaaggcggaagagctctgttcccaggtgaacgaaggggtgcgggagaaggagaactctgaccggctggagtggatccaggcccacgtgcagtgtgaaggcctgtctgaggtagccaaccttggggctgggccctggtctcccccggcagagcctcgcctgccagcctggaggaggacaaagaaaagcatgaaccattctcctccccagccgatagcatcctcatttccatccagctgcttctcatctgctgtttcatccacccactgagtatttatttatttatttgagatagagtctcactctgttgcccaggttggagtgcagtggcaccatctcagctcactgcaacctccgcctccccggttccagtgattctcctgcctcagcctcctgaatagctgggactacaggcacacgccactacacccggctaatttttgtatttttagtagagatggggtttcccgtgttggccaggctggtcttgaactcctggcctcaggtgatctgcccacctcggcctcccaaagtgctgggattacaggcatgagccaccgcgcctggccatccactgagtttctaatttaaattatatcatttcccattgccagaagttctatttattttctcctgtctgctgatttctttctttctctttctccctttttctttcctctttctttctttccttctttctttctttctttctttctttctttctttctttctttctttctttctctctctccctctttctttctttccttccttccttctctctttctccttccttcctctcttctttttctctttctttccttctctctctctttcttctccttccttcctctcttctttttctctctttctttccttctctctctctttctttctccttccttccttccttccttctttccttccttcctttctccttctcttctcttcttttttcttttctttctttcaacaggatcttgctctgtcacccaggctgctggaatgcagtggcacaatcccagttcaatgcagcctggaccacctgagctcaagtgatcttcccacttcagcatcccaagtagctgggaccacaggtgcatgccaccatgcccagctatgctggtttctttcttgtatcttgttttttgctcaaatgttaatccttcttatttatttcttaacacattttaaacatagatattcctggccaggtgccgtgactcacgcctgtaatcccagtgctttgggaagtggaggcaggaggctagtttgtgttcaagatcagcctggaaacagagtgagaccctgtctatacaaaaaaataaaaagtaaattagctgggtgcagtggttcacacttgaggtgggaggattgcttgagcccaggagttcaagggtaaggtgagctatgatcacgctactatactccagcctgggcaacagagcagaatgtgtctcaaaacaacaaacagatatagatatagatgtagatatagatatagatatagaacccataacctgaagttatgggtgttattgttttgtctgttgtttctgccagctcttgctaaacttactaccttgtttcttgtattacgatttttgactgtgaactaaatgttccttagaactttacctgtgggcaccttttttttttttgaaatggagtctcgctctgtcacccagggtggagtgcagtggtgtgatctcggctccccgcaacctctgcctcccaggttcaagcagttctcctgcctcagcctcaaaagtagctgggattacaggtgcgcaccaccatgcctggctaatttttatatttttaggagagacagggtttcaccatgttgaccagtctggtctcgaactcctggcctcagaagatccacctgcctcagcctcccaaagtgctgggattacaggcgtgattaccgcacctggcccacctgcaggcatctttattgtctgaagttgtattccttctggaaggactgttattgtgattatccaaaactatgtttagaggggtttgggcatcacagcccttgtgtgaatcgtggttgtaaacttgcgtgagagctacctgataaagcacacattctcagggcacgttttccttcactacaccaaggtcaaaaacagaaatgttttattgctcatcccctctgagcttgagtttacctgtcactcctcctctgggttcatctttttgtgaagatctcctagtagacccctcacgttggctctggatgcacctgtttctgcaccctatgtagtgagtaaaatgcaaggtcagcgtcagcagattcaagagagaccctcaaagctatagtggcactggctttcggtgatcttccaaggttcctattttcattctgttttcagcctctgcaaatttcttactttgtttctattttgtgtgtgtgtgtgtgtgtgtgtgtgtgtgtgtgtgccagttttcttggagttaaaaagtggatttttgcatttttctgtttttttaaagtttttgttgggtgagtcattctgagtatctagtccactctacttccagcaacagaagtctctctctgtctctctttctctttctctctctctttgtgtgtgtgtgtgtgtgtgtgtgtgtgtgtgtgtgtgtttgttttagtcagggtctcactctgttgcccaggctggagtgcagtggcacaaactcagctcactgcagcctcaacctcctcgagtgattctcccatctcagctttccaagtagctgggactacaggcattggccaccatgcccagctaatgattctattttttttgtagagacaaggactcaccatgttgcccaggctggtctcaaactcctgagctcaagcgatctgcccgccttaacctcccaaagtgctgggattacaggtgtgagccaccacgcctggccagaagcctctcatttggtttctaattttcttcttttcacttaacctttcctttggtctcattcattctttttgcccattttttctctctgtttctgtatacacatgtgcttgtgcctgtacacacatacatacatgcatgtatgcacacacatacaccattcactagggtttcccaaaatgaccagcgagaatgtgtctccctcatccactcctcctgtggtttcttccctctcataagctgcaaaggccatcaccacctgagggagtcaccatgactggttcctccacggccccatctcctgtccaccttcagtgttggtgtgggatgagcaaaggtgtggaagcagccccgtggaagccgagaggacagctgtgggctcccattttgggattttgtgttgctctgctgtcagtgggtggctcatttattcgctcatcatcattcattcaataagcacttagtgagtaaccacccatgtgccacggctcagtactaaaccctgggacataaaaacaaataagatgtgactcccactctcgaggagcttatggtccaggaggaagctgggggttaaaccaacatttacaacaagatgtgaggggtaaggaggcagagctaggtgccaagtgctgtggcgacatgtgacaggagcaagggacagttgtacgggggactctcgggccctggaggtgatgcttgactgcgtgttgcaggatgaagcattggaggcaggccaagcaccgtgtctcaggcctgtaatcccagcactttgagaggccaaggcaggaggatcccttgaggccagaagttcaagaccagcctgggcaacatagtgagaccctgtctctacaaaaaatgtttagaaaactaaccaggtgtggtggcatgcacctgtagtctcagctacttgggaggctgaggcaggaggatcgcttgagcccaggagtttgaggctgcagtgagccatgatcgcaccactatactccaacgtgggcaacagagcaagaccctgtctcagaaaaaaaagaaagattgaggcagggcattaggagtggaggaccattctgagattctgagcagggcattggtgaggattgcagaggaatgatgggccacagggctgcagggcaggctgaggcccagccgaggaaggcctgtgtataatgcaaaggaacattaacttgatcctgaagacaagggactcaagcagcccctgcactgccacgcagaaatgccgacacacagtcatgtgcactttagaaagggcccttccccgactctgacagctgccatcagagggacacagtgaggccgggatctgaagatgttaaagtaaaatcagttgtcatccttctttttttttgagacagagtctcactctcttacccaagctggagtgcagaggtgcgatctcggctcactgcaacctccacctcatgggttcaagagattctcctgcctcagcttcccgagtagctggaactataggggcccagaaccacacccagctaatttttgtatttttagtagagacggggtttcgccatgttggccaggctggtctccaactcctgaactcaggtgatctgcccacctcggcctcccaaagtgttgggattacaggtgtgatccactgcatccagcctagttcttgtgctttgattttttcagcttacatcccccctttgccatcagatggctgtccttcttggtcagtcttcctggctatcatgcacagcgtcgttgttgtcttgatgatgttcatggtgatgggaaggggatgtgttgacttctgtctcctgacctaggatcacggtgtggaccatgcgtggcccaggtctggacacacaccagtgattaagtttcaaacagatgctgtttttggcattcctgtctgaagatagagaagtttaaatactgttcccagttcatgcatattcagtgttatcttggccaattagaggctttgagtatgaatgaacgagagcacctttatgtcattggatccaatgacacttgccttctctggattatttgcgcccacgtggcttgaaccctgtcttggcaagcaggaagggctggttggtctccaggctcctgcctggagtgcagaggtgaagaatgttctttgaaggttcctgttgtggcaccaccttcggtctttcttgggctctcagaccctccacaggaggtcagaggtcatctttcctcctcgtggctgacagcagagtgcagtggcccctttccagctgcctttagctctccactcacagaagtgccactgtttctcctgtattggagatggacaggtggccatcagcttcttttgggggacacatgttacgaacctatcactccttcacaaatactctcttcagagaggggtccatagggctcgtagctcaggacagagctccggagcgccccccaggccaattgtgtgggcagatggggagcgtgaggggctggcctcggactgggtcatcttactcctggcgcgcagccatggccttgctatccttggcctctccccttgctgtcaaaaagggggcctctgtgggatcatctccacctcagtgccctctgccccttcagaacctagtggaggtgatggacccccgagaggtgttagagccgcgtttcagcgcccaccgtgtctctaagggtcagtggagggagggagctgttcccttcctgtttgctgagcgggtgagtcgggtgaggtttcatgtgcgcagtacagtgtctgttctgtttggcactggagggtcgctcaacaccactgatttacagctgggtatggtggctcacgccggtaatcccagcactttgggaggccaaggcaggtggatcacgaggtcaggagattgagaccatcctggctaacatggtgaaaccccgtctctactaaaaatacaaaaaattagccgggcgtggtcgcgagcacctgtagtcccagctacccgggaggctgaggcaggagaatggcgtcaacccgggaggcggagcttgcagtgagcagagattgtgccactgcactccagcctgggcgacagagtgagactctgtctcaaaaaaaaaaaaaaaaaaaaaattaacaccactgatttgtgcagtcacacacatgccaggggcccggactgcagttgtgccttggaaggcagcatttgtccatggaattggagagagacgggggctgctgctttccagaagctcaaaggactgtctgaatctgtgtggggttttctccctggagctgtttcatgcacagaccctgcatagagcagggagtccccaaggtgggagccaggtgggcacttttctttctgctgccccatttccccagtaaataaaaaagagaaatggccaagcccagtggctcacacctgtaatcccagtattttgggagcttgaggtggaacgatcgcttgaagtcagaagttcaagaccagcctgggcaaagtagggagaccccatctctacaaaagtttttttcacatgtgttggggggctgagatgggagaattgcttgaacctgggaggtcaaggctacctgaactatgatcacaccactgcactccagcctgggcaacatagtgagaccctgtctcaaaaaaaaaaaaaaaaaagaaaagaaaaaacacaccagttgcaccataagacactggcatgctcctagaggaaaagccttagaaattaccattgagactcttcttgatacttggaatcccctgaactgtgcctttgtctgactttgatctcttggctccaaagtcttcaaagctatccttgacttttgcctgagatccgagtctgctggggcctggcctctgattctgatggagcccatgctttcagatgcggagaaacaaaaatgctacactttgggttttgttttcctttctcagcaacttgtgttcaattcagtgaccaattgcttggggccgcgcaaatttctgcacagtgggaagctctacaaggccaagagcaacaaggagctgtatggcttccttttcaacgacttcctcctgctgactcagatcacgaagcctttggggtcttctggcaccgacaaagtcttcagccccaaatcaaacctgcagtataaaatgtataaaacagtaagttggattctagattttgcattatcagggttgacgtgtttggggaggaagaagtttccaaaaaggaggtagagttttagcagggtcaggggctgtggcatgcaggagaaggccaggagttgaaatgcgatttagggtgtccggagtggaggacgatccatatcccgccgcagtgtcagtgacactcagtgctatcggtggaacatattggctgccaaatggctgctgtggtcccctgggatgtgacagaggcatgctttagcctgtaggagcgaagtctagggtacagatgaggcaggtgtgaaaaagctcgggagaagaggtgcaaaacagcacccagggcccaccgtcgcctccaaacagtcctaagtcccctgccagacttctccaggtagcttgaaacatccgagccccctcctttctagcaaagtctctctaaacagttgatacgtggagaatttccctcagctgtttatatggtctgctcatacgtgcatggctgtgtttgtgtgtctttgtgtcacgggacgttgtttttctaaatttgtctgcatgggggtgtttttacagaagaattttctctgaggcagcagttagctttattatgggaaaaaaaagagctatgtagttatatagttactagaaacttcatgtgaaaatctttggagggaattgcttgatgtaaagtggatgaaaactgctgtttagaatacaccaggaaaagcgacaccagccagatcttattctgaaagacttaaaacatacccgcaaaatcgtgggcgggggaacccatatttatcatatttataatttgtaatatgtaaaagttgatgctaacccaaaattattattctgggattctttactggaaaacacacacgcccttagtctggtttactggaacacacccagaaacacacacacatgctcagtctaggttactgaaacacacgcacgagtgtgcacacacgcgctgacttgcagtctcgtttactagaacacattggcataagtgtgctcacacactcacggtttaccggagcacacagacccccagcctcgctttgtaatgcctgtgtgttactttccagcctattttcctaaatgaggttctagtaaaattacccaccgacccttctggagacgagcccatcttccacatctcccacattgaccgcgtctatactctccgagcagaaagcataaatgaaaggtgagacctgccgcctccccagcatgggccccagggctccacggctctaggacacacaaggggcgggtgattaatcaggtgccaatgtttcccaagtggcaatgccatcacccctagctgggagtggggatggggctattacttttttctacagcctctcaaaaatctgtcacatggcatgccctttccaaaataacatggattcaaactaattttgcttgagtttttttttttttttttttttttaaggcagagtctcactctgtcacccaggctggagtgcagtagtgcagtcacagctcactgcagccttaacctcctgggctcaggtaatcctcccaccctagcctcccaggtatgtgggactacaggcatgtgctaccaagcctggctaattctttatatttttttgtagagatgggttcttgccatgttgcccaggctggtcttaaactcctgggctcaagggatccacccgccttggcctcccagaatgccagaattctgggattacaggggtgagccactgcacctggcattgttgttgttgttgttgttgttttattaagaaatgtttcgcattctttgaggtaaacagagcatctcaggtttcccctggcttcccaggtggcagaaaccaataggaaagtaatttcggggttaataggaccacgcaaacccaaacctctcctcaccttggctgacttaaatgggcattctggaacctagggctgtgggtattttgcttcaatctgtcttcaagacactgccctggagccaaatgaaatagatcattttctgaagggtgaacttgacacaaggccagcatcattccaaagagcatttgcaccaagcaagaaaattggctaaagcttttgtgcatatggttctcagaaaaaatgaaggagaaaaccgcggccacaaatgccttcccccaaggcgttttggtctttcgtgtgaagtggttcccaatctgggaagtggtttttgttctttctttgcgtgatttcataagcgagatccttctggctttgttggattaggcaaatatgtgctgctcttcggtaaggaaggaagaggagtcgtgtcccgatgttgcctccaagacagcatctatcacagattttcttccccggggacatcatcgcaggtcttgaggacatccatggaaatggccctcatgcctttcttatcgatggcaggaataagtattagcgtcacgtgacataaaatcagattttctttcccgagcctttgttgttaaaatcaaatgaacaaagaaacagagtcctggcaacagtgtttgaacagacctgaagcctttttcctgagtttctgtttggcaactttctgtctttttctgtccaaggactgcctgggtgcagaaaatcaaagctgcttctgaactctacatagagactgagaaaaagaagcgcgagaaagcgtacctgggtaatgcatggccccgcggggtgtcctgcacagctgggcaggagggagggccatttggctgggctgaaaatcctcagaatagaagaatcccctggacctagaggaggggcatggaatgagatggaagtgagcttggggtgggatgcagatggggatggagggcaaattccaggagcaaggaagcaagtgtttaaggagagggaagaattacttttgagtcgggagaggtacatgaaatgcattgtgaggctcacagagatgggaaaggtgtggcacgttcaaatgaagcattttgtgtttttcctgccgtcatagtccgttcccaaagggcaacaggcattggaaggttgatggtgaacgtggttgaaggcatcgagttgaaaccctgtcggtcacatggtaaggctgtgaggcgcccccggctcctgctttggggttgggagtagggtccgggttccccacacccccacctggctctagatcaaatgtgctatttccatactccctgatctccttccagaattggtttaactagcacttgttaaaaacctggaggttttgtgtttttttttccatcctttctaccattctgcttctccgagggatctgagtggctgcattcacagtggatgtgacacaagatcaggccaaagtaacgagacaggaagggcctagtttcaaagcccactcaattaagtatttgtttttagtttaaggatgaagctgacttctgggagtttccacccggattctccaccgaatgacacttattaagcatagcagttattaagagtggggagcggccgggcatggtggctcacacctgtaatcccagtgctttgggaggccaaagcaggtggatcacctgaggtcaggagtttgagaccagcctggccaacatggtgaaagcccgtctttactaaaaatataaaaaattagccaggcatgggggcagccacctgtaataccagctattcattcaggagactgaggcaggagaatcacttgagctcaggaggtggaggttgcaatgagctgagatcataccactgcactgcagcctgggcgacagagcaagaatccatctaaaaaaaaaaaaaaaaaagagtggagatcaaaatgaggtgtgagttccacctggcgaaggcttttgttccctccaggaaagagcaacccgtactgtgaggtgaccatgggttcccagtgccacatcaccaagacgatccaggacactctgaaccccaagtggaattccaactgccagttcttcatccgagacctggagcaggaagtcctctgcatcactgtgttcgagagggaccagttctcaccagatggtgagtggaacgcggccctgtggttattcctccttccctggcactcgtttgcgtgggttaatgttttcttacctggggacttggtgccaggattccttcggtttccctcctgagagatgaggctggctggcacaagacgaggctctgtctcccctggaggagtcttctggaggcgtctcattgcatgtggacagagcatgcttggtctagaattgtgccagctgccctgggcaaacacgtccatcttctgctttccaaagcaggtgactgtggagaggggtgtgtttaagagcctcagcatagttcttcagtccttggcaaaaagctgtgctggcaatggatgaaactggccaatggaacaaggatgttagcccacaacaggagccgcagaatgggccaggtccctttgggtggcatttttgtaccacttattaagtaggcaaagggatgcagtcatgttgaatgaatcatttcttcagccagccttctgtttctgcttgggcctggaaaagaatagtctcagcccaatgattccaagaaactacctgtctctccctcaacccaataaaaatcaccggtgggcatggtgctgcaggcctggaatcccaacactttgggaggctgaggcaggaggatcgcttaagcccaggagtctaagaccagcctgggcaacatagtgggaccttgtctctacaaaaaaatacaaaacttagccaggcatggtggcatgcacctgtagttccagctactcgggaggctgaggcaggaggattgcttgagcctgggaggtcgaggctgcagtgagccatgatggtaccactatattccagcctgggcaacagagcaagatcctgtctccaaaaaaaaaaaaatcacagagtaagttaaaagattatggtctcaacttaattataaccgaagaagtgagggtcaaatgctagcattatctgtacaaggtttaaatggctccatatggccttcatcttttagtactttttatatgaattatctcattgtgagttaggtactcgttgtggtagctggttaaatgtttgagtgtgactggaacagtttggctcccaagtctgggctcttaactactatgtgtactgtcaacttctaattcttttttctttttattttttttatttatttatcttttttcttgttgttctcgctctgtcactcaggctggagcacagtggtgcaatcacagctcactgcagcctccacctcccaggctcaagcaatcctcctgcctcagcctcctaagtagcagggatgacaggcatgaaccaccatgctaggctaatttttaaaaattttttgtagagacagggtctcactctattgcccaggctggtgtcaaactcctggactcaagtgatcctcctgcctcggcctcccaaagtgctgggattacagacgcgagccactgtgcccggccaccttctaattctgagagataaaggttggggttgggtttttttttttatttaagtaatgaaataccatgacacattggcaactccgctggggagcgagttggaaatcctagtgttggtttacatcagagcccagagaagaagggagagcataacagttcatcagggggtccccaatatgccagacatgtgcctcgaagagagggaatggtccctcttaggagggtctgtttgttctcttttcagattttttgggtcggacggagatccgtgtggcggacatcaagaaagaccagggctccaaaggtccagttacgaagtgtcttctgctgcacgaagtccccacgggagagattgtggtccgcttggacctgcagttgtttgatgagccgtaggcagcgggctcagggtgtgctcagcagggtcccagcccacggccacacatgctgtctggaaattgtattccttttctaagaaaccaccatttggtattcagtcacagggatatgggatggcaaagacaggcccctcaaagctcctaggaatcattctcgacaatcctccctgccccgaaacaatttcctgtttcatgaaacaaagctgtgttttcctttgtcctcactacaggtctcattatggcttctagggtcgctgaaatcccatagccctcaacagggtgcagctgggagtctagccccttcccgggcttgagggatgggtctggttactataaaatagatttataaatgcaatgtctatatttttggagaactcatgtaaccctcctgtttcttacatccaccagtccccaagtagacttcttggcctacaatgcccagtccttggtgtgagtttagaaacaattatgacggtcctgtcattgcttcagaatcccatctctcctgcagggaaatgctgcctagagctgatcactcggtgagacggtctgatcaggccctggcttagctctttgaagagctggtctatggaagtttccagcatgtgcaccgttatagccgttccttccccctctaggccttgtattaatatatgtcaatgaaaacacactggtgtattgttgcgtggattcagttctgattcccagcatgcttagaatatggtcacagaaagtcattatctagaaagtcacccctctgctggatcagatcactacaggtcactggaaaggcaactttacaatgttgggtcactgggtctcggttggcagccatgttggaaaaatctcttttggctcggaggcctgtgatatttcatagcagcagtcgttgctggtgacctgttctgtgcttgaatgtgctgaatcctgattgttgtaggacatttcaacagctctttttggtacgttccccaaaaagccatgtcctagatccccaaggcgt

SEQ ID NO: 37195 - DNA, 246826 bp, Homo sapiens; identical to SEQ ID NO: 37194

SEQ ID NO: 37196 - DNA, 5170 bp, Homo sapiens
tccggtcttgtccacgctagggggtgcacgtactcccaactgtggtcgcgctctcaccccttctgctgctctcgtggccccctcgcgatggcgggcatcctgtttgaggatattttcgatgtgaaggatattgacccggagggcaagaagtttgaccgaggtaagtaaggtatgtaggggcggtttggaggaagaggctaacctcgcggacatgcccctgggccccgtgtccacccagctcttgtggcctgcccctaccagcaggtcctggtgtagggacctccctcagtaaacattttatggatgagaaaacggagactcccgagctctctctggcttcacgcatgccgtgcccggtgcctgggtggccttttgtcatggtgctggcaaactcctaggcatatttataatcgctacctgctctgtgctagacactgtcttgtgagaccagcctggccaacatggtgaaaccccgtctctaccaaaaatacaaaaattagcctggcgtggtggcgggcgcctgtaatcccagctacttgggaggctaaggcaggagaattgcctgaacctgggaggcggaggttgcagtgagccaagatcgcgccactgcacgccagcctgggcggcagagcgagactccgtctcaaaaaaatgacagtcctcatgaggtgggtggtgcctttcccatttttctctgagaggttgagtaaaccacccaaggcttcacagcgagtaatctgacttcagagcctatattcttgtattgccctcagaatctttagcgctttgtgaagtcttctttgagttagagttagctgcttggtatatacctttttttttttgagacgcagcctttctctgttgcccaggctggagtgtagtggcacgattttagctcaccacaacctccgtctcccgggttcaagcgattctctgcctcaacctcccaagtagctgggattacaggcatgcgccaccacgcctggctaattttgtatttttagtagagacagggtttcaccgtgttggccaggctggtctcaaactcctgatctcaaatgatccacctgcctcggcctcccaaaatgtcgggattacaggcatgagccactgcaccggcctacacctctttattttgtcatctatcaataattttctctttgatgtctctttctttgcctggagactaagatgtttttcaagacggataccagttcttatacatcttggtcactcccctcagcacagtgcctagcatagaaagagaaaacctttggatgattgaataacttgcccagagtcaggttctcagtcatccaggcaggctttgctgctggagtatctttggttgttttctggggattacgttcgcttgccacagtttttctccccttttccttcttgcatatctggttctgattgagcctgaatttctatgagagcagatgagagaccactggatgtagactgggttagattgagtatcctgttgcatacaatcccacactgtaggatctgccttggcaatacctctgtcactcttttcctgcttctccccagtgtctcgactgcattgtgagagtgaatctttcaagatggatctaatcttagatgtaaacattcaaatttaccctgtagacttgggtaagtattgaatacagacaataataagagactttttgctgcttctgctattctttactctctgatattgctgttattttcaggtgacaagtttcggttggtcatagctagtaccttgtatgaagatggtaccctggatgatggtgaatacaaccccactgatgataggccttccaggtgagggagtggagaaggtaatacttgaaatatgccttgaggactaagtagataagtgatatagaaagactcttctaaaattcctggaataaatgatgatcagcagaatctgagtaaccttaaggaaatttctgcacttaagaattcaaacaggccaggcaccgtggctcacacctgtaacccaagcactttgggaggccgaggcaggaggattgcttgagtccaggagttcaagaccagcctgagcaacatagcgaaacctcactgctacaaaaaagaagagagaaaaaaaaaaaaggctgggcatggtgtcatgtgcctgtagtcccagctgcctgggaggctgaggtgggaggattgcctgagccagggaggttgaggctgcagtgagccatgattgcaccactgcactccagcctgggtgacagagcaagaccgtgtctcaaaaaaaaagaaaaaaattcgggccgggcgcggtggctcacgcctgtaatcccagcactttgggaggccgaggcgggcggatcacgaggtcaggagatcgagaccatcctggctaaaacggtgaaaccccgtctctactaaaaatacaaaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaagaaaaaaattcaaacaaccaggtatttatctataacagtgattacatgcttgtgagttgcagccttttgaaggctgaggaggtaactgctgagtgacctaggccatgtgggtcttgtgtcttgggagggagcttggtgtgatggaaagactttggcaccccacttgagttcatttctcagctctaccacttatttgttgagtaaccttaatctccttcagcctgtttcctcatcaataaaatagagatggtcatgcctagctcatggggttgccatgaggactaaatgacatcatgtttgtaatgtgcctgttgttataatgctggcatttagttaccagtaaccatttttttttttttttttgagacggagtcttgctctgtggcccaggctggagtgcagtggcgcgatctcagttcactgcaagctccgcctcccgggttcacgccattctcctacctcagcctcctgagtagctgggactacaggagcccactaccacgcccggctaatttttttgtatttttagtagagatggggtttcactgtgttagccaggatggtctcgatctcctgacctcgtgatctgcccgccttggcctcccaaagtgctggggttacaggcttgagccaccacgcccggctgaccagtaaccatttttaaatgggatcttttatattgttaattactgttaagaataactttgctgctattgctccatagggctgaccagtttgagtatgtaatgtatggaaaagtgtacaggattgagggagatgaaacttctactgaagcagcaacacgcctgtaagttacgtaatcttgtgaggattcttttcctcttccatgttctgagactttgagctatgctcctgcttcctctgttgagtccctctcctcaggcacctcagaccgaggtgggaactagaaagaaatagttctgggagcagtttccagtctgaaatgtagactgccctttgtcaggccctcctggcccagtggtccacatgagaaactgattatctcactgtgtaaagtgcaaaggagacttgcttccccaggaataaatgcagcattaagtgattagactgttaggctttgtgtgtgtgtgtgtgtgtgtgtgtgtgtgtgttttgctactctgtaaaaggctgtgtgtgtgtgtgtgtgtgtgtgtggctactctgtaacccaatccctagttccttggttttcctgtccagctattttttcttttctttaaagtcttattaaaacaatatgtgctttttgtaagtaatttgaaatgcagaagagtaatgtgaagaaggaaaaaaaagtcacctgtaattccatatccagagagaaccttttacatagacttttttgcatatcctggtgttctgtttttttcttggagactgtggtgtttattatgttttcttctgctctttttgcttaacattatgtaaaacatgtttccccatgttagtgtaaagcttttcttttcttttcttttcttttttttttttgagatggagtcttgctgtgttgcccagcctggagtgcagtggcgcgatctcggctcactgcaagctccgcctcccgggttcacgccattctcctgcctcagcctcctgagtagctgggactacaggcacccaccaccatgcctggctaattttttttttgtatttttagtagagacagggtttcaccatgttagccaggatggtcttgatctcctgacctcgtgatccgcccgcctcagcctcccaaagtgctgggattacaggtgtgagccaccgtgcccggccggtgtaaagcttttcttaaacgtttcaatagttgcataacatttcagtaagtggatatgtcttgattcatttgaacattcccctgatttggggcatctaggtgttttccaccctcgataatataaagaacagtgccttgcacatatctgtgcattgatgtttgtcagaattttggttcctagtgacaaaacagtaggaagatgcctcttctgtttcttaggctgagatggaacagtgccttgcacatacctgtgcattgatctttgtcagaattttggttcctagtgacacaacagtaggaagatgcctcttctctttcttaggctgagattgagagctgctgagtggcagtgctccagaatcacgggatggggccttctgtttcagctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcagactgcccctcccctttttgtaaaaagtccatttactgt

SEQ ID NO: 37197 - DNA, 9336 bp, Homo sapiens
gataatatctgtgcctcctgcccagaaccctccaagcagacacaatggtaagaatggtgcctgtcctgctgtctctgctgctgcttctgggtcctgctgtcccccaggagaaccaagatggtgagtggggaaagcaagggatgggtgctggagaggactggaaggaggtgaggaacaggacatgtggctgggagacaggctggatgcagctgggataccctggcatacggcaggaatgggtgcccaaggctgtcaactccctcagctcacacacttccaggagcattcagggagcctctgcgctggcccgaaataagaccttcaggaatctgaatctaaaacccctagtttacagtgaaaacaaagactccaaagaccaagcgacctgcttggggtagacagtcaggacggagtaggaaccatatgcctggagctgcttctgctcctgttccttccctccttccgatggctgggtacacctgcctgacgctgagggaaagagagagcagccccaaggggaaagtgggaaggcaggttggctggagggatggtgctagaaggaaacccgtgcccaaatcccacactcagacaccactgcagtgggtctggaaggcgagtggctggaagagaagagagtgggagctccgggagatcaagagtcactcctaggataagggaaggaggctgtttgtggcatgagaatgtgcaggataaagacatggaagcgaatggcttctcagttgtgtgagtttaaaattcatgacatttacaaattgtcagaaaaggtgttatatgtttgttatataacaatcactttggaatgttaatctgattctgtgccaaaatctgaattactcagggttctccagagaaacagaactaataggtggtacacatatacatatatatgtacgtacacatacatacatacactgtatacacatggatacacacacacataggaagagatttacatatatgtatacaaaagagagagagagtagagatttattttaagaaattgactcacactattgggaggagtaacaagtcctaaatcttcagagccggccagcaggctggagacccagggaagagttgatgtcttagtcttgattccaagggcagactgtaggcagaattctttcctctttaggggacatctgaggctttttctcttaaggccttcaactgattggatgaagcccaccactatggagagtaatccactttactcaaggtctactgatttttttgtaaattaaaaaaaaaactgtgggtgcatagtatgtgtatatatttatggggtacatgagaggttttgattcaggcatgcaatgtgaaataatcacatcatcaaaaatgaggtatccatcccttcaagcttttatcgtttgtgttacagacaatccaattatacttttttggttattttagtttttaaaagtatttgattatttatttatttatttatttttgagacagagtctcactctgtcacccaggcaggagtgcagtggcatgatctcggctcactgcaacctccgcctcccaggttcaagcaattttcctgcctcagtctcctgagtagctaggactacaggcacctgccaccacacctggctaatttttttgtatttttagtagagacgggtttcatcatgttggccaggctagtcttgatatcctgacctcgtgatctgcccgccttggtctcccaaagtgccgggattacaggtgtcagcaactgcgcctggcctctcttttggttatttaaaagtgtacaattaaattatgattattattattatttttgagatggattcttgttctgtcacccaggctggagtgcagtggcgtgatcttggcttactgcaaacctccgcctgttgggttcaagcaattatcttgcctcgggtgtacactgccacacacggctaacttatgtatttttaatagagatagggtttcaccatgttggctagactggtcttgacctcttgacctcaagtgatccactcacttcagcctcccagagtgctggaattacaggcacgagccaccacacctggccccagttaaattattattgactatagtcaccctgttgtgctatcaaatagtaggtcttattcattcttctttttttttttttttttgtgacagagttgcccaggctggaatgcagtggtgcaatcttggctcactgcaacctctgcctcccgggcttaagcgattctcctgcctcagccttctgagtcgctgggactacaggtgtgtgccaccacgcccggctaatttatgtatttttagtagagatggggtttcaccatgttggccaggctggtttcgaactcctgacctcaagtgacccacctgcctcagcttcccaaagtgttggaattacaggcatgagccaccacacctggccccagttaaattattattcactggagtcactttgttgtgctatcaaatagttttctaactattttttttgtacccattaaccaccctcccaatttccccccaaccctgccactacccttcccagcctttggtaaccatccttctactctctatgtccatgaattcaattgtagggtctactgatttaaaggctaatcacatttagacactcaggagcaagaataattttagtaattgaactaggattctgccatatgacctccaacatcattagcacctgtgtaaattgtatcataaaataattatggaactattatggaaatgtccctctctcccagatcccaccttgtaccaaaatgcaaggtacaaccccgggaattctgagctccatcctagtcttaccctgtgctaattcagtctgggtcatttcttgaattttctggtaaattctcctttctaccctttctaactatatgtatttgtcaggttaagctagaagtgttaatttttttttttttgagatggagccttgctttgtcacctaggctgaagtgcagtggcatgatctcagctcactgcaagctccgcctcccgggttcatgccattctcctgcctcagcctcctgagtagctgggactacaggcacccgccaccatgcttggctaattttttgaattcttagtagagacggggtttcaccatgttagccaggatggtctcgatctcctgacctcgtgatccacccgcctcggccccctaaagtgctgggattacaggcgtgagccactgagcccggacgaaatgttaatttgttttttttgagacggagtctcactctgtcatccaagctggagtgcagtggcatgatcttggcttgttgcaacctctgcctctctggttcaagtgattttcctgcctcagcctccagcatgactgggattacaggcccgcaccaccatgcccagctaatttttgtattttttaatagagatggggtttcaccatgttggccaggctggtcttcaactcctgatctcaagtaatctgcctgccttggcctcccaaagtcctgggattacaggcatgagccacggagcccagcctagaaatgttaatttctaacgcatgtcagattccatgcacactgggcaaggttccattcctccatggggtgactcagggatccaggccaattgcatattgagactctttcatattatcctgtggccttcaaagtcgtcacctctagggatgagaaacaaaagggacaagccagctggtagggtcttggacaagaagaaagacatcacttctgctcacattctcttttgacaaaactcagtcacatggtcccaatatatcttcgaggtggctgagtaatgttatcttcctatgtgtcaagcagaggaaataatgtagtgaagacacaggatggtctctgaaatatcatctcaggcatgaaagtagagcatattcacttgagtgagcctccagtggtgtgaagttgatggcaggagaaagagctggggaagaaaaggccagtggcaggtctcccctcctagccctatgcagccccacagtgggacccttgcatggacctcaaccatcagaatcttttcttttgcaggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacggtcagtgaataacagaccacaggggtggaaggtctaacccaagaggcagcccccccagtgtgagtggcaagggatcagcaggatggaaatagtcccaatcccaggggaagaacaggagacacagcagaaacacagacatgtccacatcccacccaccccacagcacaggtgctccccgcttccccatcaattgccccatcctcatcccaggcctcaggtcacacaggaagtgatggcagagtcacttcctatccaggcacctatgacctctcacctccacaccccacccatcggaggctgatacccccgtgagaaggcatcagactcacccctgtccagggaggttgcctggagagtgagccactctcaaagtcactcagacctgggctcacctggtggttctgccagtcctagctgttgacagtgaaacgttcccaaaatatctggttgaaatctgcaaacattggagcactgagacctacctccaaacaagtctgtaatatttaactatgtctgttctatgaaggatgtcacagtctgtcctgatctcccttgcagctccatcacctagcacagggtacagccaatattggctcaattgaaatttgtggaatcaacagagaaaagcacccagcacacaccgtagcccatgctgggggctcaggaagtgctggattcaaaactgtgggctgttagagttccttggagccctaaagttcctccttaccatacgatgcagacccaggaagggccacctgcgctatggtcagaggagctggtggcagagcccgtgcagagatggtccctgtgcccccggcccagtgctctttctcctaaaccacactgccagccccaaggcagccaacctcaggtctggtgaactgctggtgttaaattatcatagagtgggtgtcaaaagatgggctactaagtacaaaaatgcccaaggtgctacatgggatctgaagattttcaaaaggaggcaagaaagagataggcagatgtttcaaggatgtggggtgggggaggtcttggtaaggaaaatggcccaggctgtgtgtcagcaataggagaggagggggcacaggtgatcagaaaagacactgggggaagcattgatggacaggaatagaaatggcaaagtggataattaagaggaaggaggatgaggagatgaacacagggtattagaaaataatagaaggcagggcttggtggctcactcttgtaatcccagcactttgggaggctgaggcaggcagatcacctaaggtcaggagttcgagaccagcccggccaacatggtgaaaccctgtctctactaataatacaaaaatagcctggcatggtggcacacgtctgtggtcccagctactcaggaggctgaggcaggagaattgcttgaacccaggaggcagaggttacagtgagccaaaatcctaccattgcactacagcctgggtgacaagagtgaaacgttgtctaaaaacaaaaaacaaaaaacaaaaaaaggaaataatagtagctgacatttactgagcacttactttgtgccaggcccatctatgagcatatataatgctcagaatagccccctaaaacagtgctcttggcattgccatttcagaggtgaggaaatagaggcacagggagttgagtggctccagttcaggcaacacaccaggtgggggtggggggctggggagagacctgggacgtgagcccagacagcttgagagctttcagagtctatgccaacagcaccaaccagtgctgggtaaacacctgcttttatcatcagaacaaagaggctgtgtcccctgccctatgaggtccatttctgagagttgtggctaatgggcaagaaggttggggctttagagatttgggataaagatatcaaacaccagaaaggtagaaagaagtgatcagattagggttacttaggtgatgatatgaactcttcctagaactgagagaaaaagagagccttcctttactcatatgaaatcacaaataatttctatccaatttggaagtacactttggtgtagttgtgacagcttcctcaggactcagcataaattcaaacaaataattgtccttagaagagatgctatagaagagatagaaatatattcatattctgtagcttttttttttttgagatggagttttgctcttgtcacccaagctggagtgcagtgatgcaatctcagctcactgcaaactttgcctcctgggttcaagggattctcctgcctcagcctcccgataactgggactacaggctacaggcatgtgtcactactcctggttaattttttttttttttttaagactgagtcttgctctgtctttcaggctgatgtacaatggctccatctcggctcactacaacttctgtcccccaggttcaagcgattctcctgcctcagcctcatgagtagctgggattacaggcatgtgccagcacacccagcaaatttttgtatttttagtagagatgaggtcttaccatgttggccaggctggtctcaaactcctgacctcaggtgatcctttggcctcagcctccctaactgctgggattacaggcatgagccactgcgtccagcctaattttatatttttggtagagatggggtttcaccatattggccaggctggtctcgaactcatgacctaaggtgatccatcctcctcagcctctcaaagtgctgggattacaagtgtgagccactgggcctggtgcttttttttttttttttttttttttttttgagatagggtctcactctgtcacccaggctgaaatgcagtagtgtgattttggctcattgcagccttgacttcccaggctgaagtgatcctcccacctcagcctcctgagtagctggggctacaggcatgcaccaccatgctgcgctaatttttatattttttgtagtggtgggatttcgccatatcaccctggctggtctggaacccctgggctcaagcgatccactcgcttcagcttctcaaagtgctgggattacaggcatgagccacagcgcccaggctgtagctctcttaaggaggaacatatctcatctgagacaaacctgaaatgccaaaccaaactgagttagcccctctctgtctgttgtatatattggagtaataacctatttgtcttgataaagggattgcatgcttgaattgcaaaaacctttatttcttttgggttgcccaatgtgcaagactaagagttattttgataaatttctcaccaggctgactgtctctctgtggggtcgggggagttttcagggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaaggtactcactgcttcctgctccccagtactgagcccagaataaaagacgatctcaggctaggagctcaggcaacatcttagtccggtctcatctgttcctggatgtccctcagacccccagctttcatcttttaggatttattccttccctgggataatataatttgtggtccaaaaagaacatcatcaaaatttcaggcagaatgggccaggaaggccattctttcttgatgagtgtccccaaatcatctccaattaacagacaaggagcttgaggttagggaggtgagggtaacactgtctgtaagaggcagagctgggactcaaattccagatttcagattccaaatcccatcgttttttatctctacaatgatgcctcccatctgggtggtggagagaagggaggcgtgtaaaatgtcagccccagaaggacaagagcaagccagtgtgagcggaattgatggctgcaagctgagacttggattggagacgtagtgagactcaggattgtgcagtgctgcagggaagtggttgctggatagaggcatgggctgaaccaagcagctggactgagactgggggacagaactccaaagcccactgagatgtgggaaaacatggagaagcacacggagcattcacaacttattgccgtcagagtcaatacatgggtgaggtggggattgggcaagagggaaagcgtcagccttccctgatattctggaaagtctcccggggctgggggtgggcaggtacagagcttcgagctctgctgatcgctgacatccaggggtgggggtaggaagagacctgggccgggagaagtccacctcaagcctgcagtgtcacactctatccctccacagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttgcctagcat

SEQ ID NO: 37198 - DNA, 68115 bp, Homo sapiens
gttccggctcccgagccccgcctgcgcgcggcctcctcggcgcagccatcctcttggctgccgcgggcggcaaagcccacggcatctgccatttgtcattcagcccgtcggtaccgccccgagccttgatttagacacggctggggcgtgctctggcctcactctccgggcgggtgctggacggacggacggacggggcagccgtgctcacagctcagcagcgcggggccttggcgcgcggggcgcttccccgggtcgccgtcatggccgcggaggtggcacgcccgagcggcctcgcctgagctccgggggtcgtcgccccgcagggtaggtgtttgggtgctcgcggctgcggcgggcgggctgggggcagcggtggccgtgcattgccgcgctgcgaggacggcgctgggttcgcggccgcgaggagggtgtgcctttgccgcgccgcctacgtgcgggtccgggctccgcggggccgggtgcgggaccccgcagatcgtcacccgcaacccaggcagccccaccgcgagtgccgccggaccccctggacgccgctgccagaggcgttcgcgcctatctggtatgaggtccacagacccgattcttacaacctggcgctctaacctcgccaacgggccaggaaaaaaacagaacaaggaaaagaagaaaaagtctgttccaagtaataatgggactagacagtaactgtttgcactttcgtctcttatggaaaatatgattattttgatgctttagtattacagactgtatcagacatactcttaaaagtatttaaaaacgtggggtcctaaaaatttcctagatcgggacagctgataatgcgacttctgttagtctccgcatccaactttcagggcggaatggggatttctaccttttactgaatatactcctgtaattttgaatattttttctcatcaaatgtgttactttcatgttttaggaaaccaataaaaatcaaaaatagaaacacccagcttaggtcctccttcttccaggaatcctcctctaacccctccctcccaggcaggatcggaggcccctcccgggtgctttctggggcctcactgaggtcctggtcccctaagtcctcccccgcagcccctccgcgtattaacccaccggtctcgctgggctcagagattgcttacttagcacatggtaagtgattaatactgtttaatgaccgagggaaaagataaaatgttctctgatgtttcacgcttttcgctctgaagttaaatagtggtaaatttatatgcgcttagataagaacatttaacagttaaggatctggaaaagttgacgacgtccgatgtccgtgtttcctgatccagcagttgcacgcctgggtattcatccttaagaacaatgtttttcagaatttgaagtccattttagtgggtcgtaaagtcatttaaatggatgatcagaatttgtaaaacacagacggagaatagaacatcagtgtctctcaggtcataggggtgttcgctttatgaatctctctccccctcctcagtttcatacatacacaaatgtgtgtcatgatgtaaaacgtcattccttagtatgagtcatggacaaaaaagtttgaaagccactgccctagataaattttaatacatgtccacaagcagacgtgtacaagaaggttgactgtaatggcagaaaactggatgccgccttcatgcctacctgaaggagaaagataaattatacaccactcataaaaagggcacactgtacagtggccaatgaagtatttttgtgtttcaacacaaatgcctttcagtgttgaaccaaaaaaaaaaaaagttgccggagaatgctgtgtgatatcttctatgtaaaattcagaacctggtggagcaaagctgttgtttagggatgcatgtataggcattaaaagtagtaaagaaaaaaagtcaagctaatggtcatctcctagtggggaggagagggtcaggggctcagagatgctggaaatgctttatcgcctgacctgtgcaatggttacatgggtgtttgctttgtaactctttgttaaatgatacacactgggtttgaatgttacatttccccccaaatatgttaaaatatgggtgttgcaaactgaagaagcctgagtctagggctctccgtctgttattcttatttcctggcttctttttagaaaaaaaaaatcttgctcagggaggagtacctagggaatttatcagtaatgttttatttcataaattccatggtggacataccagtattcattaaattattctttatgtattcttataacttaatttataatatttcaaaaagcatttaggagaaaacatcatttggtgtgtttgctttcccaaaagtcacatttacatgttttgtacacaactggaatattttatatagtaattttagctaaaatcaaattttgttatgaaaaacgaaatactaaaaagtatataaaaatcacagaactttacagactttcagcgttttaaaatgctaacatattgtatttacctcaataatttctgttcctcagttctttcaggccacatttttagtgctcaatagcctcatatgactttaatattttattatattttattatgttatatattttacattatacattatagaacagaatatttccatcattgcagaaatttatattggaaaacattctggatacaaatatttgttatatacttgcagatattaaactgtagacattaatccttatgctttttgtcttaagatactctactattaatgaaatgtattctgaatatttttctaagaatttttaagtttatgttttgtccacattttgttctttaatttacctgagacatgtatatattgagatgtatatattttatgttatgagatcaagcttaattaattttcagattcccacatgaaaaggtaattgtcccaatatcagtgattagcagtgccacttctgtcacatacagtacccagatatgtttgggcttatttccaggctgttaatcctggtttatttgtcatttgaaaatactgcagattttcatttactgctgctttctatgtagtatattgttcagttctaagaatttaagattttttcattgtgatattttttcttcccctaagagatttgtagaaagtagtctagttccaatgtggaaggttttgtgagttatccttttgttactgatttctaatttgcactgtagttagcatacgtgtcaaggccaacaattctttgaaattcgagaattgctttatggttttaactgctccttgtatcatcaagaataatttgtactcacagacttttgaggcaatgtatgtaggtgtgtgtatatatataatatatacacatacactttatatatagattatatataatctctctgtagagtttatataaaaattaaatatatttatataaatgtatatatatatatgaataaaatctcctgtctctaaggtttatgtttcattaattcaggaaagttttgtcttttatctctttattttcacacatttttgtcctattctttaggagctatgattagacttctgttagacttcctcactctatcacccacatcttttaaggtagatttaatgtatttaatatattttttatccatgttgaattctacatatgttttttagttctataatttatgtacaacaaaaaaaagtgtgtagcttggtgaaatttacatatgtgtatacctttgtgattactacccagataaacatataaaacattttcattccttctgccccttcctatcaatggagccactcgcttcccccagtcaactactgtcccgatttctatgaccatgtattattttcaaatgtttttaaacttcatataaacggagtcatacagtttattcttttgttcacattgtattcatccatgttgcatgtataagaatttttgtttgttttttatttttgctttgtatcaagggttggcaaactatggcctgtgggccaattccaacccactgcatgtttctgtttataaaattttattgggctgtgttccatggctcctgtctataattccagccagtcaagaggctgaggcaggagaatctcttgagctcaggagttcgagcttacagtgaactacgatcatgccactgcactgcagcctgggtgacagtgagatgaccccatcttaaaaaaaaaaaaaattactggaacatagttatccccatttggcagagttgagtagttgttatagaggccatatggcccacaaagcctaaactatttaccacgtggccatttacagaaaaaaatttattgacacctcttctacggtattacattatgtggatatataatatgagcaatttacttattcattttcttgtcgattaacatttgagttgttttcattgttgggccattaagaattgaattgtgaggaatgttcttccaacttccgttggtagacatatatctctcagctatataccaaggagttgaattgatggtttttggtaggttggttgcatttccataaacactaataatgttgaacatcttaaaatatcttaatcagctatttagatttcctttatcacctgcctattgaaatattttgcccattttttaaaaattaggttacctttttgttaatgatttttagttcctaatataatctggatagggaatctttcttgggtatatgtttgcaggaattttctaccctgaagtttgcctatttattctcttttttttttttttttgagatggagtctcactttatcacccaggctggagtgcagtggcacgacctcggctcactgcaaactccgcctcccaggttcatgccattctcctgcctcagcctcccgagtagctgggactacaggcacccaccactatgcctggataattttttgtatttttagtacagacggggtttcaccgcgttggccaggatggtcttgatctcctgacctcgtgatccacccgccttggcctcccaaagtgctgggattacaggtgtgagccaccgcgcccagcccactctcaagattttgaagacatttgcctttgttttcctccagaaactttatagttttagctgttggatctgtgattatcaccagttgatttttgtgtatggtgtgagggggggatcaagatttattttgtatatggacatccatctactctacacatttattgaaaaaaacaacacctttcttttcccattgaattgcgtggggactttgttaataaatgaatggtcatatatttgggtctgtttctggactctgttctttccacttggactaattatccattcttgcatcagtaccatacttttttaattactgtagtttatggtaagtcttgacatggtattgtaaaccctccagttttgttcttttaaacaaatgttttgactatttaagtgctttacatttccatataaattttcaaatgtgcttgtcaatgtccattaaaaaaaaaaaaaaaagcctaccagaattttgattgggattgcattgactctacagagcaactttgggaaagtgaacattttaacagaattgagtctttcccttcattgcataagttcttctacagttactttcaacattgttttgtatattcagtatagaggacttacacattgttcaatttatttctagacatttaatgtttttttgatgctgttgtaagtggtggagttttttttttcccccagttttattttccaaacatcttgcctagtgtatggaaacaaaatttatttttatatattgatcttgtattttgtgcgcttgctaaattcacttatagttttggcagtatgcagatttgtttttgtttttgtttttgtttttaatgtgctgtcatgccatctggaaaaaaaatggtttaaatatgcctttacaattctattctctttttcgccttttcttgccttattgcactggctgggacctctagaacaatatttaacagaagtattaacaaaggatatccttgccttttcctcatcttaaggggagaatacctcaatatttcactattaagggtgatgtttactgtactttttttgtagatgttctttaccagattgaggaaattttcttctgtttctagttcactgagaattgctttcgcaaatgagtattgaattttcaaattcattttattctgaaataattttaaatttacaagaattgcaaagatagtgcagtgtttttgtatacccttcacccagcttcctctcatgttaacatcttacataacccttgtaaagtaccaaagttaagaaattaacattggcacaatagtattaatgaaactatacactttattcagattaccacagttttccctctaatgttctttttttttaatttcaggatccaccccatataccacatggtgtttagttttcatgcctccctcgtttactccaatctgtgacagtttctcagtctttcatatcttgtcacttttgaagagtactggttatgtgttttgtaaaatgcatctcaatttggatttatctgatgttttctcacaattagactgagattatggattttgagagaagaatatcgcagagctgttgtgcccttctcattgtatcacatatggcagcatatgatagccacatcaactgatgataactttgatcacatggcaagatggtgtctggcaaggtttcttattgtaatgttactttttccccctttccatggtctatttgttaggagaaagtccacagtcaaaggaagggagggatatcaaataatttgtggtcatatgttaaaaccaccacagtgattaataaatatttttgaggtagtacaaatattctatttctctttaaagttttgtccaataattttagtgttcaatggatcttgcctgcagcaattattattgtggtattctaatggtgattttccatttccttccttctttctacatttattaatagaaattcttctctaagaaagattggtcccttttttcccattgatttattattgagtcagttatttatatccatgtatattgatggatatttatttagtctttgagctattatctaataccatttttatattgcttaaattgttccagctttggcattgggattttttcaggttggtacttttgtccttttgaaatgtccccattaaaaatttttatttttttttttttatcatttccttactgtctggcactatgagatgctccaggctcatttagtattttcccttccccaaccttagaatcagccatttctccaaaatgtcttgattccttttattggaggatggtattagaaaccaaaatctgtgtgctaggtgtccttgcttctattgagatgatactgtttcttggccctctgtggacagagctaggagttatatgtacgtatactctatttttaattttgtcaaatgctttttctgcatctattgagattatgacttttcttagtttgatgacatgaagaattacaaatatctgacattttaaaggatgtttttccagtatttcttagaactttgcaagtattaaaaggtttgttttagaatgtctagctctccatatttcctgaacaaatcttcctaagataactctaatgattttgatatgtcatagagcagaagccttcttttgtttttctgctgaattgtttggcaattttagacctttcccattccatatgagttttagtacctgtttatgaagtttcttgaaaagtcctgttgggatttttatagaaatggctttgaatttatagatcaatatgagaagaatgggtatatttgcaatactcaattttttcatttatctcacatgtcctttttgtgtccttcaatgatatgatataaataaaggacttgtacatattttgttacatttatttctagatcctgatgatttttgttgctactgtgaatagtttctcttagtttcttattttctaaccagctagttactacttcataaataacattatatttccatttacataaatacataatttgcaagaaatgatttttttcttttccttctgatcttcaaatctcttattcttttgtttatgtctaatttcactggctaggacaaccagtacaatgaagaatagtggtactgatcatgggcattcttattttgcttctgacttacataagaatgcttttgtagcactgaagcttagtgtgatgttgttgcgggatatttaaagttctcttcttctagttctctaagagttttatatcatgaattgtattggattttattaagtattttttctgaatctattggactgtgaagccagattgcttgcattcaattcctagttctgctcctctgctgccatgtagtataatcttgggcagttacttctctgtatctcaattttctcatctttaaatttaggtacaactgtctaccatataaggttgttgagaggattaaatgagttaatacataaaaaggggtaagaattgtgcttagccctaggaagtactcgtttttttcttcattacttagtgttaggttattttaatttaaattatcataataagtaaattaattactaaatcatcttgcactcgaaagtaaccttacacatatttattcacatgatttggatttaatttactgttttaattttttcatgtaatattcatgagtcataaagtgactgttcttttgctatagcaaagaatgatggattcctagaacaacattacacaagagcttagcaactgaggtggcaacattcccaactttctggagcgatttatatctgagtcttttgataagctggagatagagatagctcttgcatgagcaaattcagaacttggcatattgtggaaaatggtcactaaacaaaaaggaaaagtgattttagcttttctgcgtgttttatattgcatcattaatacattgtattatttgtgtatggagatttccatatttggaatatttggagagtcattcaccaatgatgtactgagcactttctatgtgccaggcaatgtgttttgttggcttgggggcttatgtttgctctcgaggaacttaggggtcaattaggatcaatcctgaagttgaaggcaggcctatttatatcattcagggaaactcagtgatcattttttttaaattaataaaattgaactttctcttccatttgcattctgaaatacaggaaaaaaatttgaactttctaatatctttccttcctgcttctttcactcccctcagcaccttggtttaggcccttgtcaccctatgctatttttccctgtattgacttttcttcccttcctatcatgtgtagtgaccactggggtcagttccctgaaaaagtcctttagtggcatcccaatacttacaagattcttggcttcttagcatgacaatggtccttttttttgtctggtcctaacttactttactggccttctccgatttctcaaaactaatccagtggcacaggtggtcctaaccacgcatcagcccctaaaggtttcactctcctgcttttgcagctgtgttcttatttgtgccatttcccctgccttaaatgttttctccccaactaattttcaaccattttttttcaagctctgttcagagaatactcactctacaaccctactagctacatagaaaccctataatttataatctatagcccttgttaaattcttacctttcgtcaccaatctttatatctaaatgtcttttccagatggtcaggttcttagatagggttcaagtggctgacatgatactttgcatacaaagagctattgccaaatagctaccactactaagtacctactataattgtgctacaattttgcaaagtaagtattattatctcttttaaattgtgaagaaacttagtatcaaagagattaggaaactttcctaacaccatatagttagtaagtggcaaaactggtttgtctgaatcaaagctcttgctctttcttctatgccatactgcccttgtgctaaaaatgaagaaataattaaataaaattatgaacagaagcatttatggtaaaacacacactgaaaatgacatacacagtgaaagctttgctttcattgccaatatactatagaatcttcactttggtgaccatgatagttgctatggattaactggtgtactcctattttctttggactttccttccaagtttttgttgatactaatgaataaggtttgaatattctaattttggcttatttgggggtaagaaaaactgtaaagtttagccacactttgcttggtgtttgttttattttaagtagaaaattttacatttgcctaataacctttgctgggcaatggataaggtaaaaagagtctaattatctttcataaagtactttttctctgcttctgttgaggcctaaaatacatggggaagaaaaacatatgaaatctgccattcttaagtatatagcttgatgagtttatacacacacacacatacgcacacctgtgtaaccacattcaagagcaagctagacaatattacatccatcgaggataaaattctctcatttacctcctggtcaacacctcccctatggatcacactcttctgatgtccatcactgtagattagttttatctattccttccccgccagccccctccgccccaagatggtatctcactctgccacccaggctggagtgtgattgcatgatgacaggatgacagttcacagcagcctcaacctcccaggctcaagcgatcctcccacctgagcctccctgttttgtctattcttgaattttaagtataaccaaacaggatgtactcttttgtgtctggcttttattcagcgtaaattttttagagtcatctgtgttgatgcatctatcaataggtagttctttttgtattttttctgagtaggactccattaccacaatttgtttatccattttgtaaatagctatgtgggtgtgttctagtttgggttcttacaaatagacctgctgtgaatactcattcacaagtcttttggtggacatttgcagtattttgccaaggaacaaatctgagactagaattgttaggccataggggagccaaacagtttacaaaactgaatgcatatgtgtacacttttgctagcaatagagttgtagttggagtgcacattttcatcagcacttgatattagtctttttcgctttaagccctctggtgggtttgaggtgatatctcatggcttcatggtctcatggttttcatgtgcatttccttgatgatttcatgacttttctatgtatcttttaatgctgtcttttggtgtcttaatgaaatccagtttatcgggtttttagtggtttgtcttttgtcctgtttaagaaatctttgtctatccctcaatcatgaagatatcaattttatttttacatttagatctgtgacccattccatcatctatctcaaattaatttctgtatgatgtgagataagggtcaaggttaatttttttcaggatcgagatttaattgctctagaatcttttgaggaatttttctttccctccattgaattgcatggtgcccttgttgaaaatcaagtgcctgagtatgtgtgtctgtttttgaactctaagttctatatccttgttctgttcgtctacctcatgatcgaagatggctagccaagttctagctatgatgtctgtatttcagtcagaaaaaaaaaaaaaaaaaagggaataaataagactctgctcctgcttcaaggacaattcccagaatttgcacatgacatttctgcctacatcttgtcagtaacgtgacaacctttatcttcaagggacattggaaaatgttttcattctggggagtcatgtgcccatttaaaattcagagattatattacaaagaaagaaaggaagaatggatatcagagaaaattggcagtctttgccatactttctgtttacaagcgctttgtaggtgcttaataaacgttcatttgattcaatttcatctacttctcattgaagccttcttggtcaacttttgcttgtaatcatacatgcagacatcgcagctctgtgataggattctcccagatccacctaataagaagcgtgccctgtagtaatggggtcagctacttcctagtgagagaaatgtccagaccttgttaaagttctctcaaatcaccccatgtttcttctttatgtgacaccattgtgatcataacagttcagagaaaatgagaccctaaatcaagaaaatttaaagcacgatgtggctcagcaggtcacaaaatagagtggacgatggtgggagggtgaccaggttaaaccgtttttggttttggttgagctcctgaccatcctttatccttgatatttttggaaaaaagattagaggtctagatttcagttcttctctttgctttaactttatggctggccaccattaatatagccagtaatgtaggtattttatggaaatacttattattactgggctttgaaacaaaaacctctgttttataattaagatttgagcccatcaagtgttaaattttctctttcatccctggaaaatatattatgaaacatgtagaaagggtgatctttcttcctttagtcttcaggaaaaaaaaaatccttatatttcagatttgaaacattttatataagcatatatatcataatagtgtttgaattttaagtggtatgagtatcttatgacagtatagcttttaaagctatttaacttagaaaacattcataaatttattcaacaaatatttataggaggtaaacataatttcaaactttgactaaaatggttcgcacctaaatacaaagtatagaaatctgtttaaattatgtagtttagaatcatgtttccttggcttaacttattcctcaaattagtttaacatttatcccctttccaaagcaaagcaaaaaaacccccaaaaaaccataacaacaaaacaacaaaagccaaaaattatgcatcatttattgaatgatatgaaaagggtagcttgatacgtgcatacaaataatctgcataatactgaagtttaagctttttattaattaactttaaggataaattgaaagggaccttgctttattgtgaatattttctgtgttgaccacttgttgtgaatcattttatttaattgttccaacaacctgagaatagttttatctcctttgtacaaataagaaaattttggctgagaaagaatgaagcctttcccaatatcagacagttaataagtaatacagcaagcatttgacctctgattacttggattctgagcacagggtgcctgctctttgtgatggttctatcttattgtctcttaattgttcccattagatgatgacaagatagaggcatcactgagagatgtgacatagtccaattacctccgtgagttcagaaaatctgaaattaatgcaaatttgctaagagcaaacacatcagaaactgacatgtattataatgagaattttaattggattaaagccccactcttaagacatcatttaaccttaattacctccctgatggccctatctccaaatacagtcacattagggtttgggttttcaacatttgaattttgaggacacatttgaatctgtaacagtggattttccagaaacgcaagcaggaataaaatgttgggaccgaatatgagctgctccagtggtcacactgctgtctctcatcatcttccatacatttttttgcgaataatagtagtatttataatgccattagtttcatttcgttcctacttgagatttcaagagctactgtgaagtagggctgccttgttaaatctgtccgcacttctgcagagtgtaaaatcagtgtcatacgctttaatggtaataccttgtcacattcagagatgtttaaaactgcaatctagaaaattgcttttaaacagcggaggaaagatgttcatattctcagatgacacagtgcagaacatgtggacatcccatgcactgtgaagtcttaaaatttacaatatataggaaaattcctcgtttttctgacacctttctgagattattaaaataatacagatccaaacctagtatttcccacattgtaagttataaatttcacgagtatactttagggagtccctggtccataacaattttgaaatccttcaaaacctggagagtaaaatgcttcttgattaggccctgattctaccttcttgttcatcattttcagaagtactggccttgcccctagggagttcttttctttttttttttttccttagccatatatgaagtgaacatttgagaatttgccctagttgggaactgagcaaacctttctatcctgcatatagagtactgggggccaaaggatcgttttaagacttcagctgatagtcttattcttttcggcagcacagtgctctccaaaatttggaagctttcttatctgtttgtctccagtcaattctgtgtgctagtaaacacagccctagaattttcttttgtcatgcatgagtcctggttttcagatttgctacattgatttgcattctcactcccatagctgtctttctggtcctaaaggaagttatcttgggactggctggcttctattggaaagctttacttttaatctgatctattctctcagtcattttatccacatgaaaagatttaacggatatattatctatccttgtcctgagacaatttagtttttttaaaaaaaagttttccttggctaatgatcttcaaagtcttacctttaactgttagtgtaggggtggagaagaagttagtttttgtagttgcaaaatctgaaatgtctgccgtctcctcactccctttcacttcctggaaaccggatagttcttttctaagctcagctctttcttgaaatactttgtcaaatgaagccaataataaccaatacacatgtcaattgtgtgtgtgtgtgtgtgtgtgtgtgtgtgtgtgtgtgttttgttttgttttttgtttttttgttttcagacagagtctagctctgtcacctaggctggagtgcagtggcgcgatcttggctcactgcaaactctgcctccctggtccaagcaattctcctgccccagcctcctgagtagctgggattacaggcacccaccacacccagctaatttttctatttttagtagaggtggggtttcactgtgttggccaggctggactcgaactcctgacctcatgatcctcccgccttggcctcccaaagtgctgggattacaagcgtgagccaccgcacccggccgttttctgtttttttctgtgtgtgtgtttgtttgtttgtttttttgagatggagtctcactcactctgtcacccaggctggagtgcggtggcaggatctcggctcactgcaacctccacctcccaggttcaagtgattcttctgcctcagcttcccgagtagctgggattacaggcacgcgccaccacacccagctaatttttgtgtttttagtagagatgaggtttcaccatgttggccaggctggtcttgaactcctgacctcaagtgatccacctgccttggcctcccaaggtgctatgagccacctcgcccaaccatatttcaattgttttttcttacctcttctcctagagctacaagtaaatttgacaggagatctgcctcctgaactagcagaggcaaatgttttaccagatatgttgccactgtataaaacacatcactatctttctggcccttgagatcactttccttgctacctgctgaccgctaaaccaaggtcatatattttaggtttttgctaaaacatcctacttctggtaccaatttctatgtagtcaggatgggctaacattatgttgtgctaacaagccatccccaaacctcagtggcttcattcaaaaacagtttattttttgcttacaataaacatccactgtggacttgcagaagactatgcttcacacagaaagactcaagcctgtgattgtaccacctttgtcattgtacactttctggaacacttggccttctcagccactgtggttcaaaaaaagaatattcaatggtttttcctcagtaatcaactttttattaaagtctagaactaatctcatgcccctcctaactatacgggggtagagttcaagccaggatataaatagaaacacttttaccatacatctaaatatttataagttataagttatgcagaccaactaagttcaaagctaaccaacgaagtccaaaatatatctttccttgaccactttacctcatatttcctggaaaaccatgtttgaatgtggactttttggagcctgtacctctagaacatggcactggagagcaagctggctactaggccctggcctgtcttcccttctcttaatgttctgggatcactctgcccactatgtccacatctcctgcaaacagacaccccttggccaccccttgggtctaggtactgcatataacagggcacagtctgcccttaaaaacacagatctaggaaagagcctgtgcagttcctggttagcaggcttgaagctctttggacaaggaatgccatggttctgggaaccaggagcatagcctaggagagggagtgtaggcctgggtgggcaccttccccttaggcctttggactcctcatgataaaggaaatggtgcagctagagaaaggccagaatggaacatggatcctaaggcagagctccactcacctgggttaagggcagtgctgagcgagtgcaatgtctgaatacctagaaaaccagacaggttatgggataagcacataactctgttccgcacctcatgctcaccaatttggcttccatggtagaactagggagggaagatgccctaatcaccaaaattcagtatcacggccccccagtgccatgttctagaggtacagactccaagaagtccacattcaaacatggttttccaggaaatatgaggtaaattggtcaaggaaagatatattttggacttggttggttagctttgaacttagttggtctgcataatttataacataaatatttagatgtatggtaaattaaaatcctcatcataaagttccattatgatatataagtcagtttctgaggtgtttcttcatagcaaatttgcatcagttctaggttttccaaccttgtggacataatgggacaatgtcacatctgtcagagtgatgcccctatcttgccatcatctaatggaaacaactaagaaacaatgaaatgcttattatctgtctgatgttgggaaaggttttattctttctccgccacaattttcttatttgtacaaaggggctaaagccacctattctcatgtggttggaacaattaaataattgacaccaagtggtcaacacagaaaacattcataggcaaagcaaggtcctttttctcaattaaaaataatgaaaaacaatgagatattctaaggaatgtgtctgatatataatgcagcggcatgacacaagggaggaaagaggggttgggtcccgggaagatgaagtctttaatatcctgaaaagagtgccttggggcagctctgggctcttgcatatcttgaagggaaggtacgtttttactatctcaacctagtaatctctcttgagcctcagtgtcctggtttttaaaatgaggataataagaattgctttgatgaccttgataaagatcttttgatagagtggtagagataagagcctggggaatgggttggaaagtgagtgggaggtaaggaaatggggattatctaagttttctgttcttttcagaagtttgtctgagaaagggtgggagtatagtgggaccaggaggtcaatgaaggttttgttctttaaaaattgaggaatatcagccgggcacgatggctcacacctgtaatccctgcactttgggaggccaaggcgggcggatcccgaggtcaggggatggagaccatcctggccaacatgttgaaaccccgtctctaataaaaatacaaaaattagctgggcatggtggcacatgcctgtaatcccagctacttgggaagctgaagcaagataatcgcttgaacccggtaggcggaggttgcagtgagctgagatcatgccactgcactccagtctggcaacagagcgagactccatctcaaaaaagaaaaaaaaaaaaattggggaatatcagagcatagtatgtgtcgatgacaagtatctttagtaaaaagggagaagataatgtataagaaattttgaatagagaggtggagttggcctctggttttagggagggtgcatcctcctgtggatatggggaagtttctgagtttagagatagaaggcagagatgccctatccaacagcttttgttttctcacagaagcattaagtagggatgttaacagagagatgttatgtgttaagtattaggagtggggaaggcaattggaagataggagagaaggtgtgaaatgaaatgaccaaagattagggaaatgttgcataattgttgggcagtttctagaacccaagtgaatttgagttggcagagttagagtgtatgtatgtttacccatggatacatatatggagagagaaagagagattgattacaaagaattgaccctgatgattatgaaggctgagaaatcccacagtcaactgtctgcaagctggagactcgggaaagctggtggtgtgattctggtccaaggctgaacgcctgagaagcagaggaaccaggggtataaatcccagtccaaggacaggaggagactgatgtcccagctcaggcaggcaggaagaaaagggggtgaattcctcctccttccacctttttgttctattcgggccctcagtggattggatgatgccagcccatatttgggagggtggtatgctccgaactccaccaacacaagtgttgatttcatccagaaatacctgcatggacgtagccagaaataatgtttaacctggcacttgtggcacagtcacgttgacacaattcactgtcatatcacactctccagggatgagaactcatctctgagtcctccctgcatttctactgtagtagcctttccactctattgtttctgtgcgtttttaatgtcccctggggcacccccagacacactgagctgcctatctgggctttccaagttatccctgaggtatgcattattatttggttagcgctgtgattacaaaagtgcataggttttgagtggtctactctgaatttttctccctctgttatttttggtgtgagattttgcagaccatgagttatttcaaacatacgtgacctgtcttcatgtctatgtaagggcattgcaatgaactgaatgtgtgtgtccccccaaaagccatgtgttgaaaccctaatcctaatgaaatggtatttgaaggtggggccttagggaagaaattgggccataagggtggagccctcaggaatgggattagtgcctttataagaaaaggacagagaactagctggcttttcttcctaccttgtgaggataggagagccagcagtagacagttggaggaggttcctcaccaaaacctgcccatgctggcaccatgatctcagacttctcccctccagaactgtgaaaaataaatgtgtcagccatccagtctatggcactttgttattacaacctgaactgaccaaggcaggcatggtcagtttttagaattttcaaatgctttcatgtaaaacaataaaggatatcatcttcctggcagataaatgcaattcaaaggaaagtgcccacagtagcccctgatgccaggtcttgcctttcagggaagatcttggtttcctcctccagaacctctgatgaagtggagccaacctaccattaactctgctgtgattgtactcatcactgccaagggcatttatgggatgttcgtgcatggctattatttgtaaactaagttatacagatatagtctttatcctctaagaatttaacaacttaaaaacagtgacataaacataaatgttacagctgaggtgatacacaaacttgaaaaatttagttaatcttgtaggatgttctagaatggtgaaccactgaggaaccatacaggtcataccgtacaccaccagatgactgtgtttagccgcagaggaagagtgatgttagtttaggcataatcgttattacttaccaagacttactggacaaacatcactgggaatggaaaagtgtttctcagtttttatcttatatgtatgggaaaagcttggcagacaagatagaaaggttattctaaataaacaatatgcttttagaaagatatgagaaacaagtcatgttaaacttcaaggaggctttgtatatgtatttccctgggagaagaattggagataaatgaggaattctgatttttcttcattcttagaacgttgacatctattttgtcccatgttttagacagagttttcagagaaaattaaggttaccatctgccttgtatttacttaagaagaccaggacacagtgttttcttgaaataataatgcttataaaagtcttaactctaggagccattgaaaagagagctgtatccaatgtcccctgagtctgtcacgctggcccagccacggacagctggcttcttggtgaagaagggcaaacaggcatcgtagggtggtgtctgaaaaggagagggtttccttcaccctgatcttttgcttacccacctttaagaaaatgtgagtttttactttgggaggccaaggtgggagaatctcttgggcccaggaattcaagactagcctgggcaatatagtgacaccttgtctctaccaaaaaaaaaaaaaaaaaaaaaaagccagtgtggtggcacatgccagatcttgcctttcagggaagatcttggtttcctcctccagaacctctgatgaagtagagccaacctgccattaactctgctgtgttcggaggctgaggtgggaggatcaattaagcccacgagatcaaggttgcagtgaaccttgatcacgtcaccacacttcagtctgggtgacagagaccctgtctctaaataaataaataaataaataaaagccttgagtaactgggggagattataaagctagttaaaatcaattaatagtgatttctagaaatctcgtaagatgtaagcattttaatttaaaggtttctttttagctaccttttaactgaaaatgtttttaatatatttcagtgttaacgaagtaatgaattaacttccctcccagaaagtcaagaataatagcatgtatcttcctgtggaagatgaacttcagagctccatttccctagttcctatgtataacttggttatacgcacaccaaaccatgctaataatgcattctcctcccctggctgcctcttgaacttagatcatccaggagacgtctgtaaaattagcactgtaaagaaagcctcgccagggtatttggggcagcatatcaatggcttattgagcaggcgccttttaagcactgttgaatgataggcaaaactgtcacagctatgcataaatgtgctgtgtagtttcacagaagagaatattagtcctcagtaataatgctatattattaagctaataaacctacagaaagtttgtcacaataggtgtctgtcaaattactataatctgaacatgatctttggagttttagatgtctctattggctgaagagcctaattttgaagcttttatctgttcaaaaatttcagttctcccatcatcatctctgctcaattgaatatgtctttttcaagagtaatcttgactatgtataaactgctgcctgtcaatccccaacgaatgttaagactatctttttagggctggtgaacagtttgttgctataatataaagtcttttctgcatgtcccaacctttgtttttggcaatttcctatgatttcatgcttgaataaaatactccttccattttacacatcattgctttggacattttccttgttgaattctggtatgttaaaatgaagcttaccaataattaggtgatttatttgtcatagcaatgaatgatgacatcaaaacatcttgactttatcatgggtttccttgagggatggtagagtctgggtgcccagagtctggtcccaggttccaggatttgccacttgctagttgtttgacttcaggcaacttgtaaacctcttggtgcctcaattttctcctgggccaaacagggtcaatgtgcatacatcaaaggtttggtaaaaggattaaatgatatatatatatatatatatatatatataattttatatatatataatttgatatatatgtgtatatatatcttttatatatatgtgtgtgtatacacacacacacacacacacataataatatataatatgtagcttggccgatggtaagcactcagaggtttcttgttagtaatatattgaaaatatggaatctgtgagtgcagacaacatttctgactcccttactttttgcgttttgatttttgaaatgagtgatctatgccatgctaacaatgagaaaaacttctccctggagaaggtattccttaaactaaacctttaatgcagaaaactaaaagtattcattcaagatttgacatataggaagtagtagtagtagtagtagacatagaactatggacaaggaatgaaatactttttgtaaatggctgttattattttagtgttaaaaatagatgtgcaatgggtcaggggcagaaagagattttggcaaaggaggtggtgtgtgattgtaaaagggcaacatgatggatccttgtgatggaactgttcaatattttgactagtggtagatatgtgagcctacacatgtgataaaactataaaacacactaatacaattaaatgggaaatcgcgatagactagtagatggtattaatataaacatatcggttgtgatattgtactgttgttttgtgaaatgttactattgtgggagactgagtaaagcctcttttaaaattgcatatgaacctacagtgatctcaaaattataattaacaaatgcatgtgcaaatattatacaaaactagtaatttttatttttgtttgcagattgttcctgcctgattcataaacatcgtgattggcttttgtaagctgatatttcagtttcttttatcctcttcccccaataccttgtcttctctaataacttgataatggttttttagagctcctagagcaaaaattggagcaaaacttttttgttatttggttcttaaattattttaaagtctgtctcactttttctggtactcttagataatagttattttgataatgatttttgaagtacatgtcttggcctaggggcatttgtttccttatagtgacttcttatcagagttatggttagtgggagcaaagggcagagctgaggttgtatatagatgcagacgtcctgttgggcattagtcttcctccaaaacatatttatgtatctttgtttttaaatagtctatgaagtgtcatttttacggaggagaattgaaatatactaaaccaattttaaatacatctttgagaagttattttctgagatggttttgtttttcatcatcttagcaggagaggagaatattgttacaaagtaacttaacaaggatttgcattctctgacagattctaagtctgtatcttgaatcttgttctagcaggttctgtttcacctcttttgaagccaccaagaagacacgcacctctaatacagtcttcccgatagtacctaccttggcatactcattccttaggatgttaactgatattatatggaaaatgagcatatggtcatttaaatttgggaaaaaagctgagttaaaatcaaattagacttgtttgtttccaacaagtgattatcgatggcctttggtctgtggtgtttctccagcatatttcaccatacaacccctacctcaccaaatataccattgaactggtgctccacagaaaagtttgagaaattttgctttagaatttaggaaactgatataaatgacagaattaattgtacatttttcagaatgatagtgaaagagaagaaggacatttgagcagaacgcaagttggaccataaaaggacagttggattagcttaaaacagctgacttggagttaggcctaaatcattattataaatatagttataagacaacataaaaatttaaaatctggaaagtaaaaatacatcattgttccttattccttgaagattcaggagctgtccttccctgtaagactaatgtgtcctaattcttggtgattttcaggcttcgtagagtcttaacagcctggcttctcggtttcttgatttcctctccttcaatgaccttgtcttccaaaccacattagcaactttctcccatagtcatactgtgggcctagtcattaataagaactgctctcactccatgatcttgagtcccagcaccccattctccatctgtcctcccactccaacacatttttaactccacctagacatacaacttttacactgcagcacacttccttcatatctcacatcctcccttactcaacgtcaatagcctaccctctcattaaaatcactcatccactcatcttctctgtccctcccctttgctttgttgtacttagccatctatatcccagtgcctttgtttgctgattccatgcctgcagcagtgcagctgaacgtagctggagaaagatacccagccatgctcaatttaaagcttacccttgtacttatattcttagtcccatctcctctcacctgctcaaggatatagctacagtagttgtcccttctctctcctgcatcatgcattcccacctccctgctttacttaaaaaaattatttaactcccattcctctctacttactaccccatttaatgtccctgcttccttttacacaatttctcagttctgtctgggcattccaccaaagttctcaagtgtcaccagcgaccttcatattgcaaactcaaccattaattctcagtctgtatcttccttgacctgtcagaagcactgaccccactgatcatgctgctctgtgaagtatgttcttctcttgtcttctgagtctgcacactttcccaactgccttcctattgcatgtgactactcttatctttcttgcagttacatcctcattgtcctgacctccaaacattggctgtccctgagcacagtctctgtacttgtcctctgtcgattctcactccctagctgctcccattcatttttatggctttaaatacatatatgctggcagctactaaattgtctccagtatggacctcttctctaaactccagattaaaatatccaattgctggatgtctaataggcatatcaaacctaacatgtctgcacctgagctcctgagttcttctctgttcccaaccaaacttccttcatcctaagtagccatttaccgagatgaggaagactcttcttccagttgcacaggccaggtgcctttgcagcatcctcatttcgtctctctcaccctctacacattcagctgtcaggagatactgtcagccccaccttccataaatccagaaggtgaccacttctccccagctcttctgctactgcactggtgcacgccttcatcatctctttataagagtagccttctaactggtctccctggtttcatactttctcccctagaattcactctccacacaacagcccgataaattatttaaaactgttaagtctgatcgtgttacttttctgctccagtgtctccagtccttcccatctcgcttacggaggcttatcatctcctatgtgctatgggtcccattacttctggcctaatcttttaccgcttcccttcactgactgctttagccataccagttttcttgtttctgcatcgagttttgcaattattgtacccagaaatagccacatgacttacatccttacctccttcagatcctccctaaattgtcatcctctcacccatgcctttttccctgaccagcctgttttaaattgacactgttttcactgctaaatctcttagcacttcctgtctcttcattacttttttttttaaaatcaccatctgatacatattttacttgagctttgttatgggatacagttaagctactagaaacaattaattcaaagataagcttaattcattggtgcgcttcacaagggtaggaatttttgcgtgttttgttcacagtggtgaatccccagcacctagaacaatgccaggaaaaacaaccactcaataaatgctggtttaatgaaaaagaaaaatcttaaaaaccaagtccaccatatatatcccacaaagataggaaagtgggattggggaaagggatgctatagtagtttgactttgcttattacacccttctctagttgctgactgatcatagaattgggtaaatggcttgagctgggacaatttattgtaaatataaagcactaaggcaaatataaaggattggaacttcgtactgagaggacctctgcttccagccatcttgtaataacaggaactggagttattctctcgcctaaaatagcctaacaaaccgacacacacaaaaagcccataaaacatatgaaacaaaggcattccgacattggacaagtggcacgagacagtgaaccctgagagaaggaaaaaacaaatgatttgccccaggctgcagtgcaggaaggcagaacccaaacacagcttatcctaggttgagatgatggagttaggaattctgggaggctgaggcagctagaatttgaaggacagagtaccagagaagagagagttagttacacagagagtgagctccagagatcttcagagggctctcctggaggcttcagccgagtgctgattagtgcatatgcataagagaactacccatggatgaggaaagaggcactgggaagaagaaagtagctcatataaggcagtgaagagtgtgtcccccccaccccacccccaccattcagagtggaaaaaccttgtatataagtgggattagatggtgtactcagaagactaatgcttcagcgatgaggcaaaattagccctagactagtctaatctgatcctgcctaaaaaatcttaaaagtaagccattcaagacaggtcataaaactgttttgtaaagggccagatggaaaatattttaggatatgtgggccatgtagtctctgttttaactactcacttctgcccttctagtgttaaaacagccataaacaatttgtaagcaaatgtatttacatgtatcagaatgtattccaataaaattttatttatagaaataggcagtggtccagatttggcctgtgggcctagtttgcagacacttggtttgaaggatcaaattgtttgaagtagcttaactgtatcccagaacaaagctcaaggatatttaaggaaatacaaaatatccagcacccattaataaagtatgcaatatgtagcattcagtcagaatttaccagatgtgcagagaagcaggaaaattcaacagtgaagagaaaactcaatcaatagaaacagacccagaagtgacacacatctaataagtggaggtactaaaataaattaaatagatttaataaggatattcaaatagttattgttactatgttccatatactcaagatggtagtggaaagcataaggtggttaagaaaagatggaagctataaaaagacctaaattgaacttctagacctctagacattttataaacacctgagttgaaaaatacactggataggattaaaatcccaaaatacactgcatagcaattatacaaaatgagatactgaatggaaaaaaaaaaaaaaaaactagaaaaaagtgaatagcacatcagtgagctgtgggacaacttgaaatgaccaaatatgtatgtaattggagtccccaaaggagggagaggacagaaaataaagatataatggctgaagccttgccaaatttgatgaaaacaataaatccacaaatctaagttaaataaatatcaagcaagcacaaaaacatgaagaaaactacaccaagggacaccgtaatcaaatagtttaaaaccagtagtaaagacagattttaaagcagagaagaaaaaactatacattcagaggaacaaacatgacagaaggcttcctgtcagaaggaatgtaatccagaagacagtggaaagacaccttccaagtagtgaaagctaaaactgttaatctagaaatctatagttgtgacaatatctttcaaaaaaggtgaaacatgcaagcactttctttggtaggaaaataacaggtgaaataaagactttttcagatgtactaaagctgaaagaattaatcaccagtagacccacagtgtaagaaatactaaaggaaatctttttttttaaactctcacatttattgtcagttgatttaataaagaaggaaaataatgccagatagcagtaaagagcaccagaaatggcaaccacctaggtaaataaatacatacgatgatgattattattaatattttttaaaagatggtttaaacaaaaatagcaaatggggtatataacatataaaagcaaaagttacaacaataattgcacaaaggtcaggtgaggaaaaatataactataaagtttttatactctacatgaactggtatatcccttggaagtacaccatggtaagttaaagatataactataaactctacagcaaccacgaagatatcaaaacatagttataagccaaaggagataaaactagagaaaaataatcaattcaaaagaagaaagaaaaggaacaaagaataattgaggcaattagacaacaaataacaagatcgtacatttcagcctaatcatgtcagtaagcatgttaagcataaatggtctaactgtcataattaaaaggcaaagaatgtcagatttaatacacatattggccagtctgaaggtaatgagttacctcaattgattgttcacagtcagatttaatacatacaaaacgctttgagaactaactatatgctgcctacaaaaaaatgcacttcatgtgtaaagacacaaatagattataagctaacggatgaaaaaaatatcatttttagcactgattttttaaaactgtggtgactgtattcatattagacaaagtagaaattagaacaaagaatattaccagggataaatagagttgtttcataatgataaagtggtgaactcatcaagaataaatgatcttaaatgtttatgcacctagtaaaataatttcagtatacatgggaagaaatagacaaattcacaattgtggtcagatttcagcacccttccttcaatagataatagatcaagtagttggaaaaccaagaaggctatagaagacttgaacagtgctatcaaccacattgacttaattggcgtttatagaacgctactcaacagcaaactgcacactttttccaagcatagccagaacatttttcaagatagaccatattctgggtgggaaaataagtcaattaattctgaaggatttaaatcatacaaagagtgttcactgaccataatggaattaaattagaaaggaatctggaaaaatatcttgtaactgaacatcacacttccaaataacccaggggcacatcctgagacattgaaaacatcttaacaaatttaaaagaatagaaaccatacaaaatactttctgagactacagaattaaactaaaagttaatactgaaaaaagtgctggaaattttccaaatatttggaaattaaacagtatgcttctaaataacccatggatcaaagaaaaatctcaagaaaaatgtttaaatatttttaattttaatgaaaatacagtttatgaaaccatgtgggatacagctgaaacagtgcttcaaaatttgtagcattaaatgatgtattagaaaagaaaaagaacctaaaatcaataacctcagtttccacctttggaaactagaaaaagagaaacaaattaaacctgcagtgagcagaagaaagtaaatactgaaaattagagcggaaatcaacaaagttgaaaacaggaaaacaatggagaaaatcaacaaaataaaaagctggttctttgaaaagatcagtaaaatgataaatctctagccaggcaaccaaggaaaaatgagtacaccaattgccaatattaggaatgaaagaggtgttattctgctaatcccatggataaaatacaggattagtaagagaatagtataaataagctctcactcacatatttgataaattagataaaatagactagttccttgaaatacacatataaacttaaaacagcttctagacagcagacccagatggttgtactggtgaattctaccagccagccagtgtgacacaaacgaaatcaatcagcaccaaaaagaaatgagctggccgggtgcagtggctcacacctataaccccagcacctttggaggccgagatgggtggatcactgaaagttgggagttcgagaccagcctggccaacatggtgaaactgtgtctctactaaaaatacaaaaattagcctggcatgatggtgggcgcctgtaatctcaggtatacagactatacctgtagtcccagctactcgggaggctgaggtggagaattgctttaacctgggaggtggaggttacagtgagccgagattgccctactgcaccccagtctgggcgattgagccagactccatctcaaaaaaaaaaaaaaaaaaaaagaagaagaagaagaaaaaaataaaaaaaaaagaagtgagctatcaagccatgaaaaggcatggaagaaaattaaatgtgtattactaaagtaaaagaagccagtctcaaaaggctgcatactatataatttcaactatatgacattttagaaaatgcaaaactagacagtaaaaagatcggcaaaacttctctgtatgatgttataatgatggagaactgtcataaattttttcaaacccatagaatgtacaacaccaagagtgaactctaaaccatggattctgggtgataatgatgtgtcaatggaagtttatcagttgtaacaaatgtaccactctagtgggggatgtcgataatggagaaggctaagtgtgttggggggggggaagggagtatatgggaaattgctgtaacaggctcaattttgctgtgaacataaacttctctaaaaagtagcctattttaaaaaaatcgaacaggaaattagaaaatattttgaactgaatgaaaatgaaaccatattttcaagtgactaagatgcaacttatagcaatgcttagacaggaatttgtagcactacatgtctatgttagaagagaagaatggtctcaaattaataactcatcagagattgtcataatcatcttcaaaatgtctgaacatctttcattaaaaaatgtgtttctttcatgttgtgagagaagatagaattaggggtggttacttacaaaaaggaacccggctcttaggatagaaacaattgtcatacttcaccagctctaggctgagtttctttagcaagacatattcctttagatattcataagagttcttttaaactgtttctgatataaatggtaatgaagaaaatattttaaaatattaacaggaagtaaattgcacatttcaagtgatgtgttgtatagtaggtaatgcaatataagaataagcagtaattttaaaagtcacagaactgtagaatgagaaggtgccttaggtattgatattattaagtcaaacaagagtggcttcagctcctgcctctttaatatcaaggccttggatgaaatttttaaaaggaggtgaggacatccatttaggttttcaagtgaacaaaaagcagtataaggagaactaaatcactaagtgagatattcagaattcaccaaaaaaaaaaaaaaaaagaaaagaaatctcaggctcaagggcgaccaggaatattccagaagtacgtctgtactagataaaaggttggataaatgtcaccttctctgcaaagccttttctggttctctcagtcttagtggcctctgtcttcccacagtattctgtacactctgtactgtggcatctctatgccaccgcccagtaatagggtgtcatgaaaaaatgagacaaggaataaaaaataaggtttgctgtttaccactggcagtcttctcttgtgctacataattaatctgttttctcttagtaatgtgagggtcaacgaagtaagatatgtgttagttctttgaaaacatgaaagcactatctacagacaacagatatccctgtgtgtatttttctcttcaagtggtaacagtctgtgaatttcttcttttaccaatacatttctactcgaaatggctaagtggcaagaagtaaagctgaattgtgcagaaaaaccacactgctgctttatagtagcaaggatttgcctcaattagccttttaaaacgacacttcaattagtgtttctgttttgtaaagtagcttctttctcttttataatagtttgatcttggttcattagttgtcccccataaaatcctagatttgaaggctaaacttttaatgcaaggaatcatgcaatctagagactgaatgttaaattttatgtctttttctttaaaagaaatttttccttttaacaagtttacactgttttgattttcagcattgataatagctataattattgatctttcactgtatgccaatgctgttttaggagctttatattagttatctaatttgatcctccacaaaccctgtgaggttattattcctcttttacaaatagggaaactaaggttccaaaaatattgttaattgcttaatttataaaattattacaaagtgacactaaaatttaaatacagatctgactccagagtccatactcttaagcaactacctcattgaatggaagtggtacaacccattggcctcaaaaactaggatgacttatttaatataaccttggtgagagaactccagtgaatgattatatccccagtacatggtagctggtgtaatggaaacagcatgagactcaaagatagaatacttgaatttaaagttttaactgctgattattagttctatgactttggcaagtcaatttacctctcttgagcctattatctcctcattcaaaaatagattaataaaaccatctctctcaggtggttgtggcagagatccaatggataatgtttctcagtgttttgtaaatgcttttgaaagatacgtaaatggattgataagtgtttttggtcatttgccaaagactttctttcagtagtatttttcctgagtgcttttaaaaaacaatttgatttatagaaatgtagcaagtttccagagaacctctactgagttacagggtgatcattatataaggaagttctactcataagcctaggtttctttgatgagatacatagtttttgaggaatggttatttcatagtactgcgtcaaggaattcacagatatttctgtcgtgattttggaagagtgggaagacagaggggttaaatgtgtcccctaggcccaaagcaagtcaatgccagagttagctttaaggttcctaattaattgtcacaccatttttgtcacaagctacctttcctgtgcagttgagagttctgtatatgcaaagtccatttctgtcctaatttgaatataagggaatgtcttttctccttgagggctgttcagctctctatacaaaatagcatctttgacagtccaaggtgagtaattggtgaatagatggccctggaggtcactggtgacctcccccgcaaccccaccaccgagatcagtactgatgcctgtgggcacgtgggaaggttgtgttctgcctcaccgagtgggttcatacctttcgttccaatattgtttattttctttttggtttcacaattttgaaacttaacccatcgattcccatgtgtactcaggattagtgacaaatggaacggagcacaatgaaatgaaggcattttgttatagggttccatgaaggtgtgaaataagcaattcagaattcaatggtgaatttggaaacctcttagttatatttgttccgtgtaggtaaccagtcagagtaattcattttctttcatagtccctcttgctctctcctctctccttgactaaccatcctcaccccaacaaacacacaactcatttatacacaggagcttggattacccagtttgggtgattacctggatccaaaaaaacctgttatatctctgttcacacttttgttgtacaaacagaatttatgcaaactaactccatctttaagttgtgttgctttctctggagatcaccccttagggtaaccctagaaactgcagctctggagatcaccccttactaaggtaaccctagaaactgcagctctgaattcatcacgttgtagtagcttattgggtgtagccgactggctttagcacagcagtgaactaatagaggctgcgtgtatagccatcttcctctggctattagaacgaaccattcgattgagaataaagtttccatatagtttgggtacggtgacatgaaagaagttgcagattgttcagtgagactatcgcttgtagggttgtaggatggaggaagaaagggagagtgagagggagaagtttatttatggaatgtcagggggccattgaagctcagcaggccctagaagcagaggacttccccccgtgcttgttttctccctctgaccttggatgaactagcgagcagtatattatgctgggtgattgtgctggtttgtcatggttagcattctgaactgtcactggaatgtaggaaacggatgaatttgaattaaaccatgaggtggtctgctgagccctctccttgtctcaaggaaacctgtcgctgtttgtctgggctgggcctaatgaaagcaatggagggaaagagaggtgggcctttgatctctttgttgcagctgctccctgggaactcgctgaaatcaatgccctgttttcctgaaggaatgaatggctctgcctaactagctttgtgaagccgtggggaattcactgcctctgtttattgacagctgaaaaggagcacatggggtggaatggaccttcttgtgaaaaccaggcacagggaaaattagacctcaatttaacacagaggaattgggaaattcaccccaaaggagacgggagtttctcatgcttacattagaattactcaagtttggggctagtgtgtaatgaacaatggaggttttgtcacaactatgttataagtaggaatatggtctgcataataaatgatgttaagtagaagttgattctccacccgccctctttttttaaacacagaagtagagtaaaacaaatattaaccatgatacaatcaggtgattcttttatttttgccttgagaggaaagaaaacagtgatacagtaagcattattgatattatatgaaactctctaaaatccatctttcattcattatattttaaaacatctttgaacttggaagctacgttccactcaagccagtgattcatgccattctggattgtgtgtattgcatgggaatattacaataatatatttattttaaaatatttatattcttgggatattgtaactggaagtgtgtgtcaaacagaaactggctagcagaccaagattagcgcctgacattataatagttgataaatcttaaaattaccacctttttagaacacactaaagaaaaagtcttgagattatcacaaggaaacatctctgagataccttctttcacatctcccctcacttgcttgatttcccaggaagaatttatggcttcttcctttggcccccagccctttgtgtacacctctattatggcacttaacacatggccctgtagctctttatttaggtgtattcttttagctggaagtaaagcagctgtgttgtattcatttttatatctcaagcctagcagagctcttggctcggtaaatgcgagctgaatgaatggggattgatggctctgtctacattcctttgaaagtaattacttatcacagtttcaactgcaaatactaaattttgggagaacctgattggtctgctgttacctgattgttgctattgctttttaaaattcttcctctgcagagaactattatgcccttttttgctttagcaagtttgtcaggcagtccacagcctctagaaggaagcatcaccagtgtgtggcatttttcttttcagatccaagctctcttctctgttattctttcctaaaaataaaccacaacgtaatgtttagatatttccattaatgagatgaaaaaacttttcatttagaattttgtagacttttacttgaccgaatttagtgattgagatggataaggctgccattttacatgatttaattctatgatgtaatgttaaataatagcaaaagtcaaaacctcccttgacaatttctttaaccagatttactaccattgcatgttttgaattccttatcagaaaaggcaaacaaacagctttgcttcttagtgaaaagtctaagggaaattttgattctgaagcactgactagtctgatttcacagaacactgggacaaacccaatttcttagctattctcaacttataacctatttctttttaaagccagagctggaagtgggaaattgttgtcaacatttattgggaaaataacatcttaaaatcataatggaaatttttagaaagtgttgtaggagggagtaagtaagcagacaagtacaggaacgggctaatactttactctccatgttatttttgttttatgttcactaccaagattatttttaaggaaacttatttgcacttctgttttgattaatggtagaggtaaaatttaaaatagaggtttacacatttgtgaattgcgggaggaatctcgtagaggaaggggcatttgtatgggttgtacaaataacgtcgggtcagcgggatgtgattctgagattttagatttctcatgaaacagaaaaattaccatgactttgatcattggtagactctcaccctcataagtattaacttgaagataaaaaaaaaaagcattaagcatagcacttagatttcataacttggctgctcaaccctcccagtttctggaagtaattttgtgtgacataataccaaagtagggagaggcagagagtggagggaaatgtaggaaatcaaactgcacttttccatttgatgtttcagctttcagcagtgaggcatatctttgtctacattaataaaaaagaactacagacaggccagggaagtaactgcagttaaaaattgtggtcttgctatgcttatagaatcagataacttcaactatgtgattcttcagaaaagagcctttttcttcagactgaagactgctgtaatatccaagaagaagaatttcaagtaacttaagagaaaccctcaaaataggtttggggatggacatatgttatgtctctgtgtttacatgtgtgttaatctacgtaagctaacttcctagtagaaaaataccagatatttccctcttagacagtttcccgtccacccagactgaccaaataaagcagccctaataaacgtttatctagccgttgaaaacaagacatcctccttacccactagatttagttgcaagaaagctattctgaaatacagaactatctaaaattaaataatgtgtcagttgtataagatcagatatgactattataaagatcatctgtaataattagatacctaatcatttgtagttaatcatttgtatgttaatgaggttgttaaaatacttagtatattttcagtagtttaaatgtttactttgcaacattacatattgccttctttagtgagacatttttctgcaaggaaaaacctcaattcaggaggaaaaacccaaactcagcttatacctaaaagtttatgccttttgcattagtaagattcaaattgatatggtttcgttattttaaaaacacatacaacagcagcctttttggtcaaggcacaaatgtgggctactcagagaaggaggttacttagggttggtgctcaagtattcatccaattggattgcactgctaatcagtaatgaatttatatctgtggaggtgagggttgatgggtttaagttattgatctatttcctgtcttcattattttcactgaaagctatatttccatctcttttcagtctgtaaacattttgctgctgccctctcatcatttgctgtccagtttctgtccttttccttatctcaaggtgaatgattgggtctgcacagcaaattcttttctccaggcctctgctgataatagtggtcttgactttaaaaaaaaaaaattgaagttaagccaaagtggggtgtttttttcccccatattttgccttttagtggctttttcttccctccccctcttcaccctcatccctgctgaggttcttgtttcccttacccaaaggaatagtgttcttcttagttgacgctcttaaaaaggttctgacttaaaaaaaaaatttttttttttttggtagagattgagtcctgctatgttgcccaggctggtctcaaactcctgccctcaagcattcctcttgccttggcctctcaaaatgctgggattacaagtgtgagccactgtgcccagccatgagtattttgtaatttctgcttgaggctgtatttttacttggggtctctgaaaaataaatacaaatacatgaatactccctgcttaccagacagtgtcaagcatttatctcaaattagtttatttaattctcaaaagggtcttgtgatgtgggtgtaatcgttatctccattttacaggacaggaagctgaggtagagagagaaaaccaattgcatgaggtctctaagtggctccaggtggcaccaagattggaatctaagctttctggcaccatactgtggtcttaaccacatcactgtatagcctctctaaaactaaagatcccttaaggactcaaatgggtgcctctggaatgctgggatatggcattatagcatagcatgtcgatggagagagatttttgacccctggtatccttgaactcatattctgattaggtaaatgtcagcattcatagtaccaatgtgttttttcttgatgctttttttttttttaaacttttgatattgtttttcctttaggattgctgtcacgtctaatgtggctgctgcctcgtgtcacatctgaaactcatctgtacctcacttagaaaggtaaatacgtctatgcggaaccctccaactcctgccccccagtgctcctgccatcagtcatggctctgtattcttattctctcctcgcattacagcacaaaccagagccttcgcctcctccatggtagaggggcttatgtcccagaaaagactttgtgagagaatttacatttgaggaacttcaggccttgagggggaaaataaggttgggggattaagatgtggacttaatgaaagcctgtttttcactctaaaaattcaagaggacacgctaagaacgatcattgctatttatctgtcttaaattagaaatcatgggcattgtacagttgatttttacttatcatgacttgctcactagaaacttcgtgatctctttctgttatattttaaaaagatgtttttaaatggttttatcttaaagaaatattaggaaaaaaaaaactgaggtagggtccaccatttagaatcagatatctagaatgtaacgtatgttacaattcagagtctctaaaccactctcctaaaatcataatatgagatgattctcagcttgccaaattttctagagttgtgaaataggttatgtcactcaaccagtgtttatttgagggaattcatggttggcagggtccccattatacatcagaagtttttatttcttattttctatcactcatgtaaagattaggatttgtttgaactgcctatttcaagataatgattccaaatcccagccttaaatttcatatctaacatgtttgttgtttttccctgtcccatacattaattctaggttcaaggccatgtcaccctaaagcagccctcacttcttttgcagctgcagtgctgttgcttaaccataactcttggcctctctccagactgtttttttttttttttttttttgcaaaatgtccttgatggtcataatggtgtattttttaaaaattccagttgtttttgtaagttttcttatatcccatcttacattcaattccccctgcaaacctcccactagataaaccacttcccgctctattctttgtcttgagactgacttctaggaaggctgtccacagctgcctcaggccgaaggctaactaggagaatattaggtcgtgtgcttggattcctgttctccaaacgattctaattaaaactagtccactacccccaccaacacgttcagaaggaaaaaaatgtagcagaatccccaaatgccctcatcacttcattataccatttgggtagctttatggcacctgtaggactagttcatgccaggcccatttgtaactgttttctctagttaaacatgatattgccattaacagcacattaaataggattacactgcttaagaatctaggaatttctcaaatatatgagaaaatgtgaaagcacagggataatagaaatttattttataaacacatgctaggagatggaattgtgtcatgatgatccacattaaagaaacatgattgaagtgaatccattatttatactctgactttccattatatatatatattactccaaaagaagttattcatgtttcctaattgtgagcttacccatcgtgtaaaattggccctaacacttattcacaggccacatctacttcgtacatgtactttgcctctgtatgtacacgtgtaacgcataaccgtatatcagctctgcaagatacatagatatccccattttatggtgacggagactgaggcttagagaagttatgcaacttacctaaagttacacaccttccaagcagcagagccagcattcgaacttagacccatctgactccaaagccagtgccctctacactagaccacactgtctttcttaggttggatctaaaaaaatactaccagctggttggttttttaactaactgtaggaacacaacctagtattaagtagagtatgcatgctgcatagtggactgaggtagagtaaaacccattattgtaccacttttaggtaagaaaatgtattatctaaggaatatcattaaaatttccttacttccctccatgaacaaacaaaaaattaaaatgaaagcagtgggggatgaagggaggcggggatcataacataggagtgttaaatattaaaattagaaaagaaaataatttctctatcaatgtttaaaatgctagaaattatgcatgcttatactataacaaagaatactttatttggggaataacttaattgatccatgatgtggcatttaccaaggtaatttttccctttttgttccagcagtaggaattagaggtggttcataaaacacacaatcaccatgtaaattgaaaccgcattaagatcatagtcatcttatgttgtttccctaaaatggttctcatttgccccacatattcaaatcagagtgcacaaagatgttgtgctgagtcagggaagatttagaatgctctgtgaacagttttatactgaacttcagagttcagttattgtacttattttttggtgtgtgtgtgtgcacagttgggttttttgtttgttttgctatttgaattactgtttggccattttaatgtatataactgataaatccaggaggataatctgtatgtctgctctctcagtttctttctataacacaagcctgaacatattgctctcctgattaacaactttcagtggttctgattagacaagacttttcgttgcagtcgacagaaacctaatgggaccattgaagaattccaaacaggcaagtgacaggaacatatttgcatgttagaagaatcagcctggcagcagcattgtgattagaatgaaggggaaccgtccaaaaacagactggggaaccaatatggatctgcctctagcatgcggaaatatctctctacactgacctaactgactcactaagcttgtggtttgtttaaaggaagccacatgaaaattgagtttgggccaatagagtgaactcgttctccattctctagcatccctccccatgcaaccaccctatccctgccaagtttctgggcaccacagattggaaagtagcctcctgtaggtatttgcccatgttaagtggtggggtctctttctgtcttcccttcttggtctcacctgtctggtgtgacaagggaagcatgtgccaaccaaggctagacccttgtgagaccagagcagccccactttcggtaaagcaagcaacctctgcttacttgcccaacacaccctagcttccgtgttccttgccttgtgagttatcttcttgggtacaatttaacacagcgttcccacctccttataactaaaatagctagagggggctttgtgcctcaaaccccaaggagaccatcttggcaatctctgcctctgcaacagggcacttgctccctgggcaactcctttcccaggtcatcttctcccttgacatgcccatcagatttaatagtgtgcctatttggcagaaaaatggggtcccttggttgctgattcttaggaatgtgaggttctcccagccagagctctcagcactaaaagttctagtctctgcgtaatggccggcatatctttggcgtatctaaaatcctcttcagtttccagcagggtctttataagcttcttctgaaggtctcagacattcagccacggaactcaagtggaatttgtttggataacgtgactgatttcaaagcccggaccccttagacgtgcccatttggtgctgcaagtactgaccattactacaacatcttacagtcaacaaatttgacacattaaagatttatatcctttcttttgggttaggatcttctctcccctaaagcatctcagtttccagcatgcaatcatttccatcttatggaaatcagccatcccgctccgtgccagcatgctaccctgggaggcacatccaggcttgggaaacgggggtgtcctggatctcatgactccagcagcaccagctgctctctttcctcttccaagtagacttccgttccccccccacttgggtgtttttgtttgttttagcaattcagagctcaagataaagaccttaaagataactttgtgtgtctctccctttctaggtatttgcataggaatcagaggagttaatcttgtgagtatactctaacatctgcccttgtttccttccttccttctctatctgcctcaggggtttaaagcataagcctgctgccctccccgccaccccgcccctccaccctaggtcaccagagcgtatgcagagtccatggtcctctctctaacgaagcggtggccttttttgaaaactagattggctccagttccagcagttgtagctagtctatagcacagatgtgcactgttctaagattctgcactttattgaggtgccccacaagtctgcatttcacctcagagtgtcaactatgcaagaagcattactgttttcattccccataatgaaaacggactccagtccccattctgccaacctagaggaaaatttcatgtcagtaagatttaggtgcttccccttcccccatggagtgtgtcctaggacctggagattttcatggcctctggaagatgaggaacccacctctgaccttcagtttatcaaagtagtgatttattgaatccttgtagctgtctgccccagggccgccagtgagggctggaaacctcctgcctcaggtctggcctcccgaggcacactcttcacgtagctgtcttctcaaggattctactcattgccttagggaacagaggggtgccagggcctctattgctggggactgacatacctccttatcaggccctgggatggggggttggccatggggggatggaagggagagtgtcattttggcagcttctcctctgcttctccttctcgcctcccagaagtccagcagaatttcttctctgggtttagatattgttaacaaagacagacttcttcagaatgcttctgtcttcagctggatgaaaatacaagggattacaaagcctgccacctgttttaaatgagctagaaaggagaatcattgggaattcaaacaaagtaaaattctggagttgttgtgctatgctgatttggaggccctaataaaagcaaaacatcacccaaacagcaggtagctatgggaattaagagaaggaaatagatttgagagacaataaagttgtaaagcttaatctctgagaacaatctagactgcagagcttctaagtttggagaggctgggaagtgacatgggaagaggttgacttttgacacgcaccctggattctacagcaagcttaactgcttgctggctgtaggatcatgggcaaatcagcataacttctaagccttactttccccattaatcaaatagggttaatgctacctactcatgcggttgttgaaggtattaggtaaagttcttaaaacagtagccatcacctggtgaggatccgggagctctgatggctattgcatagcggtgccattagctagaacaggcagtgctggaggaggagcaagtctgtgggttaacgtttgaagccccaccatgtgaccttgaaggggcactgcaaggtatcccgagagctgcgggagggaggtagatgtattagtctggaatttgaaagaaagttcaggattgaagatagagatttgggaggcttctgacttcaaggagtaattgtaaccttgggttgtgcatggggtcccccagggagatcatgtattaatgtgagaaggtagaagaccagctgccaggcccacaaatctattccaacttccagcaaccccttcataccatgccccccagtgtcacctttaaaatgacatcattgcctggaggtgaatctgaatatcccactcaggcttcatttcaaagaaataatctcattgttcaccatgatccatcttgctgaaataagatttagttgtctgtaatctaccaaatcaggtgggctcctttccatctggaaaataaaataaaacatattcgagaggcttttcaaaaacaaaccttgtacatcttcagcctagaggattctttcactgaaaaccagggcagacttcccagtgtttgagggttgcccaattctttcccactcaaatcattagaaataaaaaagtcagtttggagaatttgcttaagtaaaaccaggagtcgctagaagtgaatgagctgaaactggaaggaaatccctttgttcaatgtgggtttcagtgaatgcccagcaggcggctaaaccagttcattaagagagaaaaagacgggttcttaaatgctgttctcagaagcaaatgcctagaaaaacatattgtgacagcaaaaacacatcctggaactcatacactctatgaaactttggtttttgtcatcaacgaataaacaaactttccaaaaaatatttcccccttcatttaaaacaattaactaatctgtttaccatctgccagtcttcactcccacaaaaatgtgattcttcttgttactctggaactcggaaacatttatctttaggattgtttaattttatagggtcatttttaaccacatacttaaaaaagaataattgacgtatgaaaacccttttttccctctgctttagaaatctaaattctgacctgaaaagcaatctgcaagtagcatcctgtcaaactgagatgtgttatttttcctgtctgttctctgctttattaaatcgtcatatactgcacatgattttccccccagaccaggcctgccttgggctctctgttgcattgttaactatttaagcattagactggcgcagagatggcaggtgggaaaagctgagggatttgatctcctccctgccagagttctcctctttcacgagtgctgcttacattgaacagcttaagaataagctcctgtgtgagcccttggaggccaaggagtattgttgaattcagaaaggaatcgctttctttttgtgataatttgaatattttgacaatgaagctaagctacttcactgcctggtttgcgtacctcacgttatgtgcaccctttcctgggaagcagaagaacccctgcctctttgaatacataaattggtattgtccgtttgtgagatgggtaggtgcaaaggaagaatcatccggaagaattttactcttttgctttaatgtctttttaaagctctttcaaaaaaaattttatacaagcctttggagaccacccaattaaaccagcacaataaatgttgagcattttgaggaaagagatggaccataaagatgatttgtaaagtgtttatacaagcaaaacaaggaatatgttggaaacaatttccctaaatgactcaggcaaataacctgctcacctccagtattttcctgtattgtgatgcattaacgttaaaaacagttgtcccaaaatggccttggtttttccatttttaacttaaaaggatgttctcatacaaaataaatggacatagcctttttgatcaaattcacagaagaaaataggcaagtgaataaatcacttaggcgagatataaattggctttgttccatagcagatttgcctttgtactagttaagaaaatcctgaaaagctttccctgtaagaggatcagttggttggaatagccttggtaggaagaagccaagtttgataattacttggtgaacggaaatgctggtttccaaatgctcatcagggttcagtggcacaaagctggctgtagacttggcttctgtagatttggtaaaaacgtaaattcctggggtcccagtgatgctgttttagtctgtactgatttgccctgtggccacccaggaatctgtatttttaaaagttttccatgctgattctaatgcatagccaggtttagtaaccatttaattcagtattcaacttagagacttcaaccttcttgcactgcaaatttgataaatctttgtttatatgaatctcctttgttgagtgccaactggttatttgctgactttctttcaattcagaatttgttttaggttctgttattgcatagatttgcatacctgttttatggtattttaatactgttggttttaaaaaataccatttcctctgagtgctgttctgaatatattatgtaagcaattttgtgtgttcttttttttccacttgcataaagcaggggaaaagttgagagtttttcttaatccagttgcaagtaggacaaaggatatgagtgtttaaagatcatctattaaaatgcatgaaaaaacactagaaaatctcctgtgcacatcgccagtcgtgtgtgtgctctagaagtgaagttcagggggtaacataatggaggaatgttttcctagcttcattccctgacgatgtacaaggtctcttctcacaggtttgaatcttcagacaaacttctgggaggactcggtccctgcctcgcagcagatgttccctgtcactcagtaggtgcgcatgttttaagattatttctagttgggcatgtttattaacgattgcttggaaacacatcataggcaagaacatgctggaggttcagggtacttcaaaaaggttctagtggaaaataaacacatttcctccacaaactgcagaatacccgagaacagggttcttttagccctttcattttttaaagctcagtgcacatgtgtttcagggaattggatgatgcagttagcaacttttcatgacctctgctgtcccacatccacagcctagtaatacacatagatctatggaattttctgctgacaaccctgtcagttcaaaagaagaaagctgcccctgccaacactcctaacttgtgtacataagatgtgtaagaggttgtcctgtctttgtggcagatgtcgactgaaagataagcctgggaaagatgctggtcgcatcccagccacatgaggcaatccagccatacttcctgaggctttatttgaaaacgctgttgtaaagcagttgctgaacttcactgctcatgtagacagtgtggctagaagggatggcaaagcgtaggttgaaagagcacttggcttagttcagaacacctgggagcaacctctgttcatcatcattatcatcatcaccagtaatgatattaatagaagctaatgcctttggggcactcactctgtgctaggcgttttgcttaggacagtgtattacttgcagtatgtcattagtccatgctgatgggcagtaaacttaaatcctctgagcctcagtttcctcatttgtgaaatggggacaatgatgcccttctacctatctcttagggctatgagatggaaattattggaatagcatgagagagctttatgagctcaactgaaatagtttattaaatagtattccgactcctactgaaatacaatattgtcactaaatatttggatttattgaccaagaaattgaaattaatcccaacagggccaacatatctactaggacctagcagttctagttagggctgggagttggggtggggtgggggagcgtcttgcctgtatcttctgtttacagtgtgcctgacattagaagactaggagtgctagccaggaagatcctggaatgtgtctgccgaagtattcagtggcgagtccatgggctgcgaacaggtggggtgtggctaacacagcaggccttgtctgtctcaggagctgaagggggccagccaaagcagggtggacagtatgattgcaaggcaagcaggggaggaagagccacttgagacattgctctcagctgctggggaggagctgcgagcaggcagcggtgggaaattgaggcttattgtgagcaaggtgccggcctccggggcgacggggagcgcagagcagcacatgaaagctgcctgcggatgagctgggggatggaccacacatgtggattgcaaggacagctactcagagagttcacattcctcccccattgaactgggtatgattgtaatggtttgttaaacaaacaaaggacctaaagctgtgaatgggagagaaaaaagacttaaggtgaaaaggagaagaggccctgcttgctagtgttccactctttttaagctttctcccccatttccttaacattcctttcccctttcagaaaagccagtgttgtcgcttggaaaacttgccttgtctcttcagtgccattttcttttaaaatggaaacctgatgaaatgttaatcagtttaaaaagaaaaaatcaagaatcaggataatcttaaaggaccagtgataaatatttttatttctcaaattaactattcctggatgaacaatttgctttgcatcctttgaatttattggacatgacatggaaaggcaaagagaaaattctcaagcttcttgaaataattgtgtctaataaagtacggcctgtgtcccgagaggcagacaggcatgcttctggaggaagtggagtgagcttgggaacaggtgcagcagcttcacttttctcacataaccatgcatgtacacagtttactataagttctggatatttctacatcgagcttgaaaagttactgcacgttactttaaaactgcccatcaaatttgtgtctagggtaatccgatttggtcttgggttcatctcatgtaaaaagaaccagttagcatttcagaacagtacctttcaatctgctgttctctccaggtaactgagttacccatgggggagggataagtgattatatgtaactttttcctctctgcaattcatctgtagatgggacatcctcactttcactggctcccagttccctgtaggataaacccagtgtcccctgccaggtgcactatccctgttattggttttctgacacaggcccctctcctgcccatcccagccaggctgcaccacgtgttccacattgccctatgctgcttcatgactccgagctcttctctgttctcccctctgcctctgcaatatgcctcctccatttgtcaaccgggtatactcctagactcagcctaagtagtcattatcaaactttagaaagtgcagatattcaaaaaataaacaatgaggtcatctataaatccagtgtcaagataccctgctcccatgtagttatctgtacttcaaggcctttttctgtttatttagtgatatgttattttaggatcaaacagtccacccaagtcttgagcatcctttctagatctcagatccttcaaggtcattccggtgattttcactcacaaaccaggcatcccatggtcaatgtaactaatatgcttttcacatttctcttctcaatgtgagcctatatcctcacacacttcctgagaaagaaagaggcttttctttcccttgaatgttaaccttattggaaaaataataggtcctgctgctaattagagttctggttcctccatgtcctacacttaagagtcccaggaaaagagatcaccgccatcagctatagaagcagaccctaaaagggcctaaaggcgagactcaagggtttctagggagtgaggagggggatgtattttcagctatcataaaggaatgatccccattcctgactgtaacaattagaaaatcttcccctaataccaaaggctcttgtctggattttgggagttgctctccacccctcacccccccaccagactcctgagagtcttcattcataaatagtcctcttcaaacaaggcagtcccatctcagcttgagaaccaggcctggacttaacccttgcctttctcaatgcacacatctattttacttgtagacatttgtctatttttttgtgactgtttctatttaaaaatacaatgcatatggtggggagaggtgaggaggcctgtcaaagatccaagagtctgcaacaatatttcttttcctccgttccccctggtgggtactatactggatgacccatctggaagaaggcctttggccctttcgtggggatcctggctgtcccagccccttgcttccgtgctatatggatgaggaaggccagtggtggaaggggccccagacctgtgagagatgaagcacttctggggtgacagatcccagctccctgctcatcagagtcatcccttcccccttggtagttcagcatctctcagtcctctgtggctctccaaggctcacattcattggcttttgccttttccatagcttctctggacttcttcctgtttcagttgagaacgttttattggcatcctctacctctaccacctcactccatctccatgtagatgcagtcaggggctaggcttgactcaataggttagatatcttcaatctgctaaatatagcaaagaaaagctcccatctataaaaagcctaccttcttctagtagaagagataaccaaaagatttttgttttgggtttgtttgtttgtttgtttattaggatcttgtttgtactatcaccatctagaagttatttaccaacatcaagtttttgaactcagacttaattctcattttgctcatttttatcaccataggcctatcagtagaccatcttatccaagaggagctggggggattttgaggcagaaggctgcttctgtctttggagctctgagaattccatgcccccacaaggctgcttccatccgggctacagtgcagagtagatgacctaagggagtctcagtctagctgcagcctgccataaagaaaacaaattcctccttacccccagggctagcccacttgaccaaaccactctaggaggaaaacattggtgatcaaggttgaacacgtgagtcactgacaggatatgaggccacccatggaaagctcagagtaacttataaaatcgcctgtataagttaggttcagaaaggcatccgcttccctagactagaagagctcctgagccactccacgcttcacgtctccttgctggcccgaatgcccattaggcaccattaagcccagcatgtctaaaaatgaactcctaacgcttattttttgctgagtttttcttctgggatgcagaagaaaacctctctctgccaccaccattccctctttcccctaacctcagtcctaatccagttattctgtttacagagtgtcactggaacctgccctctctccttgtgcaggcctgtgttctctcttctgagatctggcagaagcctaaatgatctcattatccagcccaccaccctccagcatgtcttatacgtccctgccagagttaccatcaaaaagtgaaatctggtggcaagtccactgcttctgatcggtccccattgcccagctccctggtggtgagcgcctgggtcgtcctttccccttggtagtttggttttgtcagttttctgtggccctttgaggctcacaatcacaggctgaggctttccccactgcctcttcccattcctcacagcattttattggcattctctacctatttctacctcttctcttcccgccctcctcactgcatctccacataaattcaagagtttgtggctggacttgactaaatagatcaatctgctaaaaacaatttatgacaaaaaagcccaccttccccttgtagagtggacccttcacgattctccatctctctagcctgttttctcctttgcccacatctgcacctgtattccagtcttactgaaccacttattctccaggtggttggattcattcccttggcctgaaatagaccacctccctcttgaacacgttgtaaacttctacgctagcttcaacttttacttctctgtgacacctttcttgatctcccaagcaagagatggtcactgcctagacaaccaccacctcaagttttagtaatgattttcacttctatttatctgttttcatgcatatgtcattatagagcaatgtaattgtattctgtccattcattcctgaggaaacacatctttgaatatatcctgtccatgattccagtcttgcatattgtctctttccctttggctgggcactagttacctgtctttattttctggctaatatgatggtatttaaactatatttctgtttgtggatatttagaaatgcagctgtttgtgtagtttgatttttataatcaaacaccttgccaggctttctaatcttgtgtgtggattctttgggattttctatatcgacattcctctgcaaataaataattattccattccaattttatgcctttcattagtttattgtcttactgtatcgtattatccatgacttctaatacatgaatgtttcatgcaagcaatgataataggtaactttgtcatgtgatgaagatagtatactctgttttgttagtttaaaaatcatctcctctcctttcatgtttcttggtgaaatgatacatattttaaccatttagtcaatgaatgttagtctctggattatattagctgagttataagaggctgcctcatggtgttgactctcagatgctctctgggttctcaagtgttccccttgcaagtttgactcaaatgcctgtcccagcccctggggtcttgcactgccactgcctttttgttggtgttgtcctctttaaaaaataatatcctgctcttcttttaaggacctctgttctctctaggatattaatgattattatttttgaagtttccttccccccgtagtctttttttccccgttactttttgtgtcagttttccctattaagtgccttcctctgatttctggtgatccttggcctactaatttgtgagtcaagccagtaaagagctgatgggagctttgtatacttaggtggggcttgtcagctggggccttgtatagggtaaggtggcgacccctggaggaaaccccctttgtccttatggtttgctcttttctcttgggctggtcagcttcccagggaagactcctccatcctcctgccctgagagagaggacattcaccctgtgtcaggctactcccccactttcatacagtctccatagcgagcacttgtgctaggggaaggaagggcaggcaccccactgcaggcatcaggagaggtcaggagggctcagtgcttcactaacagactttcacctgctgctttcatacctgtttccatcctcacttccagaagtacctactgtaccaaattgcagagacatatggtagatgcttcagggtatagcaggttgttttgttgcctcttaatgctggcttaaactttagctttcttaggatggccaagtcgatcactgcttgtttacctgcttttcagcttccaaaatttgttgttttctcccttttatattaggctgtgttttagaaaaatcccactattactgttttagtagaattttcagagagactggagctacatgcttttattcagttggccatctttaaccaaatattacactatttgtaaacagaacacaccctgtcccttttcagatgttctggctaggatgtggatttgatgttccaaagctgtagcataatcatctggacagctttctcaattttttccctgaatattagagaaataattcactttgtctttcttgtttatcttaagcctcatttcttagaaagtaagagcttagtcactgggttaacaaaattcagtctttcaaggtgacagctgaaaagaatctataggcaacaaacctgatggctcagcaggtggctctctcagagcagaatagaagggcaggtagtgcttcctacaatgaggataaactagagtgaaagctcttcaaacatattaaggtggagatctctactgggccattgagtaaacacctcaccgtgtggaggaggaactcgtgcctctgcctggcagtgacagagaaaagtagaagtttgccaggtagacaagggttcccaggacattccaggagggagaaagccagaagcgtgagagaaagtagcactttaaggaaacagcaagtggagtgatccttggccttgccttccggccatgatgggagtgaggtctgcagccatggcagccatgactacctggaggttctggatatcatctttctcctgatgacatttctaaatagcttttttaaatttgatagagactgctaccaaagtccttcaaagaactgatattgagaaaaacacccttgttggaagaccaaaagtggaaattcactttcctctcagaaatgggccttgcattgattgtgtcactgaggacaatggaaatagatgccagaagtcacagtttattttaagaatgttgtaaagcagttgtgccccattagatgatgtgttatgtagcactggagaagtcctggaactacagttgtgttctgactcccccctccaccctcgtatacccctgtcccctgggaacacagtctttcctggctgttaccatatatatatgttcttcttcccgtctgatcctctctcatccccaaaataatcaacatgagcagaacgaagcagatggcacaagccttctttggcatactggcagatctgtatcactcagtatttttagaatcaaggggactgaaaattatgtcctgagatgttttggggtaagacttactatctttctagggtgacaggtgttgaaatagcaccgtatttaagactcaaatgcaatttctatgtcaagtcacagaacagaatgactcgcatcaggaccattgctctgtaagttctgttaggatcgttggtggcctgccagataatagaaagttgtcataaattgttttaaggatgtggccagaaagtgcattgggtttcaaccaaagattggactcatcagtaaacagcctttgaactgatcaagtgcgtggtgatgagagatgttgtatatacccacagttgttgttgttgttgttgtcgttttttaatagctaagctttgaccctcagccacaaagcgtttatagtctgttggggtagacagtcttgtttttacagaagtttattattatatcatgaaaacaaatatttgtattctaaggcccatatggaagaaatacatagttacggtgattaaaaattatgaatttgagttcattaaggactctctgaagaaattaaagaatgttcactattatataactaacttagttctgaggaccaactttgcaattagtattaggctaggtatattaaacacacagacctggaactcaaagccttgggaaaagatattcatgaaataagcataaaaacgagagactttgtgttttagtctttgagggaaacttgaagttggaggaaatgtgcctcacctttaaaccatggccatgtctaatgctcagattgtcccattcatctttgagggctcaggggaaatgtaggcatgggtgatgtccatgactgctggccttttgaatcttgggaagaagtggctggaaagagatctggaaaacctcattcagtgccaaagggcaagtttttcaattgaataagctttatttttttctttgtactcctagtgtgtttggtaagcaatgagtcaaggtttacatctgctgagaaagaatgcaggcgttttacttgccacctcttgtgtcctttctacacgtgtgttgtccacactgccacttctttccagtataattgatatggtgtagtatccatagggagagaatgtgtctctttcccattacatccatagctaaatggttagaacatgagctgtacattgacacatggttctatagtacttttaattccagtgtttcataaatactgcctatttgtagggtgtttatttaggttacagtgtgctttcagatccattttgtctcagtcgattgtcccagcagcctgtttacatacatcaggtaactatcacaaatgaggaaactgaaactcgacacagataacatgggtaagttggaatttgaactggggaatctttccactggattcacagaacaagtgcctggatttatagcttcagggtaaacacctgaggctcaatcagtagcacagttgtgtccaaggaaagcacagccttgccttcctctcctttgatgggaataccaagagtctgcctgtgccgtccaggacagcagccactggcactatgtggcaatttaaattaaagttaaataaagtaaaagtttcagtttctcagaggcacattttgagtgctcagtagccatcacatctgtaacatttccatcattgcagaaagttctgttggacatgccagtcatctcataaagcaagaattggggagaatcaacttactgagataagttgagaaaagtgtatatgcagggtgttaagtaggtgagagaaatgtaaaaccttccccaacaaagcagctccttctctgaaggggcgagtgggacgagtgctattttgagttcagctataaagggaatgagaaaaagatgcattttcaaacttcatactctgtgtgtgttagtcttttttaataaacctagaaagaacacagagcaattctaagtgaatgagtgtgttttatagctgggccggtattatggccaaacttaggctgggtgagaagtagaacagatcatgatacctagcagagcaaactcggcaggcggaatagaattcctagaaggagttattttgtttgtgaccagggctgttgaggattcctcaagatagggcctcaggcatgaactagaatactggaagggaaccaggggttgggggaaaggggtttgggcagagccgggacaggtaattagttaaagtcacacataattgcagaggttgtgtgtgctgctagaatcacagccgtcacaaagaaggtgtggtgccaaggtgctggccgaggactcctgtgtgtcccctggtttggattagcgctgaccaaaagtgcccgagtcagctttcacgtttccaagtgggtgaggcaggatggtgaggggtatttgcttggtaccgcgaactctgtccagacactgaaaacatctacaacagaagatgaggaactctacaagtttcctggaatttttgctggttagaaaaggaatatgtgtttggttatgtccgtgtgctacataatgctatatttaaacatgtttaaactgttattacaataaagtttcatctagttagactcatactttctgatctgaaagtaaccaaaaaggtaagtaaaaattaacttttaacaataaagagcaactctagagacatggcaataaatgactgcaaggagcagggagggctttaaagactcactgcaattggtcagtttaccatgaagtgccctgcttactggcaaagttcagcaaatgctggcctgtggacaaaagctactcaagtgtacttcacctaagcatacagtactcttaatttttttaagtattggcacttgaaaggtgagcatttgcccacctgaaaatctctctctagaatagcacagggtggtagtgatccagggctttaccctggcaggtagtggcaggtagaggccgatttgaaacctgctgtcagagtccagggatgaaatgtggggggttggtccaggtcctgagagtgaagctaggaggagacatctccaagtgtaaatttttggaacacagtttctcagcttgggtggaaagccaccctagtaagtggagtattgttcatgatgcaggctcagacacttcaggttcctccaatgatggccaattggtagaaaaagaagaacctggtttttggtgactctggctgagtcagaaggatgataatgatttgggtttgagacaagttgggtttgaggaggcagtaggcccatctcctggaggtggcctaccagcaggtagctggatgggccctccagggtagggccagggaatgaagaaaggtccataaacaaaaaaggaagagattagtagaacttactagaggatggtgcctacaaatctgaacgtggcctgggctggttcctgagctatcagctttgtgccaccacatcagtgcaactagactagactagcttcatgcacattctgtttatatcagcccttctgcagagtaatcttacaaacaaattgacttaggtgtatacaaattatttcttatcctctggaagtttaaacaggtgtgataagcaactaatgttatgccaacaatgagtgatgaggaagagcccgtggtttgagtaagtgtgggtgatttttgtttatggaccagtaaaaacacttgaacacactgagggagggaggtttttgtttgttgttgttgttgttgttgttgttgtttttctctttggtcaatggagcttcacactgacctgaaatagataatactggatccgtggaaagaactctccttaccagagggaaagtgtgctccactggccatcagtgcttgactcctcaccctctgagaagccaaaagtgtagacttgtatgcagatggccctctcacatggagaactgtgttccatgagcaccatttaaaggaacgtgttgattgtgggtagttgattctgaagcggtcagggaggaaaagcattgttttcaaatggctaatgcaagaaaactgttcctcttctctccacagccaatccgggggacccaggacatgccccagctatagtgatgcagattacctttctgctcctgaatcgcacctgtgcctcagactttctcccctcagcttgagactgcatgtaaactgggatgtgtgaaagcaggaagcaaagctagtgacagctgagaggtccatgtctgggtagaaccaggcccacgatgctgcctctcccgtggtctggagttcagctgcagggactctgctgatgtgcccagcaccatcgttctgtttgtgcttaaatggcacagcatttggtcagcacatctgaaaaggaaggtgtgagaagcaaagcccatggccacgttcccctgccagttatgtggcaagacgttcctcaccctggagaagttcacgattcacaattattcccactccagggagcggccgtacaagtgtgtgcagcctgactgtggcaaagcctttgtttccagatataaattgatgaggtgagaggctttggcaaaggtatgcacttttagaagtacgtttaaatggcttttctagccctcagaccacacgatgcaaggggaaagggacacaggatatggatgcattttagcctttgagggattcttgaaatctgcatccagtgattcctgtggttttatgtgaccgtcttgttgtgcagtgtcagttcattctttcaacagagattttttatgcacctacaatataccaggcctctccccatggctggagaaataggaaaagacaattaaaatgcaacctcactgctttgacagagctatacaggtggtagaagttgttcttcactgcctgatgaaacctgggacggcttctcagatggggacaatctttaagctgtgacacaatgaaagaggaggaggcagagaggaggttctgggaaagccataagtcttggccttaaagcacccatgtgcagagggtactatccgaggaggagcagatgaggctaaaagtgcaggcaggaaggaagccacgtatagcaggccttacctctgtctgagagggtttgtctcattcaggtgtataagtagtgaagaaatatgattcgtttagtatcctagaaagaggactcagataataatttgaagaagtggcaggaaggctgatttgaaacctgctctcagagtccagggatgaaatgtgggggctgatccaggtcctgagagtaaagctaggaggagacatctccaagtttaaatgtttggaacacagtttctcaacttgggtggaaagccaccctagtaagtggagttcaggtgggtatgcagatgagcagcatgtgcatttgatcagttttaaaggcacccatgacacaccaaaggataaaaagcactgttttagcagatgagtctttttaaaaaattacatttagtctaagttatttattgagtgcctgttaggtacctacttccatgagggaaatgaatacattagatatcgtttctgccgccagtggatctttttaatatcacaggaaagactccatgtacatgcagtggctgtgctgcacggtactgggactggtaatgagcatggtgtgtgttgtgtctgtgcacactcagagccacacacatagtgcgtccactcacacgtgctgcttttgatacttggttaagggaaatgcaccatttgcccttaatttcatgaaataaactttgaagtttcaactttgactgttcacatacaaacgcctggagagagccaggctttagcaagtgagattttccatctgactggtattaccatagaccacattatgaaatcttggagtgaccctggaggaaggcacttgaaagaattgaaaagatggaaattatgctcctggcccttaagaataccactgttatacataatgtaatgtaataagttggttttaaaaattagcctgcaaatgcttacatattttaaaattcaaatgtcttctatacatgggcctccctctagctgtcacgagtagaagtattgaatgctgatcacgtgcatgagtttgttgcagaggctccctgttttgcatgaagcttcttgcgtgtgcggagggtaagcgtccttacccaaacatgagagcagcgctggctgcaactgagtcacagtgaggacactaaaactgcagataaagactgagacacatagaagagatcaatgtttagaaaagaagaattagtggagtagaactattgggattacagttgacccttgaacaacatgagtttgagctgcacgggtccgcttatacacaaatatttttcaaccagatgcagattgaaagtacagtatttgcagggtgtgaaacctgtgtataccgaaggctgacttttcatacacatgtggtccacagggtggaccgcaggacctgagtatatgtgtatttgggtatgacaggggtagaatcagtaccccgcatgttccgagaaataatttactatggtaaactgcgctgaaaaagaagtcttaagtcatgtttagaaggtagttgttcttagcaaggaaaatggcttgttcagttaagggtgtaaagagaggcaaaaagggaagctgtcagtgtactttatgcaagaaccgccttccctgcctcagcccccagcatttcttgcctctcgcctctcttgcctgaagcagtgatatagtaaaggactggaagagtgtgagatggcaggatgctttcggttttgcttttaaaaaaaagatgatgcctgtaatcccagcactttgggaggccgaggtgggtggatcatgaggtcaacagatcgagataatcctggccaccatggtgaaaccccgtctctactaaaaatacaaaaaattagctgggcgtggtggtacacgcctgtaatcccagctactcgggaggctgaggtaggaggatcacttgaacccgggaggcagaggttgcagtgagctgacatcgagccactgcacttcagcctggtgacagggtgggactgcatctcaaaaaaaggatgatgaggcaacagaggttgaaggaaaaaataactgacttgcttaaccagaaaacagaatgtgggtcccagtacagcatataatgaaaccagttagagacaataacaggcaagaaaagatgatttggcaaggttggaggtcctaatgtgagcaatcaacctctaaataattctaaaatcactgacatgatccagatgatacccaaagatggtggcattgggtactgactctaggacatactaaagctgttttcatgggttataaggtaagatgaaaaactgagggaaagaaacaagtcgttgaagtaatttcagctataggatgagaatgttctagatcaggattgttgagtaagtaagggataaattaaaagggaaagaagtagatgccaggcaagggaaagagtcaagaaattcagaaatgtgggagctagtgaagtctggaaggcagtggtcttgctcaagtactactggggtgtcagactgtgccccacttacaggtagtacaggtgtaggacaggaaagagtgcgtaggaaataaccaggtgcagtcgttaacctggtattgatctacccatgggtgataaatgaaatcaaatcagatgaaagtcctctataatgaaagaaaagagagaggcacaaactgacccaagagctatgggatcctgttcaccagtactgggccagaaaaaaaaaaaaaaaggtttaaatactgagtgtgtaagccagctccccccttcatatgtattcctgcgatatatatatatatacatatggatatcctgcagaacaacatggctatttgccctctaacatgctctaaaaaccctttctccaacctgtgcatttatttagatagacctagaacgtggaaacaccagcacaatctggtttctcagatgcccatcgtattggttcctgtccctgccttacggtacccatcatgttatcatttatgtgcaaacaagctgtggtgtactggagggaagggaagggatgcacacagcaggccttttttgtttttgtttgtttgttttgtgacagaggaaggaggtatgaggttgtactttatttttaagaaaatgacagttcgattcagattagctttatattttttgaactggcttccagttggcctctaggtgggggcctccactcaacggctgctattgtagacccctccccaattctggctccacaaaaggggcaggaataaacagtatagggcagatgttggctgaaaggtgtaattaagtatacttttgacttaaacatactgtcttaaagagatcctatctcttttacggaatgagttgttagaaaatcttctgtatctaacgtgaaagctcacagggtacaactgcacttaaattgtcagttaggacaagctttaacctctcgtgacaaaacccctaaaggaggtatctgccctgagggatatgaagctacaagttgtaatgaaggattctgtttcataggacatgctaacatgtaatgctctgcattttagttattaaaatgaacctttttaaagcttaaggatgacaaactcagggtttccttataccactgagtttttaaaagccagtggtgagtttagatgttagcaattcagtggaactatgaaaaagatggaattgtgatggctttccataactaatttctgcttcacaaatataaaagagctattttgaaattccaaattgactagacagactacggcttgtccctgaagccattgttgaagacaaacttacaactcttattagaagtagcagcttcatatttaaagaagaaagtctttttgaattttgccaattaaattaccagtgacctttaagaagtaagtcaaaggtgtcttagagggaaaatttgaagtaacagagacaggcagcagcatcagagataagagctgatagtcaagcattgaatgaaggaaatcaagacagtggtgagatctcacggcaggcagaggctgaggctgaaagcaaggcagtgggctgatgttcagggtcctattagacacttttctgaggttaaggatggactttttaagaggctcctaagagttacatgtccatggcttgaactttttgtctcaaacaacagaaacataggaactaggaacaataacctaaaactggggctttatgtggttctgggtagcagacaaattgagtcacttgaatttccagagtacaaaagacccctttaaccccttcctgaaaaagatttttcatggtcaggtatttttaagtacttgcatactttgttcagaaatctgtatacattaaaaaaacatgttctctttaagaatattctggccaggcacggtgactcttgtctgtaatcccaacacttttggaggccaaggcgggaggatcacttgagcccaggagtttgagaccagcgtgggtatagtgagaccttgtctcaaaaaaaaaaaaaaaaaaattagccaggcctggtggtgtgtgcctgtagttcagctatttgagaggctaaggtgggaagattgcttgagcccaggacgttgaggctgcagtgagccatgatcgtgccactgcactccagcctgggcaaaagagtcagatcctgtctcaaaaaacgttttataggtgtgaaaaatgtattatggctttagtattgcttgcttttcttaattataaaagtttatatatttggaaaatatatgaaagaattttgaaaattataccaagacccagagaaaactattaacattttgatataatattgttgctacacctttcttcagctcttaaaacaactctctattgtgaaatttctccttctgctcctaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgc

SEQ ID NO: 37199 - DNA, 30877 bp, Homo sapiens
atgccgaacttctgcgctgcccccaactgcacgcggaagagcacgcagtccgacttggccttcttcaggttcccgcgggaccctgccaggtaagcggcgggcgcagagcgggcggcccgggcccaccttcgcggtgagcgctgccagccgccggcccctggcgggctcccgggctggctgagaggggcgcaggaggcgggcgcagcgcactgccgtcgaccccagcgttggaccgagatggggagccggccccgagccgtgggcgggcgggcgtccggggacctcggagcacgtgcgctggtgggggctctgcgcggaggacaccaccccaaacgcgagggagctggggcggcgcgcggacgcgggatgctgtgggttctcgccgtggctcacttgctgtgtgacctcgggggagtcgctttcctctctgggcgttagtttccttagctgtcaaaagagagcaggactctatggttgtggccactggggcctttccctctccttgccaccacccccgggacagtgtttctgttttgagtcccgctaccttctttcatctcatcgcaactgctttctccttcggacttgtcattgcacggttcaggattcattttctggctgtcaccgttactcattttctcgcttgggtattgtagggataacagagggtgtacgcgtgagggcgtggaaattggtattggaacctcttccttcggataacccccacacactgacatatttagggaatgatagcatagggactgtgtttgaaaggctgagatgtttcataggcctgtcttgttggttcattcatttaaaatcaatgcctactatgtgccgagcgcaaatgttaggtgctgggagttcatgggtgaataagggtgtcactgcttgcagaaagctctcagtccagtaagggaacaggtgcagcaacgggcgactataatttatgttatttattaattagttcaattaattattgaaggtctacttgtgttggcattgttgtgagcagtgggggttacagatgaacaaatcgaagtccttgctttcatgaagattacattctaatggggggggaataaacaagtaaaatacgtagtgtgtcggatgatgataaatactgtggagaaaaataaacaaaggttagagggtaggggaataagtagtatcaagggacgcacaattgctattttaaatacagtgattagagaaggcctcactaagaaggtgaatttgagcaaagaccaggtgaaggggccagccatggagataccttgggcagcagcattccaaagaaggcaaagacagggcaaccaggagtccagggagagggactgggagagaggtgagatgagaccagaaaggtgtgtgtatggtaggggcaaattctttaggtaggaccttgtaggtcttggaaggcactatggtttttattatgagtgaaataggaagtcattgaagggtttagagcagagacttaaattttaacaggatcagtggctgctcattagattgtggggaggcaaaggtgaaagccggaagaccagttaaaaggctgttgtaataatccagattaatagaggaggagatggtaaatttgagatatggtttgaaggtgaagccaacatcatttgctaatggtttggaggtagattgtaaaagaaaaagagaacttaaggacgacttcaagattttaaaaatctatgttggccaggttggtcttgaactcctggcttcaagcagtcctcctgtgtcggtctcccaaagtgctagaacaggctctgagccaccgcgcccagccgacttcaagatttttaacgtgagcatttgctgagatagggaagactgggaagagcaggtttggtagaggaatactagaagtttgggtttgagagacctgatagacattcaagaatagatgtctaggccgggcatggtggctcacacctgtaatcccagcactttgggaggcctaagcaggcggatcacttgaggtcaggagttcgagaccagcctggccaacatagggaaaccctgtctctattaaaaaatacaaaaattagctgagcccagtggtgcgtgcctgtccagctactcaggaggccaagacgtgagaatcgcttgaacccaggaggcagaggttgcagtgagccgagatcgtgccactgcactccagtcagggtgacagaacaagactccgtctcaagaaagaaagaatagatgaaaaaaaaaaaagaatagatgtctttcttcataccatatacagaaatgaactccaaatggcctatacttttattgagatcaaaggcctaaatataagagctatgtcattaaacttttaggaaaaaaatacagataaatcttcatgactttagatttggcagcacattcttgtttgttttttgttttttttgagagtctcactctgttgcccaggctgcagtgcagtggcacagtctcagctcactgcaacctctgccaccgatgttcacaaactattctactcactcagcctcccaggtagctgggattgcaggcatccgccaccatgcctggctaatttttgtatttttttttagtcaagacggggtttcgccatgttggccaggctggtctcgaactcctgatctcaggtgatctgcccgccttggcctcccaaagtgctgggattacaggtgtaagccaccgtgcttggctggcaccacattcttagatatgacaccaaaatacatgcagtaaaaagaaaaatagactaattggacttcatcaaaattaaacttttgtgtatcaaagaacattaccaagaaagtgaaaagaatggaagaaggtacttgcaaataatacatttgatctgggtccagtatccagaatatataaagaactcttacaattcagcaacaaaaagacaacccaattttaaaataggcaaaggacttctttctttaaacagaagatataaatggctaaaaagcacatgaaaagatgctgagcatcactcgttattagagaagttcaaatcaaaaccacaagtggcagttagatgtagaattactgtgtgtcccagcaattccattcctaggcgtatatccaaagaattgcaaactgatattcaaaaaaaccaaatgtacacacattcatagcagcactattcgcaatagtcaaaaggtagaaacaagccacgtttatcagtgcttgaatggataaacaaaatgtatatcaatacaatgaaatattagccatgaaaaggaatgaagtgccagtacatactacagtatgggtgaacctcagaaacattatgctaagtgaaagaagtcagatacaaaagcttatatgttgtatgattctattatattaaatatccagaataagtaaatccatagagatagaaagcatatcagtggttgcctggggctgggcgaaagggagagtggggagcaactgattaatggttacaaggtttccttttgaggtgatgaaaatgttttagaattaggtagtggtgatggttgcagaacatgatgaatgtgttaattgccattagttttttactttaaaatggttagttttatgttatgagaatttcacctcaaagaaaatagatgtcttgaagagagaataggatatacaagtctgaaattcagagactttcaaaccggaaattgtaaatatgggtgttctcagtttatagagggtatttaaaaccgtggtacgggttaaggttatctaaggagtgagcaaagaacagatctgaggattgagtcctggggcattcccagtgttttaagttccgagacatgggaaagaactcgctcagtacagtgaggagtagcagttgggaacagaggagaggagcatcttagtctgacttggccttgccccattatgcgttatcttccttttacccaaattttagcccaaagacattcttacaggtttatttcacttccataatgagggcacccctagtcagttctggaccacaggtcatttgtattaatatgtagtgaatcctgttttgactacactccttaaggggagtatagtctataggggtttacagtttcagatttgaaagaagtgtttagatctagtgaaatctcacttgaaatactggaattttctcaataatagtgacttttatcatttttagggttattatcccttttgagaatctagcataaggactcttacctgaaaaaaaaaaaaaaacaaaaaaaacatagacacaatttagcattcgaagacaaagatgtttatgggcctttataggccctgtgcattcctgacagatgggcatctttgcccttgctaaaacacctctaatgatagtcctcccctttgtgagaagacacgtgatgattctggacgctttggctgttgtttcttccttgtattgagtggacatctgcctcctgtaattgaggccttggaggtcctagttttgttcccaggatcacacgaagtctctgcccttttcaacgttagactcctttgaatgcttcaagaccaaatcatgaatttctttttaaaaagatgtttattgagatgcaattcacatataattcacccatgtaaagtgtacgatttggggtatatacattaatttttaaaattttggtaaaatacaacagaatttgctaatttaacctttaagtgtgcaattcagtggcgttaattacattcacagtgttgtgcaaccttctccactattttcaaaactttttcatttatcccaaacaaaaactgtaaccattaggcaataacctcccattcccctgcccttccagcctttggtaacctcgaatccactttcggtctttataaatttgcctgttctagattcctcatattggtggaatcatacaatatttctccttttatgtctggcttgtttaacttaatatgttcaaggtctttttatccaaatcaaacctcctcgtactacatgattttaagttctactgtatttgatagtttccatttcactgtgcccagtgttatttataacaaagaagtagtttccagaggtgttattgaattaataacagtatttttagggttattagttctaacccaccccccccccaccttttcttctataaacaggttgtagggaaggttgataaaaggtgacattgccagtctagtcttcaaatgctaacattgttaacaaacaataaagatgaatatatttaatgctattaaaacagtacatttcccagtcatcagttataaattccatgcatgcttttagaaacagctatttagaaataatttaaacttcaagagtgtaattaataaagtgtatggtgtggaatcacataccataatagttcttattgttttagaaaacgtggcattaatatgcttcttttttaaaaaagtgaaataatcaacccagcttaggtcagtgacacggtttaagtaaaaaaaaaaaaaaaaagcctaagtcttgattgccccagggtggcttgcctaatgccaaggcttgccactgtgaggcagctcacagtggagctcttcctaaaccaggagatggtacaggtagagctaatgaattgctctgattagagtgagatgggcgttgaagctctcttcttcctcctcaggcagctagtactaactcacccaagatgggtgagggcttccaaggttcttctggcaatttaatgaaggctgattgagagctggtgtgctctactttgtgaaatgtaaaacagtggttttctggggactcgtgagggtgcctgtttgggctgttataacaaaataccttagactaggtgatttttaaacaacagaaatttatttctcatagttctggaagctgggaagtccaagataaagtcaccagcagatttggcatctggtgagggctcactcttggcttcttagatggtgccttcttgttgtgttctcacatggcggaaggggcaaataaggcttccccgtcatgacctaagtcatctcccagatgccccacctcccaacaccactgcactggggattgtttcaatatgaattttgaggggatgcagacattcagaccatagcaatccccaagatcctttcagggagtccacaatgtcagaactattttcataataacactgatattatttgcatttttcatatttggtctctcaggagtggacagtggaatttttgggttgctacataacatgatggcatcattgctttgataaattttgtgttgtgttttctagaattttctaaatattattcagatctgagtgttcagtagacattttctcagaaataaacaagcctgccacttcaaggagaacaactgataatttgagcattcaagttgaaaattagaattttggaaaatttatgtgccactgtgagcttgacagctctctaatacttaaagacttttctggtgagatcactgatgatactgatgtgtttttttttttttttgtataatgaattgcattaacatttatatggtatgtataactcactgaactaatattttccaaatgaccaatttatggttttacagagacatacatggataaaagtgcaagatagactatgggattttttatgtactagggcatgaaaaagctcattggtctggtctcagatgtcacatttcaactaatcttgaagaaactaccacttgtggagaattcacaattatatggaaaaaagaggagtattgtaataacctttttaactgcatatcgttatgaggctagattttcttcatatatttcaaccaaaacaacatatagcaatagattaaatacagaagcagatgtgagaatctagctgtcttctgttaagctggacgttaaagagatttgcaaaaatgaagaagtgtcatttttctcactaaatatttttgttttggaaaatgcaattttttattaaaacgttatttgtgttaacataaggttggtattttaatgaattaataaatatttttaaaatttttctgataaatgttgttaggtaaaatccacataaaagatctttggagtcctcaataatgtaatagtgcaaaggaatcctgggactatgaagtttgagaattgctgctctaaaatgtgagcagcaaatttcaaactttttttttttttgaggggtcttactctgtcactcaggctggagtgcagtggcaggagcatggctcactgcagcctcaaccacctgggctcaagcaatcttccagcctcagccacccaaatacctgggactataggtgcccatcacaacccccggctaatttttgaaaaaaattttttttagagacagggtctcaccatgttgcccaggctggtcttggactcctgagctgaagcattccccccttgttcagcctcccaaagtcttaggattgcagatgtgagacaccacgcccagcctgaagtactttcatatcaactcatttaatcttccaaacaatggggtgagttgtaataatagtacttctttttccttttttttttttttttgagacagtgtctcactgtcacccaggctaaagtgcaatgacacgatctccagtcattgcaacctctgcctcctgcgctcaagtaattctcctgccttatcctcccaagtagctgggactgcaggtacataccaccatgcctggctaatttttatattttttgtagagacagggtttcgccatgttgcccaggctggaacagtacttacgtagtgtattctttgtgacaggcactgctctgttatatacttctctgttatatatacattatttcatgttacccttgcagtaaattttgaggtagtccttgctttacagatgaccaaagtaggtacagagaggttagctaacttttttaaaggccctgcagaaatgtctaaaaccttaagagcaggtaggacaggataaaataggtattacccgaacttttttgaccgtggaaccctgttttttttttggagacaggttcttattctgtcacccaggctggagtgcaggagcacaatcattgctcactgcagtctccatctcccaggctcaaacaatcctcccatctctgcctcccaagtagctggggaccataggcgcacgccaccacacttgactaattttttaattttttatagagacaaggtctccctatattgtccaggctggtcttgaactcctagcctcaagtgatcctcttgccttggcctctcaaagtgctggtattatgagccaccatgcccggtcccttttttttttttttttttaaatgtaacagttctgactgggcatagtcactcaggcctgtaatcccagcactttgagaggctgaggcaggaggatggcttaaacccaggagtttgaacttagaatgagctatgattgcaccagtgtgctacagcctgggcgacagattgaggccctgtctctctctctcttttttttttttagaagcaattctttgaacaggattccttggaatacacttttagaaatgctgcattagtaagaaaccaatgagggaaaaacatcaaaaacaaaacaaagaagtaatcagtgatggttgactagtgctgaaggtgtttaaggtgtgtacagaaagtggctgcacgcagtggctcacgcctgtaatcccagcactttgtgaggtttaggcgggaggatcgcttgagcccgggagtttgagacccacctgggcaacataatgacacctcttctcattactttaaaaatgaaataaaagataggccaggcacgatggctcacgcctgtaatcccagcactttgggaggccgaggcgggtggatcacctggtcaggggttcgagaccagcctggccaacatagcgaaaccccatctctactaaaagtacaaaaattaaccgggcatggtggggggtgcctgtaatcccagctactcaggaggctgaggcagtagagtagcttgaacccaggaggcagaggttgcagggagccaagattgtgccactgcactccagcctgagcgacaagagcaagactccaccaaaaaaaaaaaaaaaaaaaaagaaaagttaaaaatgaaataaaatctgtacaggaaagtgaccgttggatttggcaggatagggtcgttagtaattttcttgagcagtttcagtggaaaagggatagagtaggagcctccttggcattgattaaggagacagtacaacaagataagtggatgcagtccaaatggatgctttaacaagttttgctataaagaggatcaggattaagagagttttaaagatgggagacattagggcatgtttacactgtgggaataatatagtaagataaatgtagggagttgagatattatacatggagaggtggaaagtcttaaatgcctggagttttctgtgtgcatacatattcatacacatacacccacatatatgtacacatgtgagtcaggaaaactttccctcaagaaatgacatttgcgctaagatctgaaggctgagtcatagttaactgtgcataggaagtgtataaaaagcagcaagaagagtgtagtaggctgagtaaacagcgcagggaaggccccaggatagaagtgaacacagttgtttatcctgagagtaatgagaagccactaaaagcttaagcatgggagagacattctcaaattggctttaaaaaatgctctgcagcacggagaaggggttagagaagggcagatgaccagtttggaagagatactagtagaccaggtaaaaaattatggtagcttggaccagggtgttattgatggagagaagcagatggatttggggagtcattccactgtgctaagggaaaagtctacaaaatctggagtacagggaacagaacaatgacagggagagctgggaaaggggaggcattggtaaaaatttgagacgagtatgtaagtgggtatgtatgtatataaatatatatacatattcataatacacatatgaatacacatgtgaaaacacttattgtggtcatatatatatatattttttttttttttctttttttttgagacggagtctcgctctcttgccaggctggagtgcagtggtgcgatcttggcctactgcaacctccacctcccggattcaagtgattctcctacctcagcctcccggtcatatataatttttataattttattcatgtaaaaacgtatacatagaagagctacgtgcggtggctcatgcctgtaatcctagcaccttgggaggccgaggcaggacgatcacttcacccaggcgtttcagactaacctggggaacatggtgaaaccccgtctctacaaaaaatacaaaaagttagccaggcatggtggcgtgtgcctgtagtcccagctacatgggagactgaggtgggagaatcgcttgaacccaggagatggaggctgcagtgagccgagattgcaccactgcactccagcctgtgcaacagagtgagatcctctctctcaaaaaaaaaccccaaaaaacatatgcacagaagatcacaaatgataactgtacatcatgttggattttcagagtaacatatccatgaaaatttcaccgggatttttaaaaaatagagtatcactagcgtcccaaacttcctctgcttcatggttctcccagccattatcccattctccccagtggtagccactgtgacttcacataccttggattagttaggttttggggggaagagggagaatgaatggaagctttattattgtttgagatatagaacattagcagcacctcagtagcctcttttgtgcccactcccagttgttaccctccccaaatgtatctgctattccatcactgtgttgaggcggagccagaccaccccatatttaaagattcactagaagggcttgcaggactcagtatatggttgtactcacagtgaagatttattgcattgtagtaaggatacacatctggatcatgagggaaaaagacaggcacagtctgaaggaatccatgtataggcttccctatgctccgtctttcccatgagggggtcacccagagcccgtttttccccagtggtggaaatgtggcaacacgtgccgtgtttctgtggagagaagaccgttagagacgtagtgtccgaggtttttactgggtcctgatcacataggcagcctctgcctggcatataataaaattccaaattcccagaagggatggcaggtgttcagcaggtgtgcttgtttgcacaagcagtctaggcacattgagctgcattatcagttaggaaaaattttatttctgtgtatggaactgtttaccaaccaagttcccggataccagcccaaggtccttaacaaacaggcctttctaaggacagcagcctgaggtctgctgtgttaactctttttctgaacaatcactatgaatgagttttgcctgttctagaatttcatatcaaaggaatcatgtagtatgtactcctggcttcttctgcttaacattacgtttgtgagattgtagatagtttgttcatttcatagccaagtagtattccattgaatgaatataccacaatttatccatcctgctgttgatgggcaaagttacttcaccttctccccaatatttggtattacctcttttacattgtagtcattcttgtgggtatgtagtaatttgttttggctttaattagcatttccctgatggcaaatgagatcgagcatttttttttcatctatgtattgccatttttataacctttttattataaagtgcctgttcaaggccccttgcctatttttatgttgggttatttatttgtaggagttcttcatatatattttgaatgtgagtccattgttagatatatgtattgcaaatatctgacattttgtggtctgccatttcactcttaaatggcttcttttaatgaagaaaagttattaactttaaagtagcctaatttatatatcttttcctctagcatttgtgctgttgccttaagagatctttattccaaggtcatgaagataatctcctgtgttatcttttagtggctttattgttttacctttcatatttagatctccaatcacttggaacttatttttgtgtatggtgtacaagtaggagttaagatttatttttttcatgtagatattcagctgactcggccctatttattggaaaagaaaaatccatatttgctgctgttcagagctacctttaagtatctgcagtgctctattttgtttcactgttctgtccttctgccagtacttgtcttaataagctttacagtaagtcttaatatctggtagtgtaattctttcaacctcctttttcctctctctctctcaagattatcttggttatccctggttctttaatgttgtgtataaaaagttttagaataatttgtcatttctttctcttgctctctctcacaaacttactgggcttgtgattatattgaattagtaaatgggtttggggagaattgacatctttggaatttagtgtgccagttcataaacttgtgtatttatttaagtttgctttaaaaagattattagaggtcttgcacttctttcactagatttattcttaagtagttcatatagaaagtcaggtgtatttgattaggctctctgcctgatgcccattctgttcttgattgtctgaataagagttgctgttgatatcagaaagctgtttcaacttagttcggaggtaatatgtacagtattgctctgtgtggaaggtctccagagatttaagaatttaaaaaacaaacaactgtagcagtatggcaaattattttatagtgagatcgtttttatacttaatatttggattttgaaacatgaaatgtttataatcataatgtacaactgtgtaaaagtgtgattaaattgtgaacatcttaggcatcgttactgtgagcagtaatacttgttggtcaaatgaaatgctgtacaatttaggtgtagttttttaaaaatcatagcattttaccttgatttgacatttttagagtagagagaattaagtgtcaggggcatgtatgttggggggaggtggacaatagtgttaaaacataaaaaaaaaatactgtgatttaattataaaggaatatgttgggccgggcgcagtggctcgcgcctgtaatcctagcactttgggaggccaaggtgggcagatcacctgcgatctggagttcgagaccaagctagccaacgtgctgaaaccccatctgtactataaatacaaaacttagctgagtgtcgtggtgcacgcctataatctcagctccttgggtggctgaggcaggagaattgcttgaacctgggaggcagaggttgcagtgagctgagatcacaccactgcactccaccctgggctaaagagcaagacaccatctcaaaaaaataatttgtgatactgtttatccacggcagaacttttattcttagaaatttgaggaatgggccgggcgcggtggctcacgcctgtaatcccagcactttgggaggccgaggcgggcagatcacctgaggtcgggagttcgagaccagcctgaccaacatggagaaacccagtctctactaaaaatacaaaattagccaggcgtggtaacgcatgcctgtaatcctagctacttgggaggctgagacaggagaatcgcttgaacccgggaagcagaggttgcagtgagccaagatcatggcattgcactccaacctgggcaacaagagcaaaactctgtctcaaaaaaaaaaaagaaaagaaaagaaatttgaggaaagatctagttgtgactttagcaagttacttaatatttctgtgccttcatctgcacaagggggatattaatagtacccatctttggaaaggacttagaacgtgtctggctcataataagtgcttattattagcttttctgaaaatatttaagcaccgagagggcatggactttgtcttgttctctgtcttcaacactttttgtgtactagattgtgtagtcacagtccctgcattcatggagcttgcaatctagtcagcacgtattactgtagataataatttgtgttcataggaagataaacgaatacagcctttatgcttcccttagaaactagttatttaaagaacatctagttgctgatttttttttttttttccgagacggagtctggctctgtcacccaggctggagtgcagtggcgcaatctcggctcactgcaagctccgcctcccgggttcacgccattctcctgcctcagcctcccgagtagctgggactacaggcgctcgccgcttcgcccagctaattttttgtatttttagtagagacggggtttcaccgggttagccaggatggtctcgatctcctgacctcctgatctgcctgccttggcctcccaaagtgctgggattacaggcgtgacaacacgcccggcctaattgctgattttctacagtgacagtgttgttttgtatgcttgttgaagttgaaatcctgaagggaatgttaagctgtgagccttgtggctgtgcatgcagctttctgcttgttctgctgatggttgaatcttctctgatgttttgggagttggaagatgcaggtttcagttctagttctgctgatgattttgtacttccctccaaacaagttacttcttaaccttgtctgtaattgaaatgttggtactaaatgacttctaaggttttttccaactgttattttgttattaatcaaattctccaaattatgttctcagggaggggagcaggaatccgttgttattaatgtatgtttgccttaaaactgaaggctgaaatttaaatgctgagctcattttcataattgtattttggttttatttatagatgccagaagtgggtggagaactgtaggagagcagacttagaagataaaacacctgatcagctaaataaacattatcgattatgtgccaaacattttgagacctctatgatctgtagaactgtgagtaatagaagagcttggtgtctctctgtttgacttgatttctctctctcactgtgtctggttggaaatgtaagtatttaccaatgttggaaggtattcctatatcctgccactttaagatgaagacagatttggagctgaaaagtatctgttttgttcttaaaatcctgattttgccgggggcctataatcccagcactttgggaggccgaggcaggaagaccacttgagctcaggagtttgagaccagcctgggcaacatggccagatgccgtcgctacagaaaataccaaaaaaactagcgaggtgtggtgacgtatgcctgtagtcccagctacttgggaagctgagatgggaggatacttgagcccatgacgtcggggctgcagagagttgtgttcatgccactacactccactctgggcgacagagtgagcgcttgtctggaaaaaaaactcaaaatgattaaaacaaaacaaaacaaaacaaaactcttcggttcctggtgccccatttctactcacccaaggtaactactttttttttttttttttttaaagacagtcttgctctgtcacccaggctggagtgcagtggcgctatcttagctcactgcaacttctgccacctcccccacctcctgggctcaagcgattctctctcctcagcctcccaagtagctgagattacaggcattgtgccaccacgcccagctaatttttgtacttttagtagaggtgggatttctccatgttggccaggctagtctcaatctcctgacctcaagtgacccgcccacctcggcctcccaaagtgctgggattacatgtatgagcctccacacccggctgaggtaaccacttttaaatattatttagtcttcaggaaaattttagatgattataaaagtatatgtttatttaaggtaaagttggtgtttttatttggagctctttagagcttttttatgagtaaaattttcatctcggaatggagctcttgttttcatgtttttgtatgtactattagaaccaacttttaatttttatgtggtagatataatggtaaacaaattatccaggtaatgtggaaaaacattttcatcaataatatgtaatttcatatcaggacctactgttaactgtgtgagcttggccaagtcacttcccctctttgggccccagttcctaataaggagattaggccaggtaattcctgagttctaagatttttaaccctctgtgattctcttgctgtgatttataaaaggcacaaataaggcaaatttgattgaaatgaagcagacttgtttcagtgtaactaatgtaacacctcagatattgggatagacataaacttgattcaaaggtacactatatgttgttatgcagcaatttattttgatatttttttcagatacattttgcagaggcatcagaaaactaaagaatgattgggttattttatttctcaaaattaattgaagcagatacttgtgaagtcattgggaggtgagccaattccggttcaacagtttaatcacaaatatttgaggaatatttttgccttgatttgttaaaagggtaataatgatcaaccaaaataaaaggtttcatatgtttaaaaggcaaactacttttatgttcttgacatgaagtaaaaatatcccaaattattttaaatacatttgccatatgcatttttgcatttttattttagtaataaatatggtctcttaattagataattctaaccagattgtgagaaatttaaaggatagttcattcttacattctttagttagagaatagaacagaaagatgagccaggtttgcttttttaatttctaaatgattcttcaatcttgaataaatgaacgcaaatgtgagaaaatgttctttctatacgtctaggagatgttgttattaaaaactggatttctgggctggatatggtagctcacacctgtaatcccagcactttgggaggctgaggcgggcagatcatttgcggtcaggagtttgagaccagcctggccaacggggaaaccccttctctactaaaaataccaaacaaaacaaaacaaaaaaaattttgctgggcatggcggtgcacacgtgtaatcccagctgctcaggaggctgaaacaggagaatcgcttgaaccaaggaggccgaggttgcagtgagccaagattgtgccactgcacttcagccttggtgacagagtgagactgtgtctcaaaaacaaacaaacaaaaacccctggattttctgatatctgtatctaaatgtttaagagttttggctttattagtttggcattgaagatctcatcagtagcaaggcacagtggcacgtgtctgtagtcccagctactcaggagtccaaggctgaaggattgcttgagcctaggaattcagagccagcctgggcaacatggtggtgagaccctgtctttaaacagacaaaaaaaaaaagatttcatcagtaaacattcatgactactgaatttggccggagccaaatattttattattttgatgctagagtaagattattcttttatgctcaaaccttaattcagcagttaaagattaaatcttgatactgagatacttggtatcatacgtagtatttgaatattgtcttttttggcatgtgtccttatagatatttatattttttattattattatttttttttgaaatagggtctcactctgttgcctaagctggggtgcagtggcgcagccatggctcactgcagccccgacctcccaggctcaagcaatcctccccgctgagcctcccaagtagctggaactacaggcacatgccaccatacctcgctaatttttgtattttttgtagagatggagttttgccgtgttacctaagctggtcttgaactcctggggtcaagccgtctacccggccaaggcctcccaaagtgttggaattacaggtgtgagccaacattcctggccaaaataaatatttgtaaaatgtcatttttttcattcatacattctgttttctgatctataatatctttgctttatttgcaaatagaaaatcaatttgatttgacttttaaaaatttgttaaaatgttttattcctcccctccttatttaataattagtaagatatcaagaattgactgtgtatgtgtttttgcttattttggggacatttgctcggtgtgaaagatgggggagctttgaatataataacttgtactcccttcagtgattgtgtccctaaccaattcctcattcagcctccctagtagactcaggatcacgagcccagcactagaagttgagtgttactaggaagtcagagaatcatctttgtgttttctattatggcatggaattgaactagaaaatattgactctgaatagaaattcatcccaaatgtgtttaacaactctttgggtacaacccaagatagtgtgttccatttagatacatgttttcccttcatgtcttcccaacctcccttccttgggtgaacaaatttagaagttgttatttttgtttggcatgttctttgagcatgcttagatattttgaaataatcactgcttcaaagaaagcttatttaaatgaagtatgtcttatctttatcattccaaattcaggaagaaattaaaggcactattctttggactgtctgaggggagtgtaatagcagttatttattactgtccctcttaataagcttcttgtcttttactcagcctcctcagggctggcagtaggaccgttaccatctaagtatgcatccagcttctagccaagttggatgaaattaacaggaagtagggtagagtatgatcattctttcataagatgattaggacttgaaagagatacagaaatacctagattagcatttgcaaaaatgtgattatgtatatcagtatcacttgtggcgtgagagttggtttcatgtggcagatgaatcaatttttattttagaagttttgtagtatgtgttaaaaacatgtttaaaaacttttttaaaaacataagataacatcagatcattcttcctacagttttattacttaagacagtgttaactaaaaaatgagtagattgtgtaaaaatacagatggtaatataactgaaatggcaagcattgtgatcattagtatgtgaataatttcattttaggaaatgttgatctagttcaataccagaattttattcagaaaaagaaactggggcccaaaaagggaaagtaatttagccagggtgtcttagtgagtcactcactggtagagtttggactagttcctaggtctcctgggtcccagtccaatattttcactgtgccttgatgcttctcagtaatattagcaaaagtggaacattaggtaaaatagggatgcattattatggaacatacaagagtgcagattattttgggagacttgtacctcctgtagatttggtgggctcatggaaggacagtacagataaagtagctgggatgctgaattagaaacagatatgcaaaatgcaagtacattttatattttatgcctaccttcaattcagtttcttaatttataatagattgccagaagggcaaatgcaggcacagttggaaatagtagactgacctgaactgacatcaaattctgtaagtctctatactttagagctggagttgaaggaatattgtggaggtcattaacatagaattttattgatgtgtaatatatttataaggaccatctctgaattaacacaattttctttttcagagtccttataggacagttcttcgagataatgcaataccaacaatatttgatcttaccagtcatttgaacaacccacatagtagacacagaaaacgaataaaagaactggtatgtctatgtactttcagctttcccaccttcccccataatactatgaaatcaaatacagatgcatttatgttaaaattaatccaaattactctctatttcagaggtaatgtaacgggaaataaatgttatggttgttaaatagcctagatgtgagatgatgagttttagtatttaaattggaaaatctccctcagagttagccagttgatacttgttgacttggtccagagtgtgctgttaattacaggccactagctcattcccttctggagaagaaggaaaaagctaccttttctttcatagtaaggaaaatagagctgaggtgtttccagagttcagcacaaaggaataaagaaagggaaagtgtaaaagtggagacatggaatgttttaaagataaggtttctatcactattaaatatgtacagggtttagaaaaaaacactgaaatttctgtatatggcataatttacacatattcttatgttccttggatatccttcagttctgaggattgacacctatctgtattttgttgaccttaggtgaacagaagtacagtaactccttagtccatggctttttgtcatcattgccactagcaaggcccttattttgctttattatttttccttcttcacccactattaccattaccattcctttccctaccagttggtgtccatgctagtgtatttaatatatgtcctatcagtccacctactgtgtgctttttaaagatagcatttatctaattttccttattctatgcttacctttctatttagatattttatccatttggagttagtatgtatgatgtacagtagggatctataataactttttctccttatagagaaactgttttcccaacatggtctgttagttcttcctttcgtccactggtataaaatgccacctctgttatataacaagtttacatgaggctgttttggggagttctgttccatttcactgtattatttgtttgcaactataccacactgttttattaccatggcattgtaatatatcttactttcaaataaggtgattgtttaactcttctttttcttaactatttgtggacctttattcttccctatggattttttttttcccccccgagacagagtctcactctcacccaggctggagtgcagtggcatgatcttggctcactgcaacctccacctcccggtttccagcaattctcctgcctcagccttccaagtagctgagactacaggcgctcaccaccacgcctgactaattttgtatttttagtagagacgcggttttgccatgtcagccaggctggtctccaactcctgacctcaagtgatccgcccacctcggcctcccaaagtgctgggattatagacgtgagccaccggcctcctccatatgaatttgaaagtccttttgtcaagttctcctagaacttcttttgggattttcattataattgctttgaattgacatctttacaatattagctattgtaaatttattactagtttagtattactgttagtaaacgaatattactagtttactgttacagtataaactattgtaaagtattaactagttctatccatgaagagaaaaaaaatcccataaaatacctatcaaataacagcaatcattgacaaaactaaatactagttttttgaaaagaatattagaatacttttaggagtacagaaaacgaaaaattttgagagcttttgttacagttgtttaaatgagaatgtatgcattcttagatcacttcttaaatacattatggttcttactggtatagatgatatattctggttgaaattgtttccagcacttttgaagaacttctttttaagttaatcctagtaagtcttctgagtttttcctctgttactgattgtatcatctgcaaataaggagaaatttgtctctttcagttcttattattttaattttttctgttgcctgtcttgtttagtcaagatccctggtactatgttgaacaattctagtaatgtcatacttgccttgccccattaagtataatgtttgctgttggtattgttagatagtttttatcaagttaaggaaattcccttctactcccatattcagagttttgttgtttttttttaagatggggtctcactctgtcacccaagccagagtgcagtggggcagacactgctcactgcagcctccacctcctgggctgaagcaatcctcttacctcagcctcccaagtagctgggaccacaggtgtgtgccaccatgcctggcttatttttttgtatttttttttatagatggagtcatgccatgttgcccagtttggtctcaaactcctgggctcaagcagtcctcttacctcagctccccaaagtgctgggattacaatagtgagccaccacgcctgacctatattctgtttttatatttaacttatcacatgctttcattgcatgtatttaatagacaagttcatttttttcattctttaatgcaataagtaatactaatggattttctgtgaaccatctgcatttctgtaatgaactctagttgactgcaatatgtctatttgcttttatataccattggattcaattggtcaatattttatttaggattttacatttgtgaatcttggtctgtagccttcttttcatgtactcttattacccagttataatatcaaggttctattggcctcataaaataagttgggtatcttttttttttttttctcctagaaaaatttgtgtaggtagatgttatctgctcttgaaagtaaggtagaacttggtaaaaccattagatggcttgcggtggatgagggaaagttttgattgccattctgctatctttattggttttctttctttcttgtgttttgttaatgtttctaaaagtttatgaaactttaataatcttttcaaagaaccagtagttttgtcagtgattgttgtacttatgaactattttattggtttttctttgattagggtgatttattttttgactctttttctagcttcttgaatgtttagctcatatttatgtgtattcaaagctataaaagtctctcttaggtccattttagctataccctacaactttagacatatagtgttgtcatgtctggctgtaggtattttgtaatttctctattttgttaacataggattgtttttcttagtttccagatgtggaattatttttaattgctatatgatattttaaattttaaatgttattaagagatacgtagaggatacatatagtctatgtgatgttgattctttctgatttttttgcatccattattgctattcaagtctgtgccagcctgattcttgttcctttttaggtaatcttcttttctccctcaaagctttttagaaggtttctttatatttgacattttaaaatttgctaacctgtatctagatgtgagttttttttttatgtaccttaatttgtcatcttacaactgaggacttacaccttaaattctgagaaatccttagtttttatttttctttatgcattttcccctctatttgtttatttctattttcctgggacttagatgaatactgacacttacattacagtcctccatatcagctttcttcttggtgtccatggaggactgattccaggagcttccctcagagagcaaaatccacagatacttgattcccttatatacagtggtgtagtatttgcatataacttacacacatcctcccgtgactttaaatcatttataatacctaatacaatgtagtgctatgtaaatagttgttctgttacattgtttagagaataatgacaagaacaaaaatctgtgtgttcagtatagacacaaccatccttttcttttttttttttttgagacagagtctcgctcttgttgcccaggctggagtgcaagggtgcgatctcagctcaccgcaacctccgcctcccgggttcaagcaattctcctgcctcagccccccgagtagctgggatcacaggcatgtgccaccacgcccggctctttttgtatttttagtagagacgagggttctccatgttggtcaggctggtcttgaactcccgacctcaggtgatcctcccgcctcagcttcccaaagtgctgggattacagacgtgagccaccatgcccggcacaaccatccattttcaaataatacctagattatttatgatacttaatacatttatgtgtttgtaacacctactacaatgtaaatgctatgtaaatagttatgctacgttatgtaggggaagaatgagaaaaaaagtctgtacatgttcaagatagatacaaccatccattttttccccagcattttcaatgcatggttggttaaatccatagatatgaagtgtaatatgtatcaggatgaggagctcaatcacttgctgtcctgtagctatcatttccctgtagtctgtccctcagagagcctcacatatctcacagcaggcatactcttcctgacccaccatccttataaacgtgcagtccgtaggataaggaggggatgtccaggttgaccagcctgctgatgtttcttgttatcagcaccatgtccagtgctgcccaacaggcatcctgctgtcttcagctgtcactggcattgctgcttttctgccacagaaagtaacaggtggctcatgatttaagcattgtagagggttggaaggaaagtaaaggatgcagctggaaagttcttcctttgtctaaccctattggtgccacttggcctactatgctctgtgtatgctctgtgtatctcttccatgctggtactttcaccttctgcttctcagggatttctcatcacttttgtgttgagtcctgagattcagcaacctccttcttatgggacatctccagggttaaattgggaagtaagatgatttgtgtcctcttgaatttaactccaagtgccatggtgtatttttgtgcctttcattagccagtaaacacttataacccaaagttacgatgatttaggtagaaaataagcaaaatgatgtattcttttttccctaagactttgttataaccttggagtcattaacagcttattctggttttctcattgtctgtttgtttgaagaatgtgtactatataaagaatttatgctcttgaaagaattaaattgactcagaataggcatttgtatttgtgagtctaagatgatacactagaggtcagttttttaaagatgatttgtttttttctttttttttcttgacatttagagtgaagatgaaatcaggacactgaaacagaaaaaaagtaagtgatagtgttaatgactcaacttctgaatgccttttaaaaaggccttgacctggtaaggacaaataaatatgttctgtgttgaaaacctaccttgagaatgaatgtaggagtgtgctcaattttgtcctgtgttttggaattatctatgagactaaagtctaattttagtttgtctttattgagtgctgcaatgccacacactatgctatatgcaggcctcatggaggtgacgcctcctctctcagtgtggtaggggtggcaggcacacagtgctccattgtagggaaggaagggcaacagtagaggcatgcactgaatctctttttctgtccacccagttgtggtatgtaataaattctttgtaaatgtttaaggactaaatgctgtgggggcacatagtgccattgtgagtagtggtcacaacagcctttctggaggtgctgatgtccgaattatgtcaccaaaggacgagggctagaagctgtttttcttcttgtcagttattagttactcctcctcctctgtttcttcctcctattgctgttattattaacgtagcattttattgagtgcttactgatgccaaatcattgttctaagtgctttacttgtattaattaatttaattctcacaatagccgtgagataagtactgttatttccctctttatggatgaggagatatggacttgggcaaagagagggaaaggtattctgtgcacgaaacagggtgctgttttggggaactacactcattttagtgttgttaaagtttgtgataacccattatggttagaaaatagcctagagaggaccccagaggccagaacttgcagacttgtgggctattagcaatagggaaccactgaggggtttataagtaggtgataacagggacctgatttccatggtacatagagtactctgttggattagaaaaggtaacactggaggcatggaggctagttagactgtcaactgaccaaataaaagttgaaaggccttgaattaaggcaatggtagagagagtaaagggaatagattcaaggaacttaagaaatttgtatacctatgacacctaaaaagatgtccaaaagaagagggacttgacttttcagtttgaactctttgctctttaatgaacttctttttgaaaaaaataaaagcaagagaattagtacttgttaattggaagtggagaaataatggaggagagagggagggagccagacaggcaggcgtccaggataacctcttgctttctggcttgggaagcctccctagtatagaaccactgctgtgtcacatataatgaatagcagtgtcatctgatttgaggaggggtgaaggaaggatgctccctgcatttttctgaacccttatgaagctctgaagcatggctcacacaggctccggtcagactagatttccctttgtacttgggcagcctgcttccctcttctaccttagtgcttgtgctagaataattctcaccaactgaaatgccctccttgttcatgtcccccttatttatccttgtcatcaaatgcaacttctgaatttttgtttctccccaccgccctccatagtcttttttctttttgagacggagtctcactctgttgcccaggctggagtgcagtggcacgatctcggctaactataacctctgcctcctgggttcaggcaattgtcctgcctcagcctcccgagtagctgggactacaggcatgtgccaccacgcccagctaatttttgtatttttagtagagatggggtttcaccatattggccaggctggtctcaaactcctgacctcgtgatccacccacctcagcctcccaaagtgctgggattacaggcgtaagccactgcacccccggccctagtcttatgttctaagaactaggttttaactgtgcctcctcagatttggattattttcctgcagacaccactgacctgtatgactatgggcagggcatttagcctgtagggcctcagttttcctatcccctgtgaagagattaggctaagatgtgtgatattctaatactagccctaagagttacattaatctcctttatattatactggtttgtacagctgtcccatctcccatataaatgtgtggcataatggtttgataaaaacagcatcagcatggatcttggagccagacgcacttggatttcaactttacttccattcttctaactgtatttgtgatcttgggcaagttacttagtgtccttgtttgtcaagtggggccgataccacctgcctgaacagagagtaatgtgatgcatataaaatactaagcacagtaccttagtaattagttctgtcccactttgtttttctgagggcatggactgtcattcattacatatgtggaaagtcttgttaagtgtattttaaaaattaggccggatgtggtatctcacacctttaatccttgtactttggagctgaggtgggaggatcacttgaggccaggagttcaagaccagcctgggcaacatagtgagactccccgctctacttcttaaaaaaaaaaaattattcctatcttgtaacagcatttacatctaggattaaaatatatctctttacactgtttgtctctcccactaggatgtgtcttatcttagtgtcttattttaatctctgtcctagtctgtggtctagtaaataccctatgaatattgaatgaatgagtttgtggattttaaatatttaaccaaagatgtaatattttttgttgtgtatggtttttcatgagcctgtttgtaaaattaattctttgttttccagttgatgaaacttctgagcaggaacaaaaacataaagaaaccaacaatagcaatgctcagaaccccagcgaagaagagggtgaagggcaagatgaggacattttacctctaacccttgaagagaaggaaaacaaagaatacctaaaatctctatttgaaatcttgattctgatgggaaagcaaaacatacctctggatggacatgaggctgatgaaatcccagaaggtctctttactccagataactttcaggcactgctggagtgtcggataaattctggtgaagaggttctgagaaagcggtttgagacaacagcagttaacacgttgttttgttcaaaaacacagcagaggcagatgctagagatctgtgagagctgtattcgagaagaaactctcagggaagtgagagactcacacttcttttccattatcactgacgatgtagtggacatagcaggggaagagcacctacctgtgttggtgaggtttgttgatgaatctcataacctaagagaggaatttataggcttcctgccttatgaagccgatgcagaaattttggctgtgaaatttcacactatgataactgagaagtggggattaaatatggagtattgtcgtggccaggcttacattgtctctagtggattttcttccaaaatgaaagttgttgcttctagacttttagagaaatatccccaagctatctacacactctgctcttcctgtgccttaaatatgtggttggcaaaatcagtacctgttatgggagtatctgttgcattaggaacaattgaggaagtttgttcttttttccatcgatcaccacaactgcttttagaacttgacaacgtaatttctgttctttttcagaacagtaaagaaaggggtaaagaactgaaggaaatctgccattctcagtggacaggcaggcatgatgcttttgaaattttagtggaactcctgcaagcacttgttttatgtttagatggtataaatagtgacacaaatattagatggaataactatatagctggccgagcatttgtactctgcagtgcagtgtcagattttgatttcattgttactattgttgttcttaaaaatgtcctatcttttacaagagcctttgggaaaaacctccaggggcaaacctctgatgtcttctttgcggccggtagcttgactgcagtactgcattcactcaacgaagtgatggaaaatattgaagtttatcatgaattttggtttgaggaagccacaaatttggcaaccaaacttgatattcaaatgaaactccctgggaaattccgcagagctcaccagggtaacttggaatctcagctaacctctgagagttactataaagaaaccctaagtgtcccaacagtggagcacattattcaggaacttaaagatatattctcagaacagcacctcaaagctcttaaatgcttatctctggtaccctcagtcatgggacaactcaaattcaatacgtcggaggaacaccatgctgacatgtatagaagtgacttacccaatcctgacacgctgtcagctgagcttcattgttggagaatcaaatggaaacacagggggaaagatatagagcttccgtccaccatctatgaagccctccacctgcctgacatcaagttttttcctaatgtgtatgcattgctgaaggtcctgtgtattcttcctgtgatgaaggttgagaatgagcggtatgaaaatggacgaaagcgtcttaaagcatatttgaggaacactttgacagaccaaaggtcaagtaacttggctttgcttaacataaattttgatataaaacacgacctggatttaatggtggacacatatattaaactctatacaagtaagtcagagcttcctacagataattccgaaactgtggaaaatacctaagagacttttaaaaataggctttcttatatttgatatttggaagaaaaagccgtaaggtgtatgtagaccacttaatcactaaatatctttgcctataggactccattgaatacattagccattgataatctacctgtttaaatggcccctgtttgaactctcaagctttgaagacctacctgttcttccagaagagaacgttgaaagtgccatgtttccttttgcgtgatctctgttgatggcactctggaattgtttcagttaagtcattttagacatagcatttattatcactgtggatctctacttgttgggtgttatgaattctttgaagaaatatattttgaagaggtgtgggaggaaggaatacattttataaaatgttgtagtgaagcccacaattgacctttgactaataggagttttaagtatgttaaaaatctatactggacagttacaagaaattaccggagaaaagcttgtgagctcaccaaacaaggatttcagtgtagattttgtctttcttgaacttaaagaaacaaatgacaaagtttgaatggaaaagcctgctgttgttccacatctcgttgctgtttacattcctttgtggagcctacatcttcctaagctttttagcaggtatatgttgaacacttctgtttcatggttgagacagaatcagaggccatggatactgacaactgatttgtctgttttttttctctgtctttttccatgactcttatatactgcctcatcttgatttataagcaaaacctggaaaacctacaaaataagtgttgtggtttatctagaaaaatatggaaaatattgctgttatttttggtgaagaaaatcaattttgtatagtttatttcaatctaaataaaatgtgaattttgtt

SEQ ID NO: 37200 - DNA, 5785 bp, Homo sapiens
gcggccgctcagtctgggcgcttgcaggctgctaaacccaaccgcagttgactagcacctgctaccgcgcctttgcttcctggcgcacgcggagcctcctggagcctgccaccatcctgcctactacgtgctgccctgcgcccgcagccatgtgccgcaccctggccgccttccccaccacctgcctggagaggtaaggggaggttgtccaactgcttgggggaagtcccaccaactcttagggagtggagcggcaggcctggggacctgggtgggcgcggggatggggcgctagaggcttgagtagagaggtagaagcgcacttgatgccacgtgctcagattccaggagcagggagaaagcaaggggaagggaagcaagggcccgcggcttgctgccatccccatcctctgacaaactgcagtcgtgctcaggtgacctgctgaagacccggctgcgggaaggccacgttgacatttccaggcagcactgagcctgcccatttcttaagcatttgtttttcattcctcagaccagagctaggggcattgcctcctctgcccctggaagacagggagatttttttttttttggtggggtgtgtgggggtgggggctcccactgttgagggtgtgtccatattccagagagctactcaacagcttccaatccttactggctgggaaggaaaaagtaaagatgaaggcaggaatcagtttcccacacagttcagaaatacttctgaaaagaatgctgagttcttttctgaatcaacaggcacgaagagagatcagtgtgactttagggaaaagcccatatatgcagcgtgtgtattacccagaaagtgtaagacctaccacagcatagctcaaacattgcttttgttgctttggggttgatgatgctgataagagaagcactcttggcctggggacagccaagagtttccaggaactcttgaggctaaagtttgggtggcaccacccagagctcttctgggacccataaacctctccacactggctgagcaaatgagagaatgctttcatgttcctgatttgtttttcagagccaaagagttcaagacacgtctggggatctttcttcacaaatcagagctgggctgcgatactgggagtactggcaagttcgagtggggcagtaaacacagcaaagagaagtaagtgttgctgaccagctcagggctccgagagggaagggagtgggaagggagtcatgaggagggaaatacagggagaagccaggacacgctaagtggaccttggcaacacctccctagagattttagtgggacttgttgctggtctgttatgactacttggctcatgggtgagtgggtaggtggctccagggctccaagtccatccacggatgagggcacacagggcatgaatgcctagttcccagactctcccacctcgggattcattgcacgtgcatccagggctaggacagaatccaagaccacttgaagttttctagtatgcaccttgcctagaaactctttcatattggctatcaactgtaccaaactctggagttatgtgtagatgtaatctctatttatgaggaccttatttccttgggaaggtgtacaaaacaaatctttgagagtcaggggaattgaaataatttttggacagagacgagacaggcttagagatattgactgaggactaaagagtccctggctttgatttctggttgctgaattgtgctctagaaagcactactgcttaccctaagtccaactaagagtttgaggtgtcagcttcagcaatcaccaagcaagcctttctgtgaattttatgcagttttccatcagagttctggctagaatttgtactatgctttggtttgttgattttttttcttactctttttttttctttttgtcttttagtagaaacttctcagaagatgtgctggggtggagagagtcgttcgacctgctgctgagcagtaaaagtgagtaggagccttttgtgtctgtctctgggtggcacatgtgtactcatgtgctttggagccagccccaggactgctgagagcctgggcagaataatagtagtagtaataataataataatgatcccctagtgtgccagcctctattcaacatataaaggcaggtcattgttcaagaaaattatgttctaaaaatagagccattaattgcaattgctttcctttcttcttgtattccctgctgtccctccagctgacctatttcctcttctttcccgcaaccccagatggagtggctgccttccacgctttcctgaagacagagttcagtgaggagaacctggagttctggctggcctgtgaggagttcaagaagatccgatcagctaccaagctggcctccagggcacaccagatctttgaggagttcatttgcagtgaggcccctaaagaggttagagcccccatatgcccagtgaatcctcacgaccctgcctgctccttcccctctgagaatcagggctagaggggaggaagggctaggtgtagaggtagaagggccttacttggcacaggggtgactgggcttctgtgaccagagactaggaaagccaggcccagtgccactcctgggtgcttaaccctaagactcatgatggggcaggatgtgttggcaggtttttcggcttctgtccatacccacctttataaacccatccgtttttagaggctcaaaacacttagcaactggggagacaaggtcagcacagggaccttatgtaacctggctcagtccccaggctgacctgcctgaggcctgctggtctgtggtctgtgatttttttgtctaccttctctcctggccgctaaacgcatggcagctgcatttgctaaagaacacagcgccacctggtggaaagataagagtaatgccttacttttgtaccttatttttgttttctgaccgctgattgattccacataattctgtaaaggtgtattgagccccaattatattcaagacactgttacagtcactgtgtatgtcacagtgagccacacaaagtcccttacctaatgaaacttataatttgaatgggggaagatgccaataaccaactagacaaatatatgccaggtgatgagctatgcactcataaaaatacagcaggaaatgagagacagggagtaccagaggtagggcctgggaagacgtaaggttttccattctgtaaagggaagtgaggacatatgaacagagataagaaagaattcagggagggaagaacattccaacacaggaagcagcaaatgcaatggccagagcctgcctgtcacagtcacggatgagcaaatggacctgtgtagagcagggcaagagcaggagatgaggtcaggcatgaggaggatggccaggtgtgggcttggggagcctcgtgggcccagcaagccctttggctcttcttctgaaagacatgaggagacaacagaggagctaccaaactgagttgggtttttaaaggctcactgtagcgactgggtagagaacaaaccacaggggtggggggtaaggtagcagagagaccaggtaggaggccttggtgcaaatcccaggagagctgatagtgacttgaagcagggttgctgtagaagaaagggtgaaaggggattgcgtttgtatacattcttgatagatcctcatgttaattctgagagattggaggacagacactggatcagatgtgggtacaagcccagagctgaaaagctagtgatcaactcaggagcccccacttcctgatgcagcatccgatgctctttccaatgcccagcctgccgttggccctccctcagccatgcccaccctcttccccaactcaccctgtgtgtgtcctccttcccgcaggtcaacattgaccatgagacccacgagctgacgaggatgaacctgcagactgccacagccacatgctttgatgcggctcaggggaagacacgtaccctgatggagaaggactcctacccacgcttcctgaagtcgcctgcttaccgggacctggctgcccaagcctcagccgcctctgccactctgtccagctgcagcctggacgagccctcacacacctgagtctccacggcagtgaggaagccagccgggaagagaggttgagtcacccatccccgaggtggctgcccctgtgtgggaggcaggttctgcaaagcaagtgcaagaggacaaaaaaaaaaaaaaaaaaaaaaaaaatgcgctccagcagcctgtttgggaagcagcagtctctccttcagatactgtgggactcatgctggagaggagccgcccacttccaggacctgtgaataagggctaatgatgagggttggtggggctctctgtggggcaaaaaggtggtatgggggttagcactggctctcgttctcaccggagaaggaagtgttctagtgtggtttaggaaacatgtggataaagggaaccatgaaaatgagaggaggaaagacatccagatcagctgttttgcctgttgctcagttgactctgattgcatcctgttttcctaattcccagactgttctgggcacggaagggaccctggatgtggagtcttcccctttggccctcctcactggcctctgggctagcccagagtcccttagcttgtacctcgtaacactcctgtgtgtctgtccagccttgcagtcatgtcaaggccagcaagctgatgtgactcttgccccatgcgagatatttatacctcaaacactggcctgtgagccctttccaagtcagtggagagccctgaaaggaggctcacttgaatccagctcagtgctctgggtggccccctgcaggtggcccctgaccctgcgttgcagcagggtccacctgtgagcaggcccgccctggggcctcttcctggatgtgccctctctgagttctgtgctgtctcttggaggcagggcccaggagaacaaagtgtggaggcctcggggagtggcttttccagctctcatgccccgcagtgtggaacaaggcagaaaaggatcctaggaaataagtctcttggcggtccctgagagtcctgctgaaatccagccagtgttttttgtggtatgagaacaggcaaaaagagatgccccgagatagaaggggagccttgtgtttctttcctgcagacgtgagatgaacactggagtgggcagaggtggcccaggaccatggcacccttagagtgcagaagctggggggagaggctgcttcgaagggcaggactggggataatcagaacctgcctgtcacctcagggcatcactgaacaaacatttcctgatggcaactcctgcggcagagcccaggctggggaagtgaactacccagggcagcccctttgtggcccaggataatcaacactgttctctctgtaccatgagctcctccaggagattatttaagtgtattgtatcattggttttctgtgattgtcataacattgtttttgttattgttggtgctgttgttatttattattgtaatttcagtttgcctctactggagaatctcagcaggggtttcagcctgactgtctccctttctctaccagactctacctctgaatgtgctgggaacctcttggagcctgtcaggaactcctcactgtttaaatatttatttattgtgacaaatggagctggtttcctagatatgaatgatgtttgcaatccccattttcctgtttcagcatgttatattcttataaaataaaagcaaaagtcaaatatg

SEQ ID NO: 37201 - DNA, 37771 bp, Homo sapiens; identical to SEQ ID NO: 36007

SEQ ID NO: 37202 - DNA, 46926 bp, Homo sapiens; identical to SEQ ID NO: 36818

SEQ ID NO: 37203 - DNA, 78044 bp, Homo sapiens
gagagagcgagacctgggagggagggggcctccagcagaaaggggcgggggaaaaggtgcaaaagcagcgtgggagcgccgggctggcttcctgcggctgctgctggtctgactgggaagcagcaagccaccactacgaactctcaagaggagtgggagtgcgggagtccagagctgcctctgggaagtctgcagtagttgagcaaaggggtcctcacgttcctgagagctgggcaggggggattttggaacctggggcagccaagaacgagcagccaagggtacgggagattagttgtgcacagagcagtgctggtcgggcttgggggtggctggtgggcactgcgtgggaaaccttggtttgtagttttcttggtttgcgttactcctgttgggtagaattaccctccgcgcctttgtacaagacacggtgtctcctggggcaaggaaggagccaggatggcctgggctctgaagctgcctctggccgacgaagtgattgaatccgggttggtgcaggactttgatgctagcctgtccgggatcggccaggaactgggtgctggtgcctatagcatgaggtgagtgagattttcccagaccctacaccttctgaataacaaaggcggatagacactaagaaaaggggttgagtgggaaggaggtgtatagagttttaaaaagctgtttacgattggggaaaagggacttgttcttttgtcgctttgagtagttagtgttgtggaagaaatggaaaaagcgattgtaggcgatatgaagcctgtgcagaatcagtggaagaaggaagtggtccctgattagtaaccagatgaatgttgagaggcttttgtgccaatgtgggagacttggggactgatggtgtatgtgtgggtaagtctgacgttgtgtgaagaagggttacatatagcataggaatggtatctaggaagttgggaaattgggagctggtgcttaatgatgaatattggttcgtttcttgttggaaagatatggaagtccttgatgaagaagtccgtacagctctatcttaccactagcttgctttaagactttacttaattctgggatttctgacttttaaaacataagctgtgaaatgaaaaagtgacgaagaaaacttaagatgcttctggatctttatgtatcaagccagttgttgataacagatgaaaaatctcctttcggccgggtgcggtggctcacgcctgtaatcccagcgctttgggaggctgaggcgggcggatcacttgagctcaggagttcgagaccatcgtggccaacgtggtgaaaccccgtctctactaaaaatacaaaaattagccgggtgtggtggcgcgggcctgtaatcccagccactcgggaggctgaggcaggagaatcgcttgaacccgggaggcggaggttgcagtgagcagagatggtgtcattgcactccagcctgggcaacaaagtgagactccatttgaaaaacaaagcaaaacaaaacaaaaactcctttgaaagcaacattattgcctatataacttgttgcatgcattggctgcttcattcctccagtatagtttatttcatttatagatgtgtaagaatcctgtatggaaatgttgaaacagctgcatcttaggggtagatggactataattgggtttcctaatgcattattaagacttaatctaaataagtgagtcaagagactagaacttaacattttcattgggtttatgagttcataggggaaagatgctttttagggggaaagtagatgcatttttcattctgataatgagatcttttaagagttatataaagttcctttattcctgccaattcaaagtagacttacctcactgaagtaaaattatgagttagaatttaatacttcaggccgggcacggtggctcatgcctgtaatcccagcactttggtaggctgaggtgggcggatcacgaggtcaggagttcgagaacagcctggccaacatggtgaaaccccgtctctactaaaaattcaaaaaattagacgggtgtggtggcgcacgcctgtaatcccagctacttgggaggctgaggcaggagaattgcttgaaccgggaggcggaggttgcagtgagcagagatcgcatcattgcactccagcttaggcaacaagagtaaaactccgtctcaaaaaaaaaaagggggagagaatttaatacttcagcatcttcaggaatctttacttagaataataaagactattattctaaataataatcatgcctgtaatcccagcactttggggggtggagactggaggatctcttgaagccaaggagttcaagacccgctctccacaaataaatcaacaaataaattacccaggcctggtggcatgttcctgtagccccagctactcaggagactgaggtgggaggattgcttgagcccaggagtttgagtctgcagtgagttgtgattgcaccactgtactccagcctggtgacagagtgagacctcatctcttaaaattaaaaaaaaagaaagattttaaaaattaagaaaaattggaaaaaaatactatcgttatataaatattttagtgattttcagggaaacttgagttccatatgttctatcatgcagtgttcttagtcatgagaaatttaactttggttttacctatccttgtttatgtaagtctgagcataaaaacagaggttaatttggtctgaaagtaagtgccctgaccctgaacttacacatgagcgtctgacataatatttgacaattttttatgctgttacttgtgtaaagatattcacagcaaaaagtttgattttgtttaggttaccagaggttaggctggaaataattaaatataactgtactcattataaaaatagttaacatcaccagcaaacatttgttaatctactaggtgcaataccatatgctcttgatactatgccatcttacatttaattaagagttctttacaaatcatactctgtgtttttcacagacattagaatggcttgcatatttacacatttagttttttcaacatcaaaatcaaatgcacaagtttcaaacatcactttgagttcttgagagtatagtgtgccaacattttaagtactttcttcttttcttttctttttgagacgggtcctgttctgtcactcaggctggggtgcagtggcaccatctcggctcagtagaacttccatctcccgggctcaagtgatcctctcacttcagccttccgagtagctgagactataggcatataacactacgcctggcttttttgtttttttcatcctttttttcatgtgttaggtacttgtcactattctcttgactttttttttttctttttgagatggagtctcgctctgttgcccaggctggaattcagtggtgtgatcttagctcactgcaacctctgtctcccgggttcaagcgattctcctgcctcagcctcccgagtagctggcactacaggcgcacgccatcatgcccggctaatttttgtaattttagtagagatggggtttcaccatattggccaggctggtcttgaactcctgacctcaggtgatccacccgtctcagcctcccaaagtgctgggggattacaggcgtgagccactgcacccagctctcttgacttatacacatttaatctattctattaatttgtgttaattagatattggtcttcaaattttagtattcataagagtcacctggacagcttattaaaaatacacttggggaccaggtgtggtggctcacgcctgtaatccaaacactttgggagactgaggtgggtggatcccctgaggtcaggagtttgagaccagcctggccaacgtggtgaaaccctgtctctaccaacaatacaaaaattagttgggcgtggtggtgcatgcctgtaatcccagctacttgggaggctgaggcaggagacttgcatgaacccgggaggcggaagttgcaatgagctgagactgtgccactgcactacagcctgggcaacagagccagactgcatctcaaaaaaaaaatgaaataaaaataaaaatacagttggggataggcatggtggctcgtgcctgtaatcccagcactttgggaggccaaggtgggaggactgcttgagctcaagagttttcatcagcctgggcaacatagggagaccctctctctactaaaaataaaaaaattagctgagtatggtggtgcctgcccctagtcccagctactccagaggctgagatgggaggatcgtttgagcccaggaggtcaaggctgcagtgagctgtgattgtgcctctgcactccagcttgggtgacagggtgagaccctgtctcaaaaaaacaaaaaccaaaccaaaacaaaacaccagtttacagggtcccatctccagtgattggggcacagactagaaatctgattatttattcattagagttgaggtcttgctttgtcgccaaggctggagtgtagtggctcaatcacagctcactgctgcctcgaattcctgagctcaagcagtcctcccaagtagctgtcccctaggctggagtgcacctgggggtacagtcatgagataccatgtctggctgatttttaaatgttttgcagagacagggtctccctatgttgaccaggctgttctggaactcctgggctcaaacagttcttcccccttggcctcccaaagtgccgggattataggtgtgagccactgtgcccagccctgatttttatttttttttaattttaattttgtcttattatttatgtttttggaggcgacatctcactcttgtcacccaagctagagtgcagtggcgtgattgtagctcattgcagcctcaaactcctgggctcaagtgatcttcctgctgcagcctcctgactggctaggactacagggtcacaccaccacacctggccagtttttctactttttgtagagactagatcttgctgtgttgctcaggctgatctctaactcccgaccttaagagatcctcccaccttggcctcccaaattgctgtaattacacatgtcagccgcggttcccaggcctatttctccttttaataagaccttggatcttagtgtgccaccctccagcaataatctttgccaactggttctaagagtcaatcaggccaggcatggtggtgcacacctgtaatcccagcactttgggaggctgaggcaggcagatcaccttgaggtcaggagttcaagaccagcctggccaacatggtaaaaccctgtctctactgaaaatacaaaaattagctgggcatgatggtgcacacctgtaatctcagctactcgggaggctgaggcaagagaatgacttaaacctgggaggcggaggttgcagtgagccaagatcgagccactgcactccagcctaggggacaaaagcgagactgtctcaaaaaaaaaaaatgtcaatcagtctgacgttctacatctttattagggaaaatactctctttgacaagcaatttgttttataaaatatcttctctgacacatttgttttaccctagtttattttctgttgcatcttatgatggtttcatcttcaaatctattaatttgtattttataaagagtcatcttaattagatttatttaatccttattagtggtccttttattattctttttttcttatatttttattgtggcacaaactttatactaaaaggaaaaggagattcattgtgaatacatgataagtgaaggagccagtcacaaaagaccacatacatatgattccatttctatgacatttctagaatgggcagatctgtagagaaaataaattagtggttgactagaactatggaggaggagggaatggagagggactactagtgggaatggagtttcttttcagggtgttaaaaatgttctaaaattgtttgtgatgatggttatgatatcaaactaggttcgtcctgcccacgtgcagcaagccaatcactatgatgatgggttttgcaaaagagacaagattttattcatagggctgctgaatgaggagacaggagagcaaatcccaaatctggcaccctgaaaatagggcttggcagtatttgtggggtaggacgcagggtggtctaaagcatggggaaaggtgattggcaggtaggaaaggtgaggtaatcaaggtttctgcacaagcgtaattgagctacattgctcttcataggccatgtgcagaaaatggcagtgttaacatgatctaagtgtggagtttttgtccctctgacatgaaaaggtcactttttgggcactcatgcaggtccagttgagggattggtggtctcaactgggtaagagctgtcccctaattcctgaaaaacaactttaagcatctgttaatatagtgacccacagtcagagatgtcatcttttttttctttcctttttttttcttttgaggcagggtcatgctatgttgcccaggctgttcacagatgttaacttttatttatttattatttattattattattattttttgagatggagttttcgatcttgttgcccaggctggagtgcaatggcatggtctcagctcactgcaactgcctcccagcttcaagcgattctcctgcctcagcctcccaagtagctgggattacaggcacataccaccacacccagctaatttttgtatttttagtagagacggggtttcaccatgttagccaggctggtctcaaactcctgacctcaggtgatccacctgccttggcctcccaaagtgctgggattacagatgtgagccaccatgcctggccaacttctttgtttgtttgtttgagatggggtctcactctgttgcccaggctggagtgcagtggcatgttcatggctcactgcagcttcgaactcccggggatcaagcagtcctgcctcagcctcctgagtagctgggactacaggcatgtgccaccatgccctactcagagtttttcataaatgccgttttagtgttaaataagtttccttctattcctagtttgctgaatatgtgtgtatgtgtgtgtttattgtggtaaaatacacataacataaaattctatcattttaaccctttaaaaatgtccagatcagtgtaattaagtacatttacgttgttgtacaactgtcaccatgatctgtcttcagaactttttcatcccaaagtgaaatgctgtacctattaaacactaacttcccatctccccccactccagcctctggcaaccaccattctactttctgtgtctatgaatttgactactctaaaaacctcatatacgtgggatcatatatttgtccttttgtgactgacttattcacttagcataatgtctttgaacttttgctgagtgtttttttttttaatcttaaaagggtattgaattttttcaaatatcttttctgtgtctgttgagatgataatgtggtgtatcacattgattgatttccttatgttgaaccactcttgcattcctgggataaatgttggtcatggtatataatctttttaatgtactgttggatccagtttgcagtttgctgttattttcttgaggatttttatttctatattcatatgggatattggtttatagttttcttatcatgtcttttttttaagagaccaagtctccctatgttgcccaggctggtcttgaactcctggactcaagggatcttcctgcctcagcctcccaaagtgctaggattacaggtgtgagccaccatgcccagcctgaattttatcgtatctttttctggctttggtgtcagggtgatgttggcctcatagaacgttaggaagtgttccattcttttctgttttttgaaggagttcgagtaggattggtgttaattctttgaatatttggtagaatttgccaatgcagccatgtgatactggacttttctttgttgggaggtttttgtttatcaattcaatctcttattataggtttgttgagacttttaattttttctgagtcagttttggtactttaatgtttctaaaaatttgtctcttttatctaaattatctaatatgctggtttagtcattcacagtattctcttataatcctttcatttatataaaattagtagtaatatccccagcttcatttctgattttatttattttcatttcatcttctttctttttctcccagtcagtctgacaagagtttgttaattactttttttttttttttttcgagatggagtcttgctgtgtcacccaggctggagtgcagtggcatgatctcagctcactgcaacctccacctcccaggttcaagcaattctcctgcctcagcctctccagtagctgggattacaggtgcctgccaccgtgcccagctaatttttgtatttttagtagagacagggttttaccatgttgaccaggctggtcttgaactcctgaccttgtgatctgcccgcctcggcctcccaaagtgctgggattacaggcgtgagccaccatacccggccaagagtttgtaaattctgttgatctttttaaataacaaatttttggtttcgttgattctactatttttattcttcttggtttttgtggttgttgttgtttgtttgtttttgagaaatggggccgtgctctgttacccaggctggaatgatgcagtggtgtgatcatatgcactgcaacctcaaactgctgggctcaagtgatcctcctacctcagcctcctgagtaactgagactacaggcatgcatcaccaaacccagctaattttttttttaatttcatagagatggggtctcactgtcttgcccaggccttgaactcctggcctcaagcgatcctcctgcctcagcctcccaaagcgctgggattacaggtgtgaggtactgcacctgccttatttttattctttatttcacttatctctgctctaaacattgttattccctccctttggttgggtccagtttgtgcttctttttctagttccttaaggtctgaagttagagtattgacttaaggtctttcttttttttatctctgtttttatttttattttttgtagagatgggggtttcactatggtgcccaggcttgtcttgagctcatgggctcaagcgattctcccacctcagcttcccaaagtgttgggattaaaggcatgagccaccataccctgccttctttctaatattttattattgttattattatttatttatttattttttgagacagagtctcgctctgttgcctgggctggagtacagtggcgtgatcttggctcactgcaacctctgcctcccaagttcaagcgattctcctgcctcagcctcccaagtagctgggattacagacatacaccaccacacccagctaatttttgtatttttagtagagacagggttttgccacattggtcaggctggtcttgaactcccaacttcaggtgatctgtccgccttggcctcccaaagtgctgggattataggcgtgagccaccgcgcccggccttattactattattttttaagacagggtcttgctctgttgcccaggctggggtgcagtggcaccatcacagctttcactttccagattcaggcaatcctcccacctcagtctcccaagtagctgggaccataggctcgtgccaccatgcctagctaatttttgtattttttgaagagacagggtttcatcatgttgctcaggctggtctcaaattcctgggatcaagtgatcctcctgccttggcctctcaaagtgctgagattacaagcatgagccaccatacccagccctgaaatgtttaaaatatggaatgcttcacaaatttgcatgtcatccttgctcagaggccatgctaatcttctctgaatcattccaactttagtatatgtgctgctgaagtgagcattaaacaacacacttaaacaccaaatgaataaaaagaggaaatcattagggagataagaaaatatattgagacaaattaaaaggaaaacatacataccaaaactcatgggatgtagtaaaaactcagagggaaatttagggttgtaaatgcttcagtgaactgtgattgtgccactgcactccagcctgggtgacagagtgagacccaaccacaaaaaaaatcaggatttcgttcaagagctcttgtacatcatggggactatagttaaaacgatatattgtatacttgaacattgctaagagagtagagttgattttaagtgttttcaccacaaaaaagagaagcatatgaggtaatgcatgtattaattaggttggtttagccattgatacatttgatggtaccccagtaggccccatggctctttcctttttcttttctttttttttttttttgagatggagtctagctctatcacccaggctcaagtgcagtggcgccattttggctcactgcaacctccacctcctgggttcaggcaagtctcctgcgtcagcctcctgcgtagcggggactacagccatgggctaccacgcctggcgaatttttgtatttttagtacaaatggggatttgccatgttggccaggctggtcttgaactcctgacctcaggtgatccacccgcctcagcctcccaaagtgctgggattacaggtgtgagccactgtgcccagcctctgttcctttttctttgttcgtttttttttcctgctccttagcttaagtaatttcaattctatcttcatgttcattgattctttcttctgcctgttcaactctgctgttgaatcctttagtgaaatctttattttggctcttgtatctttatgtccagaattgctatttgattcatttttatatttttaaaatatttttattgatattccttacttgtttatacattgttctcctgatttcctttagtttttttgtttgtttgtttgtttttgtttttcgtggtttccttcaactctctgagcatatttaagacagttaaaatctttgtctagtaggtccattgtctgggcttgctatggggtggtttctgtcaatttctttttttttttttttttttttttgatatggagtcttgctgtctcccaggctggagtgcagtggtgcgaagaaaaaaaattattattattattattattttttttgagacagagtctcactctgttgcctgggctggagtacagtggcatgatcttggctcaccgcaacctctgcctcccgggtccaagctattctcctgtctcagcctcctgaatagctgggattacaggcatgcaccaccatgcccggctaattttttgtatttttagtagacatggggtttcaccgtgttagccaggatggtctcgatctcctgacctcgtgatccacccacctcggcctcccaaagtgctgggattgcaggcgtgagccactgtgcccagccaatttctttttttttttcctgtgaatgggccgtatagtcctgtttctttgtttgctttgcaaatttttgttgggaagtggacattttgtgtgttgtaatatggtaactctgaaagtcagattccactgcctccctagggattactgttgttacttacgaaagctgcatttgtttagtgacttttccaaactgtctttgcaaagagtgtatatctggttgcatgcggtcactgaagtctctgttcttttatctctgtggtctttcaatgacttgacagagagttccttaaatgcttagatccaataagaaaagaaaacagaaagaaaaaaagagtgttctctccctttaagttcacttgtctagtgccactaggtaggcaacttcagtcgggggtgtgcatgtgtgaaacagtggccagcgctctggcagctcctcagcaatcaaaagtagtgaacgaaacacataacttcaatttttggaggacaaagcccctatttcctgccctagcaccagcaagctgcagcagaaactgccatcccaacagttggttaccacagggatgggagctagagaatgataagatgctattccaaatgccaaaattcactaaaatttaccaacttttttcttcatcaagcactcttctggacactgcaagtgtttcattagaccccagagtcctaaaatatcacctcaagcagttcttgccatctcaatagttactttggtgaagatactaactcctgaagttcctactctgtcatcttgacctatgtccttaattttcagcaccgatttagttgatccaaccctccttctcagtgtatgcgcgcacacacactcatccaatctgttctctacacagaaagaaccctttgtaagtgccagtgcctatgtttttttcacttaaaagataatttcattcttaacatggaaaaagcggagtaaaaaaaaaaaaattcacagctgggcgcggtggctcacgcctataatcccagccctttgggaggccaaggcaggtggatcacgaggtcaggagtttgaaaccagcttggccaacagggtgaaacctcatctctgctaaagatacaaaaaattagctgggcatggtggtgggcacctgtaatcccagccactcgggaggctgaggcaggagaatcgcttgaaccctggaggcggaggttgcagtgagcgtaaattgtgccaatgcactccagcctgggtgacagggtgagactccgtctcaaaaaaaaaaaaaaaaaaaattcagagaggattctgggaagttgataaagtaggaggtaccagaaatctgtctccccaccaccaagataacagttgctttggcagaatctgtctgatgcatctcctttggaactctggagtttattgaaatcttacaactgtgaggaattaactgcaatttaccatccaatcctggatggtaaattttggttaatttcagtcagtttcagcgcttagcacaatagcagctgcccatccacatccctcagccccatggcaggcagctgtgcacatgttcctggagcagcttgcatgtagtttgtggaacctaaggtgggcagaaaggaccatctcttccaaatatgaggaatctggatcaagtgcagtggctggtccccaggactttgggaggctgaggcgagaggattgcttgagcctgggagtttgaggccagcctgggcaacatagtgataccctgtctctaaaaacaaacccaaatttcagaaatctgtgctccggtcggaattgatgcttctggccaggcacggtggctcacgcctgcaatcccagcgctttgggaggctgaggtgggttcgagaccagcctcgccaatgtggtgaaaccccgtctctactaaaaatacaaaaattagctgggcatggtggtgggcgcctgtaatcccagctacttgggcggctgaggcatgagaatcgcttgaacctgggaggcgggagtttgcagtgagccaagatcacgccattgcactccagcctgggtgacagagcgagactcggtctcaaaaaaaaataaaaaataaattaaaaataaaagaaagaattgctggttttgatcacagagttgcaaagaggcaatggttattgttgcatctcaccactttgttgcaaattcccccactaccaccactgaagtgatgtccagtagatttctttttttttttctttttcttttttttttgagacagagtctcacaatgatgcccaggctggagtgcagtggcatgatcttggctcactgcaacctccgcctcctgagttcaaacgtttcccctgcctcagcctcctgagtagctgtgattaaaggcgcctaccaccacgcctggctaattttttttttttttttttttttggatttttagtagagagagggtttcaccatgttggccaggctggtcttgaactcctgaccttgtgattctcccgcctcggcctcccaaagtgctgtgattacaggcttgagccaccgcacctggccgatgtccaggagatttaaaggactggcaccatactccccgtctccatttttttttcttttttcccttttgagagccagatattgatgactaggggctgggtgtggtgggtcacgcctgtaatctcagcactttgggaggccaaggctggtggatcacttgaggtcaggagtttgagaccagcctggctaacatggtgagaccctgtctttactaaaaatataaaaattagctgggcatggtggctcatgcctgtagtcccagctactcgggaggccgaggcaggagaatcacatgaacctgggaggcagaggttgcagtgagccgagatcgtgccactgcacttcagcctgggcgacagagcaagactctatcttaaaaaacaaacaaacaaaaaaacagatactgatgactaggatgatcaaaaggaaccaaatagatgggagaaattaagaagtcattatgtatgcccaggggtgggtggaagcctcagtaaagtcatgtactgaataatgatgttttggtcagtgacagaccgaatagataacagtggtcctataagattataatggaggccaggcatggtggcttatacctgtaataccagtgctttaggaatgggggggctctcttgaggtcagagttcaagactggcctgggcaacatagcaagacctcgtctctacaaaaaataataaaagaaggaaaattagctgggcatggtgatatattcctgtagtcctagctactagctactcaggaggctgaggtgagaggattgcttgagcccaggagtttgaggctgcagtgagctatgattgtgccacatcactccagccttggtgacagaacaagactctgtttctaaaaaaaaattaagattatagtggaaaaaaaaattaaaatgggtcgggtgcagtggtttatgcctgtaatcccagcactttgggagttcaaagtgggaggatcacctgaggtcaggagttcgagaccagcgtggccaacatggcaaaatcctgtctgtactaaaaatacaaaaattagtacacgcctatgatcccagctacttgggaggctgaggcaggagaatcgcatgaacccaggaggcaggcggtggttgcagtgagccaggatcatgccactgtactccagcctgggcaatagagcgagactctgtctcaaaaaaaaaaaaaaaaaagaaaagaaaagaaaaaactcaaattactgaaatactaaagataaaaatgaaagtgggaatattaccctcaattccacagaaatggaaagggtaggctgggcatggcagctcacatgtgtaatctctatgcttttgaaggctgaaatgggagtatcacttgagcccacgagctcaaaccagcctggacaacatactgagaccctgtctatacaaaaaaataacacattcctgtagtcctagctactcggaaggctgaggcagaaggattgctttagtccaggaattcaaggctgcagttaaccatgattgttccacggcattctacctagggtaacagagcctgtctcttaaaaagagagatcatgggccgggcacagtgtctcacgcctgtaatcccagcactttgggaggctgaggtgggcggatcacttgaggtcaggagtttgagaccagcctggccaacatagtgaaaccccgtctccactaaaaatacaaataagaaaattagccggccgtagtggcacatgcctgtaatcctagctacttaggaggctgaggcaggagaatcacttgaacctgggaggtagaggttgtagtgagctgagattgcaccattgcactccagcctggacaacaagagtgaaactctatctcaaaaaaaaaaaaaagaaaaaaaagagattataatagactacgataagcaattgtaggctggtctggagatagtgaattgtcttaattgattgttgacagtcagttacagatagaacttgttctactctttcccctatccttactactgcacttgactagttttttggggaaaaagattaataaaccaattgtacaccaacaaattgggtaacctagatgaaatggtcacatcctagaaacacaaaacctaccaagactaaactactaagaaatagaaaatgtaaatagtctcataactcatagggagattgcatttgtaatcgaaaatgtcccaacaaagaaatctctggacctgatgacttcgctggtgaattctatcaacatttcaagaagaactaacaccaatccatctcagacttttcaaaacattgaagaggaaagaacactcactaattcattctgtgaagtcagcattatctttgacatagtttggatatgtgtccctccaaatcgcaagttgagatttgatctgcagtgttggaggtgggtggggcctagtgggaagtgtttgggtcatgggggtttatccctcaggaatggcttggtgtggtccctatggtaatgagtgcatttttgctctattagtttactcaagagctggttgtttaagtgtggcacctcccccccccttgcttcctctgttgccatgtgacatacctgctcttccttcaccttctgccatgattgaaagtttcctgaggtacttatcagaagcagatactggcaccataagtatctgcttcttgtacagcctgcagaaccataagccaaataaacctctttactttgtaaattacccagcctcaggtattcctttatagcaatgcaaaatggatgaatagtcttgatgccaaagccctacaaagatgctataagaaatctatggactaatagttctttcttttttttttttttttttttttttttgagacaaaaagagtctcactctatcactgaggctggagtgcagtggtgcaatcttggctcactgcagcctgggcctcctgggttcaaatgaatctcgtgccaaagcctcccaagtagctgggattacaggcatgtgccaccatgcccagctaatttttaaatttttagtggagacggggctttgccatgttggccaggctggtctcaaactcctggccttaagtgatccacccaccttggcctcccaaagtgctggctttacaggcgtgagccactgcgcctggcctatagactaacatttcttagaaacattgatgtaaaaatcatcaacaaaataccagcaaaccagatttaacagcatattaaaaggattatacaccatgaccaataagcacatgaaaagatactcaatgttgctaattaaggaaatgcaagtcaaaactccaagatgctacctcacacccattaggatggctgctatcaagaacagcagaaaataattgttgggaaggacatggaaaaattggaaccactgtacactgttgttagtcgtgtcaaatggcatagcctatgtgaaaaactggtggttcttccaaaaattaaaaataaaattaccatatgtatcaggattttccagagagacaaaaccaataggatatagatggatggatgggtgaatgagaggggatttattaggggaattggcttactcaattatggaaactaagaaggctgtgataggccatctgcaactagagaaccagggatgccagtagcatggctcaatctaagtctcaaagcctcagaaccagggaaaccaatggcataactctcagaccgaggctgaaggcctgaaaacctgagaggctactggtgtaagtcctggggtccaaaggctggagaacttggagtactgatatcaaagggcaggagaaggatgtcccagccccaggagaaaaaatgaatttacctttactctgcctttttgttctatctgggcacccagccctttagatgttgccctcccacattgaggatggatcttactccctcaatcaacctactcacacaccagtcttctctggaaacactctcacagatacagtcagaaatcatgctttacccgctttttaagtatcctttaatccggtcaagttgacacctaaaaatcatcacaccatatcatcctgtaattctacttgtgggggtttagtagttcccccttatcctaggtttcactttctgagatatcagttacccaaggtcaactgtggcctgtaaaaaaataggtgagtatagtacaataagatattttgagagaaagagagagaccacatttatttatttatttagagatggactctcactgtgtcacctaggctggagtgcagtggcaccatcttagctcactgcaacctccacctcccaggttcaagcaattcttgtgcctcagcctcctgagtagctgagattacaggcacctgccaccacgcctggctaatttctgtatttttaatagagatgagattttatcatattggccaggctggtctcgaactcctgatctcaagtgatccacccgcctcggcctcccaaaatgctgggattaccggcgtgagccactgtgcccagccacatttatataatttattaccatatattgttatagttttatttttagttgttgttaatctcttactctgcctaatttataaattaactttaccatggatatacatatataggaaaaaacacactatacggggtttgatactctccctggtttcacacatccatgggagtcttggatcccccccatcagataaggatgacctaatgtatactcaaaataattgaaagcagggtctctaagagatatttgtgtacttagtgttcataggtatagcccattgatcaagggatgaatgtataagcaaaatgttgtaagtacatacaatggaatattattcagcctttaggatggctgctagtaaaaaaatcaaagtaacaggtgttggcaagaatgtagaggaattggaacctttatgtattgctggtggcaatgtaaaatggtgcattcactgtggaaaacagtatggtggttcctcaaaaaaattaaatgtagaattatgatacaactgtttcacttctgagtgtatattcaagacaattgacagcagcgacttgagcagctatttgtacacccatgtttaacaacattattcacaacagccaaaaggtggaaggaacctagataaacaaaatgtatataatgtatacatatgatggaatattattcaggcttgaaaaggaaggagattctgatgtgtaatataatatggataaactttgggacattatggtgtgtgaaatgtcagacacgaaatgataaatatatgattccactgccatgaaatacctcaagtagtcaaattcataatgatagaatgttgaatagtggttaaccaggagaggggagtgagtagttcttgtttaatgggcacagaattttagattgggatgatgaaaagttctgaaaatggatagtggtgaacgtacttaatagcactgacgtgtatacttaaaaatggttaaaatattacagattgaagcattgatatagacaacaaaaaacaaaaaaaaaaaaggttaaatgataactttttttttgagacagggtcttgctctgtcacccaggctgcagtgcagtggcacaatcacaattcactgcaacctcaaactcctgggcccaagttattcccctgccttagcctcctgagtagctgggactacaggtgtgcaccaccacacctagctaattttttaaaaattttagagagatggggtcttgctatgttgcccaggctggtctagaattggcctcaagccatccccctgccttggcctgccaaagtgctggaattacaaacatgagctgctgtgcccagccaacactgtattatgtatattttactacagattttaaaaatggaaaacaaaaagaatgcaaatagttctcctttgcccaagtcctgatccctcagctagctgcgaaagtatcaccaccaatgatggttgccaggggctagttactgttcagtggctataagagtttcagccttgcaagatgaaaagagttctggagatggatgatggtgatggttgtacaacaatatgattgtacttaataccactgaactgtccacttaaaagtgattaagatagtaaattttgttatgtgtattttatcacaataaaaagcagttgggaaaaaataatttcagacttgtataatatttgcatgaatactacaaagaatttgtgaaaacctttcacctggattccccaaaggataatattttaatatatttgctttatccttctctttctcagaatttcttacacactcagaattatttttttctgaatgatttaaaggtaaaaggcagatgtggcgccccaaacacctaaatacttcagtttgtattttttaaaaacaaattctcttacataactatggtataatgatcaaaatcgggaacttaacgctgacacaatgctataatctatagaccttattcagattttgtcagttgtcctaataatatccattatagtaaaagaatatccaatatgatgtgttgattcagtgaccttgtctctttcatctcctttaatctggaacagttcttgttccttgtatttttatgacactgacaatttgataagtgcagggtagttattttgtagagcatccttcaatttgtttttgtctgttgtttcctcgtggttagattcaggttatgcacgttgggcattaatacctaagaagtgatgctgagttctctgcgtatcatattaggatgcacatgctatttattgcttctattactggcagtgttacttgagtggtagggtccagttttctccatcataaagttattcatttgccttttgtaataatgtcttgggagatgttttgagactatgtaaatatcctgttctcaaacttttcacctgttaattttagcattcagatgattcttgccctaatcagttatctttatgatcgttgccaagtgattttctctttttgccttccctctacatttattagttggctttctactgtaagaaagagctttctgttcctattattttttatcaatgtagactcatagattcttactttattgaatacaatgtaatcttctatcactatatattttgatgacagtgttccaggtttggccagcaggaatcccttcaaaatgacttgcactcagagaagccttttaaaattaggtattggccgggcgtggtggctcacgcctgtaatcccagcactttgggaggccgaggcgggcggatcacaaggtcaggagatcgagagcatcctggctaacacggtgaaacccagtctctactaaaaatacaaaaaattagccgggcgtggtggcgggcgcctgtagtcctagctacttgagaggctgaggcaggagaatggcgtgaacccgggaggcagagcttgcagtgagccgagatcgcgccactgcactccagcctgggcgacagggagagactctgtctcaacaacaataacaacaaaaaattaggtcttattaatactgtcctaaggtaactgttaatatcacccttcctcactcaccaaggtgtacctgttttagtgataaattatatgatcactttctttaaaatgttcatcagatcatgctacttttctcctaaaaactgtccagtggcttcacatctcactgaataaaagccacaggtctgtcaaggatccatatggtctgctcctccagccattgaatatactcttcccctggcttgctctgctgcagccgcacctggtcttagggctccagtctcacctcagtgtctttgcatttgcagttactcttcccgaaacattcctgtatgttccttacttcctttaggtttctgctcacatgtctttttatcagagaggccttctaatgtccttcacgtaaaatagcaagagcctcctccccctcaccagcactccttgctttctttaccccctctgctttatttcttccctaacatctgatgtgtaattcatttgttggcttctctccccaacttcatgcttcataaaagaagggattttcttttgttctctaccctctgcctactgttagaatagtgcctaataagtagtttgcgctgatgtgttgaatgaatgaattcactatctccattttcttaaaaaaggcaagtactatagcagttcctgaggcaactatctctcttcattgagacctaagtctctttattgagactgatttttgcccttttgttgttgttgtttgctgtgatttttcagtactttttttcttcatttctccccacttcaattatcatctgtccatcttccaaatcttctctctttgtctcagagttggtcagttgttactgttctttactttccctttcattctaagtctgttatgatggacagtgtatttagatgagattcgccctgttttgctgcaaacgttatccattactttttaaattttaaaattaaaaagaatttttaattcattactttttaaaaaaaattttttttctttttttttcgagatggaggctcgctctgtcgcccaggctggagtgcagtggcacaatctcggctcactgcaacctccgcctcccgagttcaaacgattctcatgcctcagcctcccaagtagctgggattccaggtgcctgccaccacgcccagctaatttttgtattttcagtagagaagaggtttcgccatgttggccaggctggtctcaaactcctgacctcaggtgatccgcctgccttggcctctcaaagtgctgggattacaggcgtgagccactgcactcagccatacttcactactttttaaaagatggcactgctgtaaaaatataaagacatgctgagaatgattaagtgcaaattcaggataatgttgcctctgggagttggaggggatgtaactgaggaaaaatatagggggcttcaactgttaatgctgtatcttaagctgcctagagtgtacacagtcatttgttacactgttttatcttttttatgtctaaaataccttataacaaattaaaggctaggtgcggtggctcaccctgtaatcccagcactttgggaagttgaggcaggtggatcacctgaggccaggagttctagaccagcctggccaacatggcgaaaccccgtctctactaaaaatgcaaaaaattagctgagcgtggtgatgcatgcctgtagtcccagctactcaggaggatgtggcacgagaatcgcttgaacctgggaggcagagattgcagtgagcaaagatcgtgccactgcactctggcctgggtgacagagcgagcctccatctcgaaaaaaaagaaaaaaaattaagaaaaaatttatctaacacgtaatctatttcttcattcttttaagttatgctgttactcctttttactgtaagttcataaattttctttgctttcctacacttttcttgtcctcctcttattatggaaaacaacctacaaagcagcagtgctgccattccttccttctacttttttttttaaggtttttggggaacaggtagtgtttggttacattaataagttctttagtggtgatttctgagattgtagtgcacctatcacctgagcagtgtacagtgtacccaatgtatagtcttttacccctcacctcttcccatgctttccccttgagtccccaaagtccattgtattatacttaaacatttgtacctcatagcttagctcccacttatgaatgaaaacatacgatgtttggttttccattcctgagttacttcacttagagtaatgggctctagttccatccagcttgccgcaaatgccattgtttcgttccttttatggctgagtaatattctatggtgtatatataccacattttctttctttctgtttttttttttttttttgagatggagtcttgctctgttgctcaggctggagtgcagcagcgcagtcttggcacactgcagccatcacctcctgggttcaagagattctcctgcctcagcctcctgagtagctggaattacaggtgcctgacaccactccaggctaatttttgtatttttagtagagacagggtttcgccatattggtcaggctggcctcaaagtcctgacctcaggtgatccgcccacctcggctttccaaagtgctgggattacagatgtgagccactgcacctggcctatataccacattttcttttctttttcttttttttttttttttgagacagagtctcactctgttgcctaggctggagtgcagtggtgcaatctcggctcactgcaacctcttcctcctgggttcaagtgattctcctgcctcagcctcccaagtagcctggactacaggcgcccgccaccacgcctggctgatttttgtatttttagtagaaatggagtttcaccatattggctaggctggtcttaaactcctgaccttgtgatccgcccgcctcgcctcccaaagtgctgggattacaggtgtgggccaccacgcccggccaccacattttctttatccacttgttgatgggcatttgggctggttccatatttttgcaattgcaaattgtcctgctataaacatgcgtgtgcaagtatctttttcatataatgacttcttttcctctgggtagatacccagcagtgggattgctggatcaaatggtagataaacttttagttttttaaggaatctccacactgttcttcctagtggttgtactatttacattcccagcaacagtataaaagtgttccctttttaccacatccatgccaacatctatttttttttaattttttgattatggctattcttgcagaagtaaggtggtattgcatggaggttttgattttcatttccctgatagtgatgttgagcatttttccatatgcttgttggctatttgtatgtcttcttttgagaattgtctattcatatccttagccactttttgatgggattgtttgttttttttctagctgatttgtttgagttccttgtggattctggatattagtcctttgtcagatgtatagattgtgattttctcccactctgtgggttgtctctttactctgctgattatttctgctgtgcagaagctttttagtttaattaagtctcatctgtttatctttgtttttgttgcatttacttttgggttcttggtcatgaggtctttgcctaagtcagtgtctagaagggttttttccaatgttatcttctagaatttttatggtttcaagtcttagatttaagtctttgctctaccttaagttgatttttgtataaggtgagagatgaggatccagtttcattctcctacatgtggcttgccagttatcccagccttccctctactttgtcaccttctctctttccccccccacctcttcctatcctggtctccctttatctgccttgttcatagtagtttccatttgttgctgatagtcgactctcactatgcctcaagtagaacctaacagaataaacttgggactttgtgtacacaaattggtgttccagttttcctttcaccaatggtttaattttctttctttctttctttctttcttttttgagatgaagtcttgctgaggctggagtgcagtggcgcaatctcggctcactacaacctctgcctcctgggttcaggtgattctcctgcctcagcctcccgagtagctgggattacaggcatgtgtcaccacacctggctaatttttgtatttttagtagagatggagtttcactatattggccaggctggtctcgcacttccgacctcaggtgatctgcctgctttgggctcccaaagtgctgggattacaggcgtgagccactgtgcccggcctaatgttttatatgcacagcaaatcctggtttattccctcagtcactaagcagatttttactctatcattcagcaaacacttgagtgcctactatgtacttggttttgtacaacttgattctgtagctttgtcttcaccatatgctcccatatgcaggtgctgaatctaaataaacaggtttctgtctttcatttgcttacaatttgatggagaagataagacatgtatataaataaatgtgatacaggctggaaataaatatgctaaaagcacttgaagtgctataggaattcagaacacagaaatactacttctgcctcctaaggtggtatctgaaagaagggtaagatttggccctgcaaaggtggaggagaaatatattccaggcagagggattataggagcaatggaattgttggattatgagcttgctgtatcttcctacaagataatgctaaattattgttctagtatacttagaggtcaggtgtttcggttctgcatcctagccattattttaattgttcactgttgtaatttttgtgtggaatagtattttattgtggttttaatttgtattttcctaatttcttatgaggccagcaccttttcatatgtttgtgggccactgatgttttctcctaagaagtaagtatttgagttttttgggggtatggggtgggggagggaggtttggcctttttcatattaatttataggaatcttaaatatattttattaattttttttttgagataggatctcgccgtgtcacccaggctggagtgtagtggcacaagcttgactcactgcagcctcaaactactgggctcaggcagtcctcctaccttagcctcccgagtagctgagacaacagctgagcatgccaccatgcctggctaattttttatttttgtagagacggagtaatctacaaaagtgttaagattacaggtgtgagccattatggccagcctcaaaaatattttagatacttatcttttgtcagttttgtatgtagtcagtatattctgccagtttgtggcttgtcatttccctctctttatgtgtctttggttctaaggttctttttttggtggggagggggaagggacagggtcttgctctgtcgaccaggctggagtgcagtggcaatcacagctcactgcagcctcgaactcctgggctcaagtgatcctcctgcctctgcctgtcaaggagctgggaccacaggtatgcaccaccatgcctggctaattttttgtattttttgtggagacgggggtctccttatgttgctgaggctagtctcaaactcctgggctcaggcagttctcccaccttgacctacctcaaagtgttgggattacaggcattagccaccatgcctggcctaaagttcttaacttagtataatttatgaatcttttatggtatatgatttttgagtcttgtctaagaaaatcttttttttttttttttttttttttttgagatagtcttactccatcacccaggctggaatgcagtgagtggtgtgatcttggctcactgcaaccttcacctcctgggttcaagcaattctcctgtctcagcctcccaagtagctggaattacaggtgtgtaccaccacacccggctaatttttgtatttgtatttgtatttttttttttttctgagacagagtctcactctgtcccccaggctggagtccagtggtgtgatctcagctcactgcaacttccaccccccaggttcaagcgattctcctgcttcagcctcccaggtagctggaattacaggtgtgcaccaccatacgcagctaatttttgtatttagtttttttttttttttttttgagatgaagtctcactctgtccccgaggctggagtgcagtgatgtgatctcggctcactgcaacctctgcctcccaggttcaagcgattctcctgcctcagcctcccaagtagctaggaatacaggcgcccaccaccatgcccagctaatttttgtatttttagtagagacagggtttcaccatgttagccaggctggtctcgaactcctgacctcaagtgatccgcccacctcggcctcccaaaacgttgggattattataggcgtgagccactgcacctggcctaatttatgtatttttagtacagacggcattttgccatgttggccaggctggtctcaaacccttgacctcaagtgatcctcccgcctcagcctcccaaagtgttgggattgcaggcatgagtcaccgtgtccagtgttgtctaagaaattcttgcttatgctgaggctgtcaagatattctcctgtattgtctttttaaagttttctatgtttgcttttcacactttagtctttaatctacttaaagttgattttgtattgggtgttgctaaggctccaattccatttttttcacctacaaatgtctaatttttccagcataatttattgaaaagtccatcttttgccactgatcaactatactagctgtcataaatcaaatttctatatatgtggggtcagtttatgggttctgtgttctcttctataggttaatttgtctatctgtttcaataccatgctgtcttaattactcaagtttttaagtaattgttggtatctggcagggcatagccctcatctcattctttttcaggagtatgtggcctttcttggttcgcttattgatagaaattttagaatggctgggtgcagtggcacacacctgtaatctcagcattttggaaggctaaggtggaaggattgcttgagcccaggagtttgagaccaggctaggcaacataaacagaccctatctctacaaaaaaattgaaaaattagccaggtgtggtggtgcacacctgtagtcccagctactcaagaggctgaggttgggggaggattgcttgagcctcggcagttgaagctgcagtgagccatgattatgccactgcacttggcctgggcagcaatgagaccctgtctcaaaaaaaaattttttttaagaatcatcttgtcaagttgaatctattgcaatatttattggaattgaacctatagatgaatttgggataaattgacatcatcggcatatgtatccagcctttcaatctttgaacataatgtaaccctctatttaggtcttatctgaatatttcttgaatttgtctgctttgtatctgtacttttgttgctgggtcaaattctcattgtttcttacctggactgttgaatagctttcaactccccatctttggtctatcttttccaagagacagcctagcatagtgacatctgaaaccaaacttaggggtttgaattctggccccaacaggattgggcaaattgcttaacacctccatgcttctctttaaaatggaggtaataataatagtacttaccttgtgagattgttatgaagattaaatgagtttatatatgtaaaataattagggtagtgtcaggcaactagtaagtgctcaataaatgctagcaattattactgtcatataaattctagtagcttacctccagagcctgtcctctaaatttctatcctctactgaagagaacatgaactcaagatatattttatagataaaaatgtataggacttgctaagggacatgaggataagggaaaggatcaatctaggatgccttcaatagttctggtttgaatattttgttggatggtgttgccatttgctgagaaagggggataggctagttatgtttagaataagatcaagagttttatattggacttggtccatttggtatctctgagagacatccaaaaggcagtgttaggtaggtattaaatatgcaaatcaatatacaagtctaggcctagtagacacatttgggagtcatcagaataaagagatacttaaatgtatgggagttaatgagatcttctgaaagtgtagaaagagaagagccaaaaatcaagtccagagattttgtagagggggagggttgccacaagggagttgagaagatgttgccagtgaggtaggaagaaaatcaggtaagagtattcaggatccagagaagagagtggtaaatttaggagttacagttgggttgagtgctcctgaaaacagaagtaagatgagccctgagaagtgaccactgagtttggctacatggaagtcattggtgaccatgacaagtacttgccatggtgtgttgtagtgaaagctgaactgtcttggttgaaggaatgaattggaagtgaggaaatagagattctgtgtataaagacttttagttatgaaaggtacagagaagtatagcagtagttgaaggcggatgtgggaagactttctttttaaaagatgggaaatactcaaatgtgatggtatgctaatgggaatgatccatggaggaagattgatggtacatgtattgggataatcagaggaaaaaggttcttgagaattgagaagggatgggatccaagtctgtgggtaaggattagcctttcccaggaggaggaacttagccttcgttgcatcaggagcaaaagagaagatggtttcaagggcatataggtttgtaggtttggtagggaaagaagatgcttaaaaatgtatgagagatttaattaattaaattgtacatgaagaagtaattgcagtaacatgcagacccgtaaagaagaatattcaggagatcttcacagggatcatagacagccaggtactcaatacagatttgataataaatggtagcagcattgtcttgactattcatccacagtatatcccaatcatgtttgccaagtagcctaattataaagactttttttttttttttttttttttttgcgacagagtcttgctctgtcacccaggctggagtgccgtggcacaatctcggctcactgcaatctccgccttggggatttcaagcagttcttctgcttcagcctcctgagtagctgggattacaggtgtgcaccaccacgcctggctaatttttgtatttttagtagagacggggtttcaccgtgtcagtcaggctggtctcaaactcctgacctcgtgatccacccgcctcggcctcccaaactgctgggattacaggcgtgagccactgtgcctggtttttttttttttttttttgagacagagtctcactctgtcactcaggctggagtgcagtggcgccatctcggctcactgcaacctctgcctcccaggttcaaacgatgcttgtacctcagcctcccgagtaggtgtgattacaggcgtgcgccaccatgcccagctattttttttttttgtatttttagtagagatgagttttcactatgttgtccaggcttgtctctagctcctggcctcaagtgatctgcccacatcggcctcccaaagtgctgggattacaagtgtgagccaccctgcccagctaaagacccctattttttatatgggcatattcttattattttagttatttaaaaaaatagtgtttattaagtacctaggatggccaggtcttgttgataatagggtgacaagacaaagaagatccttgcaagagtagagcttgcattcctatggaagaagtacagagaagaaactataaacagatagataaggaaatttcagaaagaagtgccataatgaaaatatatggagtcttctttaggtagaatgatgagtgaatgtctctctgcagaggtacacacttgaacacagacctaaataataaaaagaaccacacagaaatctggaaatttatttagccttctgggcagaaagatcagctatattgcagaatcttttagttcttcccccacttccccctgcttttttttttggtcccagctactcaggaggctgaggtgagaggattgcttagacccagaaattcaagaccatcctaggcaagatggtgagaccccatctctaccaaaaaaaatgtaaaaaatattatttttttattattattatcattatttgtattttttagacagagtctcactctgttgcccaggctggagtccagtggtgtgatctcagcgcactgcaacctctgcctccccggttcaagcgattcacctgcctcagcctcccaagtagctgggattacaggcgcctgccaccacgcctggctaatttttgtatttttagtagagacagcgtttcaccatgctagccaggctggtctcaaactcttgacctcagatgattcacctgccttggcctcccaaaatgctgcgattacaggtatgagccactgtgcccaaccaaaaaatttaaaaattagatggttgcagtagtgtgtctctgtggtcccagctattcaggaggctatggcaggaggatcccttgagcctaggagtttgaggtggcagtgagctatgatagcaccactacactccagcctgggtgacagtgtaagaccctgtctctaaaaaatgaaggaaagaagggagggccgaggtgcagtggctcacacctataatcccagcactttgggaggctgaggtgggaggatcacttgagcccaggattttgagactagccggggcaacattttgagaccccacctctacaaaaaaaaaaaaaaaaaaaaagaaaaagaaaagaaagatagaaaagaaggaaggaagaaaaaaggaagaaagacagagtctcactatattactcaggctggtgttgaattactgggctcaagtgatcctccgcctcagcctcccaaagtattgggattataaatgggagccaccatgcctggcctttgagtccttttcaggttcttttagtgaaatcatagttaatcaatactatcattttattagtatgagttgtgcaaatatccatgcataagtgttagagtgcaacacctttagaaatatctttggagcatcagtgggagcttttgattatttatttttcccctcaggaatgttttgaacagttgctacttaatatgaggcattgagtgttgataaacaaggataaaacttggataaaatgagtttatttgcttactatttccctactgcctgaaatagttccaggcatatcagtgttcataatgtatttattgaatgaatgaataaactcatttgtaaatccagtatttaatagctgtgtaaccttgggcacatcatttaacatttctaattactgtagcctcagttccttcagttggaaaatggtgaggaggagacaattcctcctacctcacagcattattgtatgaattaaatggaaatttatgtgcaaaaaatgaatcatagcaattgagttgaggtagaagagagcaggtggaccccaaggcctgggggcaagggaaagaactgcagtttgtctgctgaatcttttaaaaaagtcaaagaggccaggtgcagtgtctcctgtctgtcatgtcagcactttaggaggctgaggcaggaggatcctgagaggccaggagttcagcaccagtctgggcaacatagtgaggccctgtctgtacaaaaaattaaaagatgagccaggtgtggtggtgtgtgcctatagtcctagctacttgggaggctgaggctgaggtgggtggattgattgggcccaggagtttgagacttgcagtgagctatgatcacgccactgctctccagcctgggcaacagagcaagacgccgtctcactatacatatgtagataaagggaaaagagagatgggaagtatggtgagagatgagactgaaaaggtaaactgggcccagttttgaagagttttgggagccatgttgaagagttagcactttatcatgattgcgttgggaaaccactgaagctttataaacagagaagggacatttctagatttacctttttaaaaagttactctggctgcaggttagaggataatgataaaaagctagttatcatgcctgaggagggttgaggcttagtaaactgggtgtcttctgctctgcatatccttagaaatacaaatttactctctgtctataaaagacaaggggcaaataacatttctgctttgattgcatcatcaggtctaactggttacatctctagggaatttgctggccattttagaagaaaaggccttccttcatcagaaatgtggtctggccgggcatggtggctcacacctgtaatcccagcactttgggaggccgaggctggtggatcacctgaggttgggagttcgagaacagcctgaccaacatggagaaaccccgtctctagtgaaaatagaaagttagccaggtgtggtggcgcacacctgtgatcccagctactcaggaggctgaggcaggagaatcgcttggacccgggaggcggatgttgtggtgagccaagatcatgccattgcactccagcctctcaccattgcactccagcctgggcaacagagcgaaacttggtctcaaaagaaaaaagaaatgtggtctgaaggaggagaaatgttcgtaagtcctatcacttttagcataaaagaggagagatggttagagcctatttaccatttcataggactaactattctggtactttcaggattttcctgaaagtcatcggcaattaaagccttaaaacacagaaaactaggccaggcacagtggttcacacctgtaatcccaacaatttgggaggccgaggcggttggatcacttaaggccaggagtttgagaccagcttggccaatgtggtgaaaccccatttctactaaaaatacaaaaattagccaggcatggtttacatgggattataggagtgcgcctgtaatcccagctactcgacaggccgaggcgggagaatcacttgaacgtggaagtcgtaggttgtagtgagccgagatagtgccattgcactacagcctgggcgacagagtgctactccatctcaaaaaacaaacaaacaaaacacacacagagaaaaatagaaaataaataaatacacagaaaagtgtctgtgcttgcctttcattaaggggaggaatgagggactagagagattgtcctactttgaagccaggcatggtagggagtacaggatgagcaagacataagaactctcaagtatagagaggtaatagtgatgcttgccagtgaagatggaagcctgactgcaagagggaagaaagcatgagctggtagacattttggatcggaaaagaagctttgaggctcagcactataaagggctaagtgtggattcccttagtcccaagaaaacaaaacaaaacaaaactgttggtgttttcccagttatgccatactatgatgatatacatttgatctttgaatactgaaatgggagttctattttctgtatcaaaatagtcagattcccttcaacatatagcctatgaatattgctgcgagttgccattttttgcctaactggaaagagtcagtgatttcagaaatttaataaaagagcctagtactaatgatgccacaggtgatgttttcaattagcagtgttttaatgagatctgtaggctggtaaatgctaatcctataatgtatgaaaaaaactaagaaggtaggcctatatctagtaaatctcctgaggtagggctttgctgattcagatttctttgattaaacttttaatatcttacaagctccctggaagtaaatttgtatctgacacagatacttttcagcttccaaaataaataaggttagcaaaaattagatgtgtttagtgactttataagctaaaggaaaataaaagcacatttctggtaggtataaataattggtagttggcaaataattcagcagagtggaaatgtgagagactgaaagacttgaggcaaaaaaagggaaatcagctccattttttggtaaactttgagatgtacataatgaaatgtacatctggtatctcgcaagtgatctaaactgatctcataatcgtgctgaagaaatagatttgtagtccagaagcacttcttaaagtgcttaaagaacattaagcccagttttgacatgtgggaaacagttccagaaccagtattcccagagaaagactatcaaatgacaggtatctctctcagggacagcataaaatccagatatggtatagttttttttgttgctgtttgtttttgagacagagtctcctctgtcgtccgggctgaaatgcagtggcatagtgtcagctcactgcaacctcctcttctgggttcaagcaattctcctgcctcagcctctcaactagctgggactacgggctacaggtgcatgccaccatgccggctaattattttttatacttttagtagagatggggttttaccatgtcagctagactagtttcaaactcctgacctcaagtgatcgacttgccttggcctcccaaagtgctgggattataggcgtgaaccacagtgcccagcctatgtgtagtttttatctactgctcacttgtgtttccatgttcctgctttgaaactggaggggaatacaggtaagctactcagggcagttgcataaaacacctgctataaacatactaggccctttcaagttacatcatttttactatatgttttaaaataattcctttattatcagtaatactgcttcctttattatcagtaatactgtaaagactggagaggaagaaaacatgaggggtttgcagaataatttagtatggtattgctgtgaagagatagaaatttagatgacagtgatgttatgctccgtcagggaaccttctttttctttttctttttttttttttttatttagagtctcacactgttggctggagtgcaatggcgcgatctcagctcactgcaacctccacctcccaagttcaagagattctcctgcctcagcctcctgagtagctgggactacaggcacctgccaccacacctggctaaaatttttttgtatttttagtagagacggggtttcactatgttggccaggctggtctcgaactcctgaccacatgatccgcccacctcagcctcccaaagtgttgggattacaggcatgagccaccgcgcccggccagggaaccttctttaacttgtttattgctatattcctgctacctaaaacagggcctagaacatagcaagtgctcaaagactatttgatgaattcaaaaaagaaaaaaaggtttgaagggatttactgagacagtgtcagactgagtgttttcaccccagtagtggtgatgagtatgtgtagaccggaacaaattccctcaccctttgtggtaatgtttcaagatagctcactgaggacctctgtaaagtcaagtcttgctataaaaagatggtcatcctagatgacatagagatcaaatccattcattatcttagtttattaatacatagcactgagtaattaagctcaccaatccctcctcctcatttggatttagttgacatgggatatggcctaaagctccccaggtgattctgatgttcagctgctaagattgagagccactgctatttatatgcctttcatacagacctgacttgaatttagtaatataatatacaaatacagcagaagatgacttgaaaactattttatttctaaatactttctgacttaaaaagcaggatctgatcgtagttgttttttttgtgtgtgtgtgtgtgacagtctcactctgtcacccaggctggagtgcagtggcacgatctcggctcacctcaacctctgcctcccaggttcaagcaattctcctgcttcagcctcccgagtagctgggactacaggtgcccaccacaacccctggctaatttttatatttttagtagagatggggtttcactacgttggtcaggctggtctcgaactcctggcctcaagtgatccgcccgcctcggcctcccaaagtgctgggattacaggtgtgagccactgtgcctggccctgaattgtaggttttttgttttttttttttctttttgagacagtctcactctgttgcccaggctggaatgccgtggcacagtcacggctcactgcagcctcaacctccagggctcaagtgatcctcccacctcagcctcctgagtagctgggactacaggtgcacaccactatgcctggctaatttttaaaattttttttagagacaaggtcccactatgttgcccagactggttttgaaccccagggctcaagtgatcctcctgccttggcctcccaagtgctgggattataggcatgaggcacagtgcccaacctgtatttgtttgattatctatttaagtagatattattcctgtacttaagtagctgaattacagtatgatcttttagacttgtcttttattatgtttgtttttaaaatactgttaaaggaactgtaaataaacttgatttaattggtacaaagttctaaggggcacaaaagactagaacagtattttttccaaacttcaggttgtagtaaaaatttaaaatgaggtcaaatagaaaataccaaggccaggcggggtggctcatgcctgtaattccaggagtttgggaggctgaggctggcggatcgcttgagctcacaagtttaagaccagcgtgggcaacatggtgagaccccatttctactaaaaatacaaaaaaataggtgggcatggtggtgcatgcctgtagtcccagctactcaggaggctgaggtgggagaatggcttcagcccgggaggtgaaggttgcagtcagccaagattgcaccaccggactccagcctgggcaatagagccagaccttgtctcaaaaaagaaagaaaaaagaaaaaataccaaaattagtaagtattgtttcgtgaaacttttcagttctgtagacgcacaaacatatgtatgtgtgtactgggtctgaatataaaatggcttacctaatacgaatggtgtttcaagatgttgaaaaccacaaaactaaagaacatgtgacaagatggaggaaagaagatagtcatcccatcattcctttaatggggctacactgattgttacacacatttattttctccttttttctctgtttcttagacattttttgtttgttttcttatccagttgcttaatttttggatctggccatattgttcaaattctttaacactgtttctttctttcgtttttttttttttttttgagacagggtctcgccctgttgcctaggctggagtgcagtggtgcaatcacaggtcactgcaacctccacctcccgagttcaagtgattcttgtgcctcagcctcccaagtaacctacaggcacctgccaccatgcctggctaatttttgtatttttagtagagacagggttttaccatgttggccaggctggtctcaaactcctgaccttaagtgatctgcccgcctcagcctcccaaagtgctgggattacaggcgtgagccactgtgcccagccaacactgtttctttacccaaagagtgaaaacaaaggctgggcatgatgactcacgcctgtaatcccagcactttgtggggccaaggcggcagattgcttgagcccaggaatttgagaccagtctcagtctgggcagcatcgcaaggcctcatctctacaaaaaaatacaaaaattagctgggcatggtggcacacacctgtagttccagctttttgggaggctgaggtgggaggatggcttgagcccaagaggctgaggctacagtgagtggtgattacgccactgtaccccacctgggcaacagagcaagaccgtctgaaaaaaaaaagagagagtgaaaataggtatattttattggcagtgtagtaaaaggttttatagcattaacttgttttaaagggtaatttaagttcagatgagttatattgtaatctgaggtggttttgtgctctgttattttttcttaaatgtcatacaatggcttttggaatgtacctttctttttttagtagaactgttctaattaaggttgacttaatattttcctttgcatattcaccattactattaagttttgttttagaacaaagaaattttttagaagctttgttatcttattgcataacaaaccacgcacaaaaacttagtggctcaaacaacaatgacatctcatgaatctgtggattgaccgtgcagttcttcttcatgtggtatcagcaggctgaggctgcagtcattctgaggcctaggctgggacgttcaagatggctcacttacatgtttgatgctgggctctgctgggacactgggttggctggagctcgctctctttccgtgtggcctcagggtcttcccctctccactgagccactccatgtggttgcttcaacagagtagccagacttcttactagcagttcagggttcccaaaagtgcaaaggtaaaagctagcgatacttcttaaagactagacccggccgggcacggtggctcatgcctgtaatcccagctctttgggaggcagaggcaggtggatcacaaggtcaggagttcgagaccagcgtggccagcatggtgaaacccccatctctactaaaaatacaaaaaattagccagacatggtggtacatgcctgtaatcccagctgctcgggagactgaggcaagataatcacttgaacccaggagatggaggttccagtgagccgagatggcaccactgcactttagcctgggtgatagagcgagactctgtctaaaaaaaaaaaaaaaaaaaaaaaaaaaaaagactaatccctaaaccagaacttgcacactgctaattcttccacattcttgttgttaaagcaagttaccagcccagatccagtgtggaaggagtgctgcgaaagggtgtgaatacagagaactgtgggtcatctgagaccgtctttggagattagctaccaaaggcacatttagcagcctagtgatgaaatctcaagtggtttttatgatgtttaaaacttaagactacatttggattatttagacttcatttatattcatttcccccacaagcagttgttcctctattttagcatttgttctattacagttagataggaactgtctagcaagtgtttagctgaaagttaggcataaatgaaaaataacttagttgtaaattggttagggagaagtgagtacaaaatagagaatagatgatgtcataaactttgtgtttaaataagtagtaagaacttaaaaagatataccaattatttactgctgctgaaacactgaagaccaaaagaacagaaaaaggagaggaaagaaggaaaataaaataattttatttttaaaaatcagtgtgtggtttttcaaacttagaatagtagctggtacttagtaggtaataaatctttgaatgactgaagttttcttttcaaaagaggagttattcaaggccaccttgagtgaaaaaaattatttttaaagggagttattggtatttcaggaaatacatattttactcagcttgttcatagacagtttagaagatctgagagtatcattcattatactgagagcatagttcatctttggccaagtggatgttcataagatgtagacattctctgagaactgaaaaccttttatatcttaacttcaaccaagaataccatttttaggaattgtttatgatagaaaaaaactataccgatgggcctgttatatttggtatacagaagatttagtatgcctagatgttatctatacctttaatataatttgtcaatttgtctaatccttgttttttttttttttttgagacagtcttgctctgtcacccaggctggggtgcagtggtgcgatcttggctcactgcaagctccacctcccgggttcacaccattctcctgcctcagtctccctagtagctgggactacaggcgcccgccaccacacccagctaattttttgtttttttttttttagtagagatggggtttcaccatgttggccaggatggtctcgatctcctgaccccgtgatccgcccgcctcggcctctcaaagtgctgggattacaggcgtgagccaccgcgcccgaactgcgtctagtccttgttttgtcaaggcaagtacacaaatgtacaaataatttttttttttgagatggagtctcattctgtcacccaggctggagtgcagtggcgcaatctcggctcactgcaacccctgcctcccggggttcaaatgattctcctgcctcagcctctcgagtagctgggattacaggcacctgccaccatgcccggctagtttttatattttcagtagagatggggttttgccatgttggccaggctggtcttaaactcctgacctcaggtgattcacctgcctcggcttcccaaagtactaggaatacaggcgtgagccatcgtgcctggccagtttttttttaagtatagacagatttataagccagttagtttagccagtatataggcttttatagttatcatttggctctgccttctatagcagatggaaaatatgctttggactttgtaatagcagtgaactggtggtatttcctatcagaggacactatatgccagttagcattttctaataataaataggatccctaaacacagtccaatgcagcttctttttttttttgagacggagtctcgttctatcacccaggctggagtgtagtagcatgatcttggctcgctacagcctctgcctcccaggttcaagcgattctcctgcctcagcctcctgagtagctgagatcacagacgcacaccactatgcccagctaatttttgtatttttaggagagacggggtttcaccatgttggccaggctggacttgaactcctgacctcaggtgatccacccacctcgttctcccaaagtgctgggattataggcgtgagccactgcgcccggccaacagcttctttttttaatgttatttttctgtttgtagggtttttgtgaaggggtctcattctgttgcccaggctggagtgcaatggcacaatcatggctcactgtgacctcccaggctcaagcgatcctcctacctcagcctcccaattaactgggattacagatgcacagaaccatgcccagctaatttaacaatttttttttgtagagatggggtcttattttttacccaggctggtctcaaactactggtctcaagcagtcctcctgcctcagcctcccaaattgctgggattgtaggtgtgagccactgtgcctggccccaatgaagctgctgctgcttttttttttcccccagttttagaacatttttatcctgccaaaaagattcccagtgcccattttccttccagtgcagcttctaatacctgaacagtctcacaacatttagtctttttagaataataaaatcatagaactgattaggaggccctcttaaagaggtcaactcatccaaccctgagctattgaaatctctttacagaacagaactaaaaagacttctttgcttcagcgatcctctttccctttagttactctacatgtgacatgactttaggtcacctcacttattcttatctctctccttagattttttttttttttttttttttgagacggggtctttcactgtcgcccgagctggagtgcacagtggcacgatctcggctcactgcaacctccgcctcctgggttcaagagattctcctgcctgagcctcctgagtagctgggattacaggcgcctgccaaaatgaccagctaattttttgtatttttagtagagatggggtttcaccatgttggccgggctggtctcaaactcctgacctcgtgatccgcccacctcagcctcccaaagtgctgggattacaggcatgagctaccgtgcctggcctctccttagattttttaagtcctctcaaatttgtacactcagaactaagtatattcaaatgtagtctgatttgcatagagaatgacattttcttcattcagactttgtttttaatgaaacctgataccagtgattttggcagctgtaacaggctgtatgtctctttgaaatagacttttttaaaagcctagttgtttctcactgtcctgtgccattttgttgttattgttgatttttttgttctaagcttatgactttatatttatccttattaaatatgatccccttaaatttagcctcctgttccagccacttagaattacttaaaaagttgattatgtcatacagggtatttacttttcccatcccagatacctgtcatttgcacatttgatcgtcctcctttccatattctcatccaagtcatttataaaaaaatgttacaaaggacaggttgctctgggcccctgttgcatactactgagccttcttccagatttatctgcactctttaggtacagttgtatagttgtctgtgaagccacttaacttttaagttaaaaaattcatattttttcaccttgcacagtgatatcaagagagactttattttatgccttgctgaaatccagatactatatttatgcctctagcatttgctggcctaaccatataaaaaaaggaaaatggagtttggttatggtttctagatgttcccaatactagtttgttttttttgttttttttttttttattattatactttaagttttagggtacatgtgcacaatgtgcaggttgttacatatgtatacaagtgccatgctggtgtgctgcacccattaagtcgtcatttagcattaggtatatctcctaatgccaatactagtttttttaatgaactattcttttagtaacctattcttcagtcttgcttgtcctgcacgtcacatcaactctggtataaggtacggggaatatattctcccttctttttgaaaattgtttctgcaggctgggcatggtggctcatgcctgcaatcccagcactttgggaggctgagttgggtggatcacttgaggtcaggagttcgagaccagcctggccaacatggtgaaaccccatctctactaaaatacaaaaattagctgggcatggtggtgcacacatgtaatcccagctactcaggaggctgaggcagcagaattgcttgaacccaggaggcagaggttgcggtgagccgagatcgcaccactgcactccctcttggacaacagagtgaaactccgtctcaaaaaaaaaaaagaaaagaaaattgcttcttcagacacacaaagctaatgtgatatttgggattattagaatcatgagatttgtctgggtttcctcagtgtcactcatgggtctcatctgcagagactcttcaagttctctagtgtagaattcatccaggaattttttattcatttagagagataggcaccctttgacagtctccttatttatcttggtcactaatccacttttcctaatatttcttcttttctttctactttcaagatgatttttcttgacagaaaagatagaggaaaaacaggaattgagatgttctgtctctgctttatattaattagtaatacgccttttacatcaaagagtgggcctgtgccttccttacctttgttgcaagtctcagcacattctgggcttcagcttcagcttccttcttgatgacacatcagtgcaatttttaaaaatagtttctttctttatatgtatattgtgtatgtctgtctaattctgagttgattggtgagctttccagctagtctctttagataagccccctcttttttccccctctatgttaaataatgtgagattgccagaatttcatttttgagaacctcaatcctgttgtcttcccttttagcacctcagacttcggtcctgtctttagcacctcagccttaggtctggttgaagcctgttctcagagtctagttgctacatctagctgtgccccttgcccttctgcctgcctatctgtcttggttgttttcttttgaggcatccactacttcttttctgatcagtttcttcttattcagattaggttccaaattataattctactcatttcttctaccttctggatgatagaataattagcaaggcaaattttaaaaatcatatatgctgctttttagttgaatgagatttttcagtagcagaaatcttgtatcatcactggctttatggtaaaaccacagggccatctcttcttgccaggtctcctccctgatctgaccttacatccttcccacaaatcccagaaaatcaatctattttcttacagttgttatggccaattgtttgctggagattttttttcttttgaagctggcctcagagtagagtgtagtctcttcagctgttgccctttcatgctgtagctaacacagggatgttagcatgcttttgtttcaaatgccttattcttatttagtggaggctaaatgagggttacaaataggaaagttgaagttcatgacatcttattgtcccaagttagtttctaagttccttagatgctatctactgcctttcttactcaaggtaacactcttcaaccctctccttctcccttttctaggctctttctagaacagagcatctcgaacagctggtaggcctgaaggaagaaagctaaaccacagttatgaattagagaccattcagggctgccttttctcaaaagggtaatttatacctcgggggaccatgaagcagctctttgtggaatcctagttacattcaagaaagatcactcctgatattgcttctgttcctctttcactcaattgctttctgctatacctccatgctgaggtgtggatttccatttaggggtatacatttttaacatacactcaacttatccttttaacaggtatgatttctatatcttttcttttctttttttttttttttttttgagacagagtctcactctgtcacccaggctggagtgcagtagcgcaatctcggctcactacaagctccgcctcccgggttcacgccattctcctgcctcagcttcccaagtagctgggactacaggcgcccaacaccacgcccggctaatttttgttgtcttttttagtagagatggggtttcaccatgttagccaggatggtctcgatctcctgacctcgtgatccacctgcctcagcctcccaaagtgctgggattacaggcgtgagccaccgtgcctggccaatttttgcatttttagtagaggcggggtttcaccatgttgaccaggatggtcttgatctgctgacctcatgatccgcccatcttagcctcccaaagtgctgggattacaggcatgagccaccacgcccagcctgtgatttctgtatctttatattttgatcagagatagggtaagataaaaaattccaaaatgatcatagtgtatatagtgctgagtattctggtgaatgcaaacaacctgtcaaaggacagaattacagcaaatttaaaagatctcaattggctttctttatgattctggaattgagcaagacatcattccataaaatacagtaattgttccagtgagctgagcagaagaggttagacagaagggctaaagaaagcagaagcaaagaacagagtatattagttacttttcaattagttactttttcttacaaggctgggagagggagacagaacaatagaaaaataactggttgattcatatggaggtcagagtggaagcaggtgtgagagggtcccacagaagaaaacatggcagccaaagtgtttgagtccacggtaagtttggcttggccttagctgttgcaggagacctgtgaactctgccttatataatgtggatgttgggcacagagctgtcatctttgactgattccaggacaaaaatgacaggacattgtggtaggggactcactttctcatcccatgggtacagaaaccaattatctttgcctttctccaccacgtaatgtaccaatcatcactggtagcaaagatttacagaatgtcaatatcacactgcgcatcatcttccagcctgttgctagccagcttcctcgcatcttcaccagcatcggagaggactatgatgagcctgtgctgacgtacatcacgaccgagatcctcaagtcagtggtggctcgctttgatgctggagaagttatcactcagagagagctggtctccaggcaggtgagcaacgaccttacggagcaagcagccacatttgggctcatcctggacgacgtgtccttgacatatctgacctttggaaaggagttcacagaagcagtggaagccaaacaggtggctcagcaggaagcagagagggccagatttgtgaaggaaaaggctgagcagcagaaaaaggctgagcagcagaaaaaggttgagcagcagaaaaaggcagccgtgatctctgctgagggcgactccaaggcaaccgagctgattgccaactcactggccaccgcgggggacggcctgatggagctgtgcaagttggaagccgcggaggctctcggaacatgacctacctgccggcggggcagtccgctcctccggctgccccatgagggcccaccctgcctgcacctccgcaggctgactgggccacagccccaatgattcttaacactgccttacccccctaccccagaaatcactgaaatttcataattggcttaaagtgaaggaaataaaagtaaaatcacttcagaactcttaaaaaaaaaagaagaagaagaaaagaaaaaaataaccaattagttgggccaggtggctcatgcctgtaattctagcactttgggaggctaagagagaagagcttgagctcaggagttcaagaccagtctgagcaacatgatgagaccccatctctacaaaaaatttaagaattagccagacatggtggtgcatacctgtagtcccagctacttgggaggctgaggctggaggatcccttgaacccaggaattgaaggcagcagtgagctttgatcacgccactgtaccccatcctgggtgacagagtgagaccccctcaaaaaagaaaaaaaaaagaaaagtagctggttggttaacatcaggttacttcaggctactgtttttgtgtgaggattaaagcagagggaacttcattatcatgctgtttgaagatttaaactgtcctgtttgggaaattaggtgtcctctctctcctgatttcttagaagataacatagcttagtttaggtttagcgatgtagaccttaaggtgaatgactccatttttatttttagtctgccctgttggggcctagtataggagtttagtggcctcctataatttttatttcacaaaacaaaagtatacatcatatcagtgaatatttgctaagaacaggaaagagaagtcttcctttcaaatagcttattgttcattggaatgaattaatctaggcacagtggctcatgcctgtgatcccaacactttgggagaagaggtgggaggattacttgaggcttggagtttgagactactctgggcaacatagcaagacctccatttctacaaaaaataaaaataaaaaaatgaattaaatacataaagcaatcagaaaatataataaaatgttaaattatacattggcagcaactacttagaatctaccagaatgggtttgggttttccttttctaaactcacctctgaggaagagcagacttttgtatttccaaaattgtttctttctggatgcacttgtttttgttttggtataaataggggcctagaattatatttacagtgacctttaacctctatctctaggaatgtggaactggatgatacttttgctcccgcagcagactaaaagaaatgcggtgtagcaagaatatgaataattgaaatatgtttggggtttatagatcttaaactctttgatgaggaaatacagtcttgtgtatttggtttggctgtactgttttgagttaattttaggggtaactttgagaatcagttttagaattccagccccagatgacagtcctttgcttagtcatgggttaggtgtaatgccacatgatcctgagaagactaggaatggttgctatttattaaccttggttggtagtgatacttgagaagaaaaaataaccaccctacattcatagaggttgaactgttgctatgtttcaaaattctgtttgccttgaaatctggtaatctttactaatcttttaaggaatcatcagatgtgatgtatttgagaatgataaggtagtaaaggcttagaaatgctaacactgtgttaagttttgtggtgttttactttattttctatactttttgttaggagagcactggtaacttcctgatcttgagaaataaaaggactagaacagagtaattttttagaaaactctatgtttctacagttgtaaatagtctgaagggaacaataatatgtttcatgtggaaaaaaattaatatggacaggaagaaggattccctcaacattctccactcttaactcatatgagcaaagcctaagcaaaagaaagtgccttttgtgtttctggcctttgaaatattttttaacgattagaaaattgtttcataggctgggtgtggtggctcacacctgtaatcccagcactttgggaggccgagatgggcagattacctgaggtcaggagttcgagaccagcatggccaacatggtgaaaccctgtctctactaaaaatataaaaattagctgagtgtggtagcaggtgcctgtaatcccagctacccgggaagctgaggcaggagaatcacttgaacccaggaggcaggggttgcagtgagccaagatggtgtcactgcactccagcctgggtaacagagggagactctatctcaaaaaaaaaaaaaaaaaaaaaaagaaaagaaaaaaaataaaactgtttcatgaaaactggtttgcatctaatctttctggattcaaataataacattgttattcagacatcaacagaaagaaaaattttcttctcttccacccctctgttttttagtgttcatgccagtaaatttgtattatacctgtgtgtgaagtcaataatcagaacatttgctacttgttttattttccagtaataatttataatattgtctgtaaaattcacaagagtgtagtcaactttctgtcaatagtgtctttgcctgaaggtagtgaccctgtaatctgatgtattggggaaaatgtgtatacaggtgagatatataggtacatataaagaattgctttttcatctgtgaatggttaaaacaaaagcatttttgtctctttagaagcttaatatttaaattataggtaaagatttcaatgtatttcattttgaacatggggaatgttaacaagaatcattgggctgggtgtggtggctcatgcctataatcatagtactttgggaggctgaggtgggcagatcacttgaggtcaggagtttgagaccagcctggccaacatggtgagacctcgtctctactaaaaatacaaaagttagtcgggtgtggtggcgtgtgcatgtagtcccagctacttgggagtctgaggcaggagagtcacttgaacccgggaggtggaggttgcagtgagccgagatcgtgccactgcactcaagcctgggagacagagtgagactgtcttaaaaaaaaaaaaaaaatcactggattcctgacttctgatcttttgggggaatatttttttttcttttgagatggagtctcgctctgtctcccgggcttcagtgcagtggtacgatcttggctcactgcaacctccacctcccaggttcaagcaattctcctgcctcagcctcccaagtagctgggactaggcgcgcgccaacgcgcccggctaatttttgtacttttagtggagacggggttttaccatgctagccaggctggtctcaaactcctgacctcaagtgatctgccccccttggcctcccaaagtgctgggattacaggcatgagccataccgtgcctagccaagggaatcttaattgtttcttttatttcatgtaccctgttccttttcttttgtacccagaagtactctgtggcctatatatattttttcttttttaaaaaaaactttactgtggaaaatttcaaacatatacaaagtaaacagaataatatgatgaaccctcttgtactcatcaccttgctttaacatgttactactctttttaccttttttttttttttttttttgagacacagtctcgctatgtcgcccaggctggagtgcagtggcacaatctcggctcaagtgattctcgtgcctcagcctctgacatagctgggattacagatgtgtgtctccacacccatctaatttttgtatttttattaatagtagagatggggtttcaccatgttggccaagctggtcttgaactcctggcctcaagtgatctgcctgccttggcctcccaaagtgctggaattacagccgtgagccaccacacctagccctcttttattatttttacttctacctattccccatcctctaatcaataattttttttttaggtaaaattcatatacaatgagatgcaaaaataagctgttacagttacaaccacgtagcagacctatcatagtataatacatttttatctccctacaaagttcccttatataccttccaagtcatcccctgccccaccaggaaaccattgttctctttggctctgcctgttttagactgtcatataaacagaaccatgcattacacattctttgtgtccggctttttttgtcgagcattatatctgtgagattcatccgtgttgcattcctttgtttcactgagtagtccattgtatggatataccatggtttgtacatccgttctcttactcatgaacatttaggttctttccagtttttatttttttgttgttgttgttgttcttttttttttttttttttttttttgagacagagtcttgctttgttgcccaggctggagtgcagtgccacgatctcggctcactgcacctctgcctcctgaggtcaagtgattctcctgcctcagcctcccaagtatctgggaccacaggcatgcgccaccacacccagctaatttttgtaattttggtagagacagggtttcaccatgttggccaggctggtctcaaactcctgacctcaggtgatccacccgcctcggcctcccgaagtgctgggattacaggcgtgagcacctggcctagtttttgcttttatgctgtgaacatttataacaagtcttgggtggacttacattttcatttttcttggataagtaccaatgggtggaattgctgggtcaatagatgcatggttaatttaatttaatttttttaattaattttttttttttgagatggagtttcgcctttgttgcccaggctggagtgcagtggcaccatctcggctcactacaacctccacctcccgggttcaagcagttctcctgcctcagcctcttgagtagctgggattacaggcatgcgccaccactcccagctaggtttgtatttttagtagagacagggtttcgccatgttggtcaggcgggtttccacctccggacctcaggtgatccgcccacctcggcctcccaaattgctgggattacaggcatgagccactgtgcctgactgcatgtttaattttataaaaaactgccaaaccttttcctaaactgttttatgtcattgtacattgctactgacaaaaggatgagagtgtggttttacattcccactgacaaaggatgggtatgtgtctttggtttgcaagtttagataaactgatagatacaaaaagctttttcttagaggaaatggcttgtaggaacatctcaatattagttgttattccacagaatgtaagatgaccttgaaatatatactcgttattgatttgtccttttcacgtggcttctaaggaattgtagaagttattttagtccttatagtaaatcagctgatatggttatatagatagtatagttgttgcctttctgagaatgaagacgttactgaatgtcctagatttatacattttagaactctgtttataatttccacagtccttttaggaacccctgtctatgattcctagaaacattctctttaacacttagtggttttagcagtgaatatctgtcatcacccacactgttgtggtcagggggatatcacagcaggtaatctaaatggaattcttgggatgaaactccaccaaggtgagtaatgtttatggctttccaaagcattgcagttaaatcattcagcaataaacctgcgtttgcaccattgccaggtattaatgtgagtcatttgttttattttagtgatgtccttgcattgcccatttttaagcaagaagagtcgagtttgcctcctgataatgagaataaaatcctgccttttcaatatgtgctttgtgctgctacctctccagcagtgaaactccatgatgaaaccctaacgtatctcaatcaaggttagatgcttcctcattcattagtactattgcagacctactgtatttatgatttttttgtttgtttgtttgttttgagacggcgtcacccaggctggagtgtagtggcgccatcttggctcactgcaagctctgcctcccgggttcacaccattctcctgcctcagcctcctgagtagctgggaccacaggcacccgccaccacacccggctaatttttttgtatttttagtagagatagggtttcatcgtgttagccaggatggtctcgatctcctgacctcatgatccgcctgccttggcctcccaaagtgctgggattacaggcgtgagccaccgtgcccggccatttatgatgttttattaggtacacttatatgtaaaaacttagatctttctagtgtggcctatcaaactagaagtcctacttcagagatttgagttctaatgtcatacttgatatctattactagcttcttttgcttagctgtccatttttagtgtccagcttcctcttcctaatcatattccctagacactcccattggttactgtctgagaagtattactctacctggctctattatttaccaattgtgtggccttggacaagttgctaaaactcttttaagtttcaatttctttgtctgtaaaatgggattgataataccttagaaaagtatatcagttaaatgagataatgtgacaatacttagcacagtgctgagcatcttgtaaaggcttctgattgttgttactaatactaataatattattatactgttgtatattcaaccaactgaattttattctttccgaatctagcaaagttaatttgtggtgaatataatatgtaattactttttcttctaggacagtcttatgaaattcgaatgctagacaataggaaacttggagaacttccagaaattaatggcaaattggtgaaggtaaaacgaataaatcattcttctgtacaatattttttactaatccttttgggattttaaattttgttgttgttgttaatgttcttttgcttccaatggcttaatggtatctcttgcctgcagtaatttgttggcagagtagtaagctgatgtgttatttctttggggtcagagtaagccccagtattcacatgaatttttcagagctgcagaaatagaacgcttaccactccctgtccagggtaatcacccctggctcagtgaagttcttttgggtggagtaaagtaacctccttgagatctttagagaagcctcagtgtcttttttgatacttagtcttatagcaaggaaaacagaagctactttgatgaagagcagttctcttagtctagattaacagttaggattttgataattcacagcacagttgaaacagaggagttttgtcaaaaggtggtgggaggaattaataggcacttctacaaagtaagagtaacaaaaggaaagttgatggaaacaggctctacctaccctcagtgtttacaggttgtatggtgggttagcaagcgggggagttggtgagtttttcatatacatctgaagagctaagccagataggccgtggtataacagaagaggtgtgcagaaacgcttcagacaggagtactttattcctagttaccatcggactgaagtttaagccaagttttaaatatggtaccagttaactataaagattctatctgagaaattggctggacccggtggctcacgcctatagtcccagcactttgagaggctgaggcgggcgggtcgcctgaggttgggagtttgagaccagcctgaccaacatggagaaaccctgtctctacaaaaaatacaaaattagtcaggcgtggtagcacatgcctgtaatcccagctactcaggaggctgaggcaggagaattccttgaacccgggaggtggaggttgcggtgagccgagatcacaccattgcactccaacctgggcaacaagagcaaaatctgtttcaaaaaaaaaaaaaaagattatatctgagaaattataaaattttatcctgaaatagcacttagtatggtatgggttttagagtgaaacagatcttaagaaaaataattttagattgcgtttagaaacaaactggcagtgaatcctgctagtttttctttgtcagcactgattttcaagaggtcttgttatcatctgattttgttgtatccttttagagtatattccgtgtggtgttccatgacagaaggcttcagtacactgagcatcagcagctagagggctggaggtggaaccgacctggagacagaattcttgacataggtgagttaagagaatctattgcctaggaaatgcctttagctatggacccagagttggttttctttatttgacatttaccttgattcatatgcttgagaggctcaattagtataaaccttgaaattatttactaagcataaaaaattttaagtaatacaagttaaaatgatatcaaaattgaagttggaagtgtaaacactttagttccatagcaactataggttgattttgttgttttttaagttgtggtaaaatatacattacataaaagttatcattttaaccatttttaagtggatagttcagtaacattaggtacattcacattattgtgtaaccatcactatcatccatctccagaacttttctcatctgcaaaaccagaagtctgtacctgttaaacaacaactccccattctcccttcttcacagcccctggtaaccactattctcctttctgtctctatgaattggactactaagtactgcataaatgaaatcatacagtatttgtccttttgtgactggcatttttcacttagcataatgttttcaaggttcatggtatagcatacattagcatttccttcccatgcaaggctgaataatactccattgtgtgtatatatcacactttgtttatccattcatcccatgataggcacttaatttgattccatttcctggctattgtgaataatgctgctatgaacatggatgtacaaatatgtgtttgagtctctgcttttaattcttttggatacatatccagaaatggaattgctgggtcatatggtaactctatcttagattttttttagaaaccactatattgttttccacagtgactacacattttacatttctaccagcggtactcaaaggttccaatttcggccgggcgcgatggctcacgcctgtaatcccaaaactttgggaggccaaggtgggcagaacatgaggtcaggaaatcgagaccatcctggctaacatggtgaaaccccgtctccactcaaaatacaaagaaattagctgggcgtggtggcgggcgcctgtagtcccagctacccaggaggctgaggcaggagaatggtgtgaacccgggaggcggagcttgcagtgagccaagaccacgccactgcactccagcctgggtgacagagcgagactctctcaaaaaaaaaaaaaaaaaaaaggttccaatttctccaatccttgtcaacacttgttgctttcctttttttttttttcctgagatggagtttcgctcttgttgcccaggctggagtgcaatggcgcgatatcaactcaccacaacctctccctcccaggttcaagtgattctcctgcctcagcctccaagtagctgggattacaggcatgcaccaccacacctagctaatttttgtatttttggtagagacggggtttcaccatgttggccagggtagtctcaatctcttgacctcttgatctgcccgcctcggcctcccaaagtgctgggattacaagcgtgagccaccacacctggcctgttgctttctattttttgataatatccatcctgatggttgtgaagtagtatctcattgtggttttgatttgcatttccctggtgataagtgatgtcaagcatctttgcatgtgcttattggccatttatatattttctttctttctttatttttatttatttatttatttatttttgagatggagtctccctctgtcgcccaggctggagtgcagtggcatgatcttggcttactacaacttccacctcccgggttcaagcgattttcctgcctcagcctcctgagtagctgggattacaggtgcccgccaccacacccagctaatttttgtgttttagtagagacagggttttgccatgttggccaggctggtcttgaactcctgacctcaggtgatccacccgccttggcctcccaaagcgctgggattacaggtgtgagccaaggctcccggcccatcatttatatattttctttggagaaatgtctgttcaagtcttttgcccactatcgaattggattgttttgttttttttgttattgagttgaaagaatttttaaaatattctggatattaaccccatagcagatatatcacatgcaaatcttttctgttattgtgtgggttgcttttttactgtgttgatactatcctttgatgcactaaagttttacattgaggtggtccaatttatctaattttttttaattccctgtgcttttggtgccacatccaagaaatcattgccaaattcagtgccaagaagcttttcccatatgttttctcctaagagttttatagttttaggtcttatattcaggtcacaggtccattttgagttcgtgtttgtatatggtacaaccatatacaaaaaaggttgtatggtaaaccatatacagaaagaagggcccaacttcattcttttgcatgtggatacccagttttctccacaccgtttgttgaaaagactgttctttcccccactgaatggtcttgcacccttgtcaaaactcatttgaccatatatttgaatacttatttgtaggctgtctattctattccatttgtttaaatgtctgtctttatgcctatacctcactattttgctaagtgtagctttatagtcagtttggaagtcgtgaagcatgagaactccaactttgttctatttcacgattgttttggctgctcaggatctgatattttgttttgcgtttgtaaagaggggcagacttttttccccagcatgctgaaagttccttcattttactagtgcctgagaaccaggcactataaagtgggagttctggtattagaagctatgtcacttggtttgcagttaagttgtgtcttcccacgttgctacacagagtagaatttgtttttcctaagtcatagggtataaaggaaagatcttcacaaatacacatgcagtcacttttcatggtgtctgcctctctgatttctaattggttaaaatttccttttggtaaacatagttgttaagaaaaatttaactgctactaattttacctgagaaaacattggttctcatgcagtgatcctgatatctgtatgataagttgaccttaagatgaatctaacacaactaatattgtggagtgggacccacttgatgctctattgtttgaatcattgataccaaaacagtagtatagttaataccacagttctgataatacatattacctggccttaactccccagtttgatcattaataggagaaatcagggaatgctatttgaatatctgctgtgtggaatggaaagaaaagttctactcaaacccattaattcttgcttcccttttaagtaaagatttgtcactctgttataggattatttgatgacttggtaagtcagcatcaaccatctttttttttttttttttgagacagagtcttgctctgtcatccaggctggagtacaatggcatgatctcggctcactgcaacctctgtctcccgggttcaagccattctcatgcctcagactcctgagtagctgggattataggcatccacaaccacgcccagctaatttttatatttgtagtagagacaagttttcaccatgttggccaggctggtctcgaactcctgacctcaaatgatccacccgccttggcctcccaaagtactgggattgcaggcgtgagccaccacgcttggcctgcatcaatctttatgttaaaattttcccactttcattcatgatataatgctttctaccttcatatagacactctgctgcaccccttcaatagcaatactcttaatgtgcttttggcaatgaaactaattttcaaactgtagttgaaatagattataaattacagttttcatgatagtgtagacttaatccaccttaaataggattttaacaaattaaaaggaaactgcctttaaattgccatattttaagctagaaggaggatactaaacattcccaacacaaagaaatgacagatgtttgagacaatgaatatgctgattaccctgatctgatcactatgcattatatgtattgaaacatcactatatagcccatgaatatgtacaattattatttctcaatttaaaaatgatttttttgtttttcgagacagtcttgctctgtcacccaggctggagcacagtggcgcaatactggctcactgcaacctccgcctccctggttcaagcagttctctctgcctcagcctctcaggtagctgggattacagatgcccactaccatgcctggctaatttttgtattttttagtagagacggggtttcgccatgttggccaggctggtcttgaactcttgacttcaggtgatccgctcaccttggcctcccaaagtgctgggataacaggtgtaagccaccacgcctggcctaaaaataatttttttttttgagatgaagtcttgctttgtcacccaggctggagtgcagtggctcgatctccggctcactgcaacctccacctcccaggttcaagcaattctcctgcttcagcctcctgagtagctgggattacaggtgtgggccaccacggccggctaatttttgtatttttagtagagatgaggttacgtcatgttggtcaggctggtctcgaactcctgacatcatgatccgcctgccttgggctcccaaagtgctgggattacaggtgtgagccaccgtgcctggccaaataatttttttaattgccgtattttaaaaactttttaaagaggaaaaaaggtgctcaagcaaagtacttaagtcaattttactctaatcaaatattttcattgacaaaaaagaaatttaaggtgtgggctgggcacagtggctcaagcctgtaatcccagcactttaggaggccaaggtgggtggataacctgaggtcaggagtttgagagcagcatggccaacatggtgaaaccccatctctactaaagatacaaaaaaattagccgggcgtggtggcacgggcctgtaatcccagctactcaggaggcagaggcaggaggatcgtttgaacccaggaggcagaggttgcagtgagctgagatggtgccactgcactccaggcctgttaccactgcactccagcttgggcaacagaacaagactccataaaaaacaacaacaacgacaaaaaaaaaaaacaaagaaatttaggatgtgatatacaaaaatcttggtagctacattgagtaatataagaatcaatgctttcttatttaaaactgagtggccctcaaaattgttcaatgattaccattttgtttctcagatatcccgatgtctgtgggtataatcgatcctagggctaatccaactcaactaaatacagtggagttcctgtgggaccctgcaaagaggacatctgtgtttattcaggtaaggcgttgcagatagggttccagttttgaagagtatctctcttactatcagtttatttcttaaaggataaaacatgttaactttgaaatctttacagggttctagcctgactgtcaagcccaggctctttaacctgtgcctgagagcattgaggagtttctgaattgctcttctaataccccagtttatttatttgtgtctcccaaaattgcttggtaatggctgcataatatttcatttcttggttgtaccataatttacataacaattatttggcagttagattggcataatttttttggggggggacagtgtctaggctttgtctcccaatctggagtggagtggtgcaatctcggctcactacaacctctgcctcccagttcaagcgattctcttgcctcagcctcaccagtagctgggactagaggcgcatgtcaccatgcctggctaatttttgtatttttggtagaggtgggatttcgccatgctagccaggctggtcttgaactcctgacctcaggtgacccacccaccttggcctcccaaagtgctgggattataggtgtgagccaccatgcccggccttgattggcctgattttttactattatctgtgatgttattttgaacatatttatacttaaaatttgatttgcgtatctgattatgttctttgggtagagtccttgaaaatccttatttgtagtaattatagtaaccactagtttattaatacttcacatgaaatagtcactatgttaagtaaacactttatatatatgattttaagactttcagctataatcttgtggagtagtcagtcagacaaggttcttctattaagattcaccaggctgggtgccgtggctcacacctgtaatcccagcactttgggaggccgaggcaggcagatcacctgaggtcaggagttcgagaccagcctggccaacatggcgaaaacctgtctctactaaaaatgcaaaaattagcagggcgtggtggtgtgtgcctgtaatcccagctatttgggaggctgaggcaggagaattgcttgaaccggggaggtggaggttgcggtgagccgagattgtgccattgcattccagcctgggtgacaagagcaaaacttagtctcaaaaaaaaaaaaaaaaaaaattcaccaatcttagactttatgcagtagccaagcaaacctttttctccactattgctgtgaactttcatatttactatgttcccagactgggtagtgactcctctttctacaatcttccttaaaattgaggaaactttaactaacataaatcatttctcttttgctagctctgtgttctttgaagcagttaatgaatttagttcctcacagtagcttttgttagcattagatctgtacttttattttgtttgcatttgtaaagcatttttctatttcctctatcagattgtaagttcttcaagatcaaaaagaggaaaagtgttttttgtaggtattcataatgcctggtaaaggttttgctgttaatagttgctaaaaaaatactgccaactggtttggctagctagcggtactgaagccttgctgttgtattcttttcaggtgcactgtattagcacagagttcactatgaggaaacatggtggagaaaagggggtgccattccgagtacaaatagataccttcaaggagaatgaaaacggggaatatactgagcacttacactcggccagctgccagatcaaagttttcaaggtattcctgggcaatgtgctggcccttggattcttttaccttatcattctattttaacattagttaccaagtcagaaaatcaacttgtctttttttgaaaactcacacacacgcaaaaagtctaagctagagtcattgaaataattaccaagatgcctggtaaagaaatttacatggtcgtaggataataggaacttggaaaagagggctagaggcaagaacatggattctcattgaaagctcttaaagcctattgaagttacaagctcttgtaaagctcacaaaaattgactagttatggttattttcatacttgatcttttcttatttggtcttatttatttatttatttatttttgagactgggtttcattttgtcacccaggctggagtgcagtgacgcaatcatagtttaacctcctgggctcaattgatcttcctgcctcagcttccccagtaagtgggactacaggcatgtgccaccacaccgggctaatttttgtattttttatagagagggggtcttgccatgttgcccaggctggccttgaactcccgggcttaagttatctgccctccttggcctcccaaagtactgggattacaggtgtaagccactgtgccccagccagggtcctgtttatttttatcacatgaataaatatgttctcattgtaagagattgaataatacagaggtattcatagcaacactgaaattctccctttactactcttacactgaccccctccacaacctcttcccagaggaaaccactgtcataatttcataatttcgtatgtgttcttctacttccctcttcttttttttttttgagtcggagtttcactctgtcacccaggctggaatgcagtggtgcagtgccagctcactgcaacctccgtctcctgggttcaagctgttctcacgcctcagcctccccagcacctaggactacaggcacacaccaccatgcccagctaattttttgtatttttagtagagacagggtttcgccatgttggccaggctggtctcgaactcctgacctcaggcaatccgcctgcctcggcctcccaaagtgctgggattacaggcatgagccactgcgcccagctcttctagttccttcctatgcttttatacacacacatacatagctatatacatattttctttgacacataaatgggattatactatttgaaatgttttgaggctaggcacggtggctcatgcctgtaatcccagcactttgggaggccgaggtgggcggatcacaaggtcaggagtttaagaccagcctgaccaaaatggtgaaaccccgtctctactaaagataaaaaattagctgggtgtggtggcggacgcctgtagtcccagctactggggaggctgaggcaggagaataatttgaaccctggaggcggaggttgcagtgagccaagatctcgccaccgcattccagcttgtgtgacaggatgagactccgtctcaaaaaaaaaagaaagaaatgttttgagacttgatttttttcagtgaactatgtgctttagagatctttccatgtcagtagctatagatctgattcttttcaactccatcgaatataaacatttaaatttcctattttcaaacttaaagtgatgtgtcttgcctttacatcactgcacatacaattttgtttcatacatgaatatttaagtttttggaagcaatattttgggttaaaaggtgagtacctgaatttaaaacaaaatatttctcatttcagcccaaaggtgcagacagaaagcaaaaaacggatagggaaaaaatggagaaacgaacacctcatgaaaaggagaaatatcagccttcctatgagacaaccatactcacagaggtaaaaagatttcttttggtgacaatttcagttcataatttttaatcttaaaaattcatcacttccaaactggtcagaatttacttctcctaagccttgagggacacagtatcacatggattctgtgtccagcggccttaacaggaagattgctttagaatttggcacgaaccatgccactgtctctgtgtccaagttatctttccccaaattactctggtttggtttggtttgctgcaggagctattgtggtgttctttgctttgtatacataagcacatctcttgcccaaatagaattcagtttcatcttgggcataaaccaccttcaattttaggaagagctgtgtgctgcctttggttctggaacccacttataaccaacaaaaatggcctgggaccgtagttttctagacttatttctttttagaagtcctattctcagcaggcctccccacaggctccaagatggcggaaagagaagcagtgttctctattgcttatgggagtctctgaggaattaagatttactaatcaagatgtgctattcaagtaacaatgttttagtcaaatcctggggtcatatgtgctcgttcattatctaacttatcctttgtttttagtgttctccatggcccgagatcacgtatgtcaataactccccatcacctggcttcaacagttcccatagcagtttttctcttggggaagggtaagtctgggaaataaaattggcttatatttgtccaaaatatatattctttcattacctgttcataaacaagatcttttttaaatcaataagtatatctatttggtcgttctttgatggatttatatattaactgagatttggagtagcttcaaaagagatcgaaagagttttatatagccctttcttctctttgtgttctcccctctccctcctcctcgtcttttttccccccactagaaagtagcatttatggtcaatttttagtggttcagggactgatgatctgggctttttgcctctccctattactgcacatcttgtggttatttcatttcctgatcatacttgcaccagacagtggtctttgggaactggaaacaattgtacaaacactaaaatttgttttgttacttgttaggaatacttctaacacctaattattatgaatctttgataattggggaaataagtttgaagatgatggctaaaatgaagttttggaattatttatgggatacatttaatcttgccttattatcttttaccataagagataattgaaagttggtacagatgcctactccaattttaaaaagtagctgtattatagtccaagcatttaacatgtatttcacatagccatattgaaacttgaaatagttaggctaccaaatgtgcgagtatattgtttggttgcaatgtttgtggttttggatttatttaggctctatgtctgacctactttttaaaggatttaattaaggtagcttaaatatttaaaacgtaacaattaagaataaaagtaggtattagttgtagagggaatacatataagtagggccctaagataagttaattactaagttcgaataccaaatttgaattttgcagctaaggctaaaaaaggaaaaagatctttttttaaaagaaaaaaaaatcttaacatccacatagatgatacattctacttataggtaattccaaatatgatatagggtttaagagctgtgtttaaaaatttttctcttctctttgtcgtgtacttcatactagttaaactttttcttccataaaagtaggcattagggaagagggacaattcatagacaaagaacgtataaagaaaaacaggctgggcgcggtggctcacacctgcaatcccagcactttgggaagccaaggtgggcagattacgatgtcaggagttcgagaccagcctggccaacatggtgaaaccccgtctctactaaaaataaaaaaattagccaggtgtggcggcgggcgcctgtaatcccagctacttgggaggctgaggcaggagaatcgcttgaaaccagagggcagaggttgcagtgagctgacatcatgccactgcgctccagcctgggcaaacgagtgaaactccgtctcaaaaaaaaaaagaaaaagaaaaactggagtgtggagataacccttggatcataaattaggcagcactaatttttggggctactttaaaaataattttttttgccgggcgcggtggctcacgcctgtaatcccagcactttgggaggcggaggcgggcggatcacaaggtcaggagatcgagaccatcctggctaacacagtgaaaccctgtctctactaaaaatataaaaaaattagccgggtgtagtggcaggcgcctgtagtcccagctactcggtaggctgaggcaggagaatggcatgaacccgggaggcagaggttgcagtgagccgagatcatgccgctgcactccggcctgggcaagagagcgagactccgtctcaaaaaaaaaaaaaaaattgttttttattttaaatctgtgtgatgatattgcattgcataaattttcttccaatatttttcttgtatatgtgtgcatatttatgtatttcctacagtagtaatgtattgataaaattttttatcctgatatttttcattttatttttaaatttttttcttgataattattctttcataatttttcatcttagtaaatttatggttaaatatttttatgccataatttatctcatcagtcccaatttattgaaatgttgatattttcttcagtttcctcaataataagaaaatattgctaatgacatagtttctccccctcctcataaagtctttaggttaaactaatagaaaattaaagtattgggtcaaagaataagaatgtgttatgagagagcacagatttttttttaatctctagcatgagatttattgtgaagctgaggaatgaaataatgagccccagcatgtgtcatggactcatcctttcattttaaatgtttctttagaaatggttcaccaaaccaccagccagagccaccccctccagtcacagatgtaagtctaaagttgaatgtcagttacttgcaatgtctggtaatactttgatgactgtccaattcagtagaaatgcccaacttttagggagtattattcattcattcattaaacaaacatttattgaattttgactatgaaccagatactgtgctagggactaaagatatgaaacaagtaatgcaggacctttccatttgagcagcttatagtctagtggggaagaaaaggatggaactccttgagcatcttgcatggttggagaaagagaaaacaactttcacaaactaggcctgagtatggggttgtgtggggtgtttggctatgtgttacctaatggggtaacagacaaatctatttggttatctaaaaaacgtgctctccctttcagaacctcttaccaacaaccacacctcaggaagctcagcagtggttgcatcgaaatcgtttttctacattcacaaggcttttcacaaacttctcaggttaaattttctttttcttttgttttccctagcatgaaattttcctttgcattctagggcctcctggtatccatgggagagttgtgtgtgtatatgtgtatgagagatcttactgcatttttctgatgaaatgaatttcatagaacccttaagactttctcactagctgcagctgtgctgtgaaatacttaaaaacaaacactttttagtttaaattcaatttaatttaaaaatgcttatttcatacaacgctttttaaaatgtatatttcgtagagttttatcaagggggcatttgcaggtagtctgaaattttccccttgatatcactataatttatttcatttacacaatacacttttatttagctttttttttctttttctttgagatggaatctcactctgtcacccaggctggagtgcagttgcatgatctcggctcactgcaccctccgtctcccaggttcaagtgattctcctgccttagcctcctgattagctgggattataggcacctaccatcacacccagctaatttatgtatttttagtagagacagggtttcaccatattggccaggctggtctcgaactcctgacctcaagtgatccacccttcttggcctcccaaagtgctgggattacaggtatgagctgcggcatctggcctatttagcactttttgatgtggtaggaatacacaaatggatgaggcatacttcctgatcaaatagcccattaatcatctggtatccaaaaaaaaaaaagcaccgaaacaaaacacaactaatcgaatcaaaataaaactctgaaaaaatgataaatagttgtgattttgtagataagtgttctgatagtgacagtaagacgttcatgggaggattggtgttagggaacatgtgtgacacatgaggtgaatccaggatttatttatatatttattttttgagacggagtctcactgtcacccaggctggagtgcagaagcacaatcttagctcactgcaacctctacctcctgggttcaagcgattctcctgcctcagcccccgagtagctgggattacaggcacccaccaccacacccgactaatttttgtatttttaatagagacagggtctcaccatgttggccaggctggtctcgaactcctgacctcaaatgatccaccctcctcgacatcccaaagtgctgggattacaggcgtgagtcactgctcctggcccaggattttttttttaagagatggggtcttgctatgttgcccacgcctaacagtcttgaactcctaacagtcgattggcctcaacaatcctcctacctcagcttctcgagtagctgggactacaggcatgttgtgcccagcttagatagtggaaggttatttcaggcagaaagaacaacttgctcattagacatcatcagtatgatgaaagcatagggttaagtggggaggttaattggggggaattgagacgggagaggagctaggagccaggtcatgaagggccttatatgccatgaagaaaattatggattgtaacattctggtaatgaggtgtccttataatacagcccattttaatagtcattaacaaagagaatctttgcctttatcatccattttcttatatttattccaggggcagatttattgaaattaactagagatgatgtgatccaaatctgtggccctgcagatggaatcagactttttaatgcattaaaaggccggtatgtaattagtgttaaaatatcaataaggttgggattccaaatggatttggattcaggaattcttcacaatactctacacagctaaatacaccttctcaaaacatttgttttaaatgtcagctatgtaccaaataaagattttagaaaaatgttttcttgcactttgtccaaggaattccccatgatattccatttttcatttccaggtgaatgaattttccaatgaaaattcatcatccttttcatgagccaggtactattgtaggctctgggaatattaatatattggtgagcaaaacagggtgcccattgttagggagtttactttctaatggggagtaagataataaatattgtggatagtgataagagctttgaaggaaaacaaaacaaataagcaaaaaacaaggttgtgggctatagggtgcccagaatatggtcaggaagggcctctccaaggaggggatacttaagctgagttctgagaaagatgcagctctggagtcacaggaagggagactgttctaggcagaaggaacaacaggtgcaaaggtcccaagttggttttaactggagaagtggtcattcttaaatgtgggtgggaattacttttttttaatttttttgaaaacagagtctcactctttcgcccagactggagtacagtggagcaatcttggctcactgcaagctccacctcccgggttcacgccattctcctgcctcagcctcccgagtagctgggactacaggcgcctgccaccatgcccagctaattttttgtatttttttagtagagacagggtttcaccgtgttagccaggatggtctcgatctcctgatctcgtgatccacccgccttggcctcccaaagtgctgggattacaggcgtgagccaccgcacccggcaaatgtgggtaggaagtgtctgcctgcaattgttaaaatacatagtaatttgtggtccttttttgggatttacaattttaaataggtagtagtaactgatgaaaaaagcatttaggtcaatggcaacagaactaaatcagtgactacatagtaaaacagagtgtgcagtatttatttttggtttgcttttgttttggggtttttttcttcagacagggtcttgctctgtcacccagcctggagtgcagcaatgcaatcatggctcactgcagcctcgatttcctgggctcaagccatcctcctgcctagatccctgagcagctgggactacaggcacgcaccaccacgcccgcctaattttgtactttttgtagaggcggggttttgccgtgttcccctggctggtctcaaactcctgagctcaagcaatccttctgactcgccttcctaaagtgctgggattacagatgtgagccaccgtgcctggtcatatttgtttttgtctacatcataagggatgttgaatcttggaaaattttaaggaaggaagtgaaatcaggggttgatgacttgtggaaaaataattgatctttcattttttcaagcatattatctaaagggtgtttagaaattggaaggagtaagatgatcagatcaagaggtagttgaatacctttctctaagaagaacagagaaaggacttaggctagttaggagaaggtaatgagagaaataagatgatctagtttactgtgttggcattttttagtaaaaagtatatcttgaacctgacccattagacggtggcttttatattttgactatttctaacttttacaccaaaggccacaaactcaaatgactatagagtacatacaggtaatgtaagtgaatggcagtcaagactggggtatagtgaagaatatatgcatcatgtaagaagaacggctgattgttttcatgtgagaatgcaggcctaagattgctagatctgagtcttcaggaaaagccaaaagttcagaggtttatatgatgtctcatattggaactaattccacttaaggaaaaaaaaaaccctactactggggaactaataaaacatagcaaattaattgcatttggccaatgagcttccaattttcatctgctctatacgattaatgtagaaacacaatttctcccttctttttattgtgcttaccataaagaatgtaagactaattagcctttttcctccccttaggatggtgcgtccaaggttaaccatttatgtttgtcaggaatcactgcagttgagggagcagcaacaacagcagcagcaacagcagcagaagcatgaggatggagactcaaatggtactttcttcggtaggttgttctggacacactaggacagatatgaagaaaggtgaagagataacttatgggcatgtgtgatgggaaactatcaaacagcagatttagtatttgctagaagtaacaataatcactagcatttattaagttcctaatacatggcaggtgccattctttttttttttttttgagacagagtctcactcagttacccaggctgaagtacagtggcacaatcatgactcattgcagccttgaccacctgggctcaagtgattctctcccctcagcctaccgagtagctagaactaaagctactcatttgcctaattgttttatttattgtagagatgggatctccctatgttgcccaggctggtcttgaactcctgggctcaagcgatctccctgcctcagcctcccaaattgctgggactataggtgtaaaccactacacccagccaggtactattcttaacactttttatatgctttaatatttacaactaatatctcctctttgcggaggattttactgttatctccggtatttatgcaagaaaaatcaggcctaggaatgttaaataacttgccctaggtcacacagctgcaagtggttgagccaggatttgaacttaggcagtgtgatttctgagtccttcagaaaagtgggcattcctagtgatcaagttacctgtaagagtggacaaactttgtactgactgctgttgctctctcccttttgcagtttaccatgctatctatctagaagaactaacagctgttgaattgacagaaaaaattgctcagcttttcagcatttccccttgccagatcagccagatttacaagcaggggccaacaggaattcatgtgctcatcagtgatgaggtagatttttcagtacagttgaattaccagatgatgattaatttgtcagcgcatggagcaagagcagttctcctggggcagagtgttctgttttctagatcagagggtttcatacttttttgcttgctttcctcctaattttttttttttttgaaacagtctctctctgttgcccaggccggagtgcagtggcccaatctcaggtcactgcgacctcctcctcctggattcaagtgattctcctgtctcagcttcccgaatagtgggaattacaggcgtgcgccaccacgcctggctaatttttgtatttttagtagagatggggttttgccatgttggccaggttggtctcaaactcctggcctcaagtgatccacccgcctcggcctcccaaagtggtgggattccagatgtgagccactgcgcctggtcctaaaatattttaaaaaccacatattcccatgcacatttttaggttgacttaaaattttttgttaaagtttaaatagttgtaaaagatgtcatttctgggcatatataatgacatttttaagtgaaatggttacatcattattctaattgcatcccatgtaaccttaatacaaaaatgatttaataccaccaccatccattaaaaaaaaatacatgattgtgcttttctttaacagttagaattcttatactattcctctgtttccttgaactcttattttcatttacttcccccggtgaattttatcttactgtaactttttttttttgagacagagtctcactctgtcgcccaggctgttgtgcggtggtgtgatctcggctcactgcaaccccgcctcctaggttcaagcaattctcctgcctcagcctcccaagtagctggtattacaggcacccaccaccatgcctggctaatttttgtatttttagtagaggctgggtttcaccatgtggccagtctggtctcgaactcctggcctcaagtgatcaacccgcctcagcctcccgaagtgctgggattacagatgtgaaccaccacgcctggccatcttaccataacatatttttatgcacaaacatcttttattgattatcctactatatttgtttgaaataaagtttttaaataaaaatttaaaaattattataatggaattatcataattatacaattgattaaaataatgtaaatatgctacatgttttaataagtaattattaaagattaagaaggctgcccaggcgcaatggctcatgcctgtaaacccagcactttgggaggctgagacgggtggatcacaaggtcagaagttcaagaccatcgtgtccaagatggtgaaaccccatctctactaaaaatacaaaaattagctgggcatgatggcaggtgcctataatcccagctacttgggaggctgaggcagagaactgcttgaacccgagaggcagaggttgcggtgagccaagattgcgccaccgcactccagcctaggcgacagagcgagacttcatccaaaaaaagaaaaaaagaaggccaggcacagtggctcacacctgtaatcccagcactttgggaggccgaggcaagcagatcacctgaggtcaggagtttgaccaacatagagaaaccctgtctctactaaaatacaaaattagccgggtgtggtggcacgtgcctataatcccacctactcaggaggctgaggcaggagaatcccttgaacccaggaggcggaggttgcgtgagccgagatgggggcattgcgctccagcctgggcaacaagagcaaaactctgtctcagaaaaaaaaaaaaaaattaagaaaaaattattacaggtatatctatgaatgagttcgatgaaattgtttcgttccctacctgtacccttgcacataattatttcctttgtagctgaatactgcctattgattgctagaatgacacaggatttcagcatcaattccattctgtttttttcctctagatataaatgctgagggacttgattcccataaattgataggaatggatggaattttgtaatgacaatgtcattagattatacttcagaattatataccagaaattacatagtgatattaccaaaaaatcattttgaatcctctgtcttacgacaatttgtgattaggttactctttaattctggtgaaaggaaagagttagaaaccatgtggctcataaaagggtctattgctcagttattagcgttcaccttcgccattccactttgccacctgaagctttcacatcatgggccaccttattaggatcctgggagggtgaaactcatgcctttatcttgggagaagggagtttatccctgggagaagggagtttgagaagggaaagtggggaaggaaaattaaagaggttttaggaaagagcacatatgggagttgaagacacggaagtcagttctcctgtatgcacatatttgtgtccgtgtgctccttggagagtcttggggttaacccagggaaatgcataccaggctttaaaacaactcttccaatctgcttagttttttaatatttaaaaaccaaatgggaggggaggaaaaaacttttatgatcctagatattcaagaaatacattatttgtgacctgtaaagcctcccatataaatccctctggatgtggggtagtccttagggacacaggaatataaaggggttgtttttcatttaaataatcacaaattttcttgcatttttcagatgatacagaactttcaggaagaagcatgttttattctggacacaatgaaaggtaatagtaagacaaacatctttctctaagcagtttaacagctttactactactaggcaaagtacatacttctttgaggagagataggaaaagtaaccatatttgggtaaagaaagtgacaatattagagattgttcctttttttaagttggcttttttttttttttttttttttgaaacagagtctcgatctgttgcccaggctggagtgcagtggcatgatctcggctcactacaaccttcgcttcccaagttcaagtgattctcctccctctgcctcccaagtagctgggattacaggcacgtgccaccatgtctggctaatttttgtatttttagtagagatgggtttcaccttgttggccaggctggtctcgaactcctgacctcaagcgatccacccaccttggcctcccaaagtgctgggattacagacatgagccactgtgcctggcccagctttttgccattctcttccatcttccattacagatgaggaaattgaggcatgttgtttttataatgcattttttttgagacagaatttcgctcttgttgcccaagctggagtccagtggcgtgatctcagctcactgcaacctccacctcccttttctccccttctcacgagaatcttaccatactttttttctcctgctgtgttttagaggtgactaaagatgattctctctctctcttttttttaacagcagaaaccaatgatagctatcatatcatactgaagtaggagtgcggcgtttcgtgcccagtggctgctccttccttcacctctgaaaacggccctcttgaagggggatatgaatggagatttgaaggtctgcaagaacctgactcgtctgactgtgtgtggaggagtccaggccatggaggcagaatcctggccctctgtgttggcccaagctcttgtggtacacacagattactgcccaatatgcagttctgcagctgttttagttaaatttctggaccttgttgttgttaaatatcagtagaaactctacataatttagagtgtatgtagggcataatgatgatgggaattgtgtgatgtttaacaggaagatcttaaattttgtgatatggagccctgtaatttttttcttatataaaaatgggtatctatattcata

SEQ ID NO: 37204 - DNA, 38304 bp, Homo sapiens
ctgtgctcccggcgctgacgtgtctgggcggtcggcttccactccttcaggcgtcggcagccactagtcgtggcgagaggggcggggtggccggggctggcgctccacttggcccccgctcccggcccgccccgccgccgcggccccccggatgagggtatatattcggagcgagcgcgggacgccgatgagtggccgcgcggaaggagctggagacggtcgtagctgcggtcgcgccgagaaaggtgaggggctcccagcccagcgaggagacggcggggctcgggacccgggcgggcggagggcctggccccaccgcacacacggccacgcgctcagacgtggacacgcgtcgcacgaacgtgcacagcgcgggcagccgagcacacgccgaggagcctcccgctcgcccgcagacacacaccccagcccgtgcgccccgcagtcgcaccccatcctccgccaccccgcgagagggtgtgtgggctgggcagccgggtggatggcggggccagggatggaatgagcgcgccccagatggactgggggcgttgtgggaggaggtctgggccagtgtctgagtccgagggggtcgtgtaggcgtgtggggttgggagtggggcctctcccgggtgggcagtagagacctcgaggctctcaggctagggccttgtggacagttataccaagtgtgggggcctgtagtgggacaggagatcgttggcactgtcaggtggaagcgagttggtgtgtcttgaatatatgaggaaaagatttgagaggtctgacaaagacaggggatacatttggaggacaggacagtgggacaaaacctgtttgcttgccacttttttctttcttttttttggtttggtttgccatgatactggtagtgagagagaattgaaatttctgggtttcccctctcttggccaagcagaaggatggtattggagggctgagcacacgtatgctgaacatatggctgcttgaactttggcctgtcgctgtgctacacttacttctacatggtttatgaaatctgaaatcaggtaataggattatgatcatatgtgtgtgtcatttggtattgcaaaagtttaaggacttttaggtgaaattcactgggtgtggatccaagagttcgccggaaactcaaggcagttgtctattccttcacggttagtcagttggctcacttagctggagcaaagaaagacttcataggctgtgctgccaagcatttataggattcagttggtggttatgtctcaactctgatactgtttttcaaaagctttaagaggtttacttattcatttcgagggcatacgtataccagcagagataggggctgggtgggggaagccagaaaaggagggagaaatactggatttctttaatactggtatttaaattctaataaaaatatatttgataatggtagattattaccaaatttttcatatattttgatgcagatggattaggctgtgggcatgtaccaagttttgtcataatttctcgagcagattttcaactttttcagatttcggttgtcaaaataaaaatccatatcttttaactcttctgttaattgctgcttaccattacacgtgcctctaaacatcgttaatgggaaacatgctactatttttgtggcatgaaggtgcttatatctgcctcaaataaatataatagatgaattgtgcttgtccaaaactcaagtatggtcgttacattatgaacattatacaacatgtagatgaacacatgttaccagtggtttacgcccagatatcaaagtttaacctatgaggtaccctttttttttttatttttattttttgagacggagagtctcactctgtcgccaggctggagttcagtggcgtgatgtcggcttactacaacctccgcctccccggttcaggcgattctcctgcctcagcctcctgagtagctgggactacaggcgcgtgccaccatgcccagctaatttttgtatttttagtggagatggggtttcaccatgttggccagaatggtctccatctcttgacctcatgatccgcccgcctcggcctcccaaagtactggaattacaggcgtgagccaccgcgcccggccctatgaggtatcttatttgcatggattcattttcccaagtgtctgaaggtggaggagtatctaatgatcttttaggaaaagtttggtttatatcttaaaatgttatagtaatatgtttgtgtatgccttttatcagacagagcactctttactcttgactatcttgaaggcatgtgagaaaggttggttgtcttatattcatgaggaaatctatgcacagggaggtaaaatgattgcatagaatcaaatgatagagaaggaccaagaacagggacttcctattctttggttatctggttccttgctgatcttcctactacaatgtactcccttaaatcagaggcaaagcagcagcataaataaggtcttgggaaagactacattccttggaaaataatttaatataaatctgttcctctcaagtgtcttttttaatgtgattttttaaaattaaaaaataatagcatcatgactcttgaaacctatataaatcaataggaatgccttttaataccataatgaacattgaaagctgagtgttgttattaccacctcagggaacacacagatgtaggttctctagacctgagcttgtaaatggagtttgatgtttaatgatcctggtgaggtagatactattattaatctcattttacagataaggtaaccgaggcatggggaaattaagtggctcagcttagcctagaattgtgctctgaactaccatgtgtattacttttcactgttcttataggaagagaagataagtgtctttagaacctacttttaacctctgtctctcacatcgaagcaattataatgcagtgatgattctttacagtgaccctcaaatttattcctttcactctcattttctctgccactaatctggttcagacctttggtatttcatacctgcagttgtcttttaacttcttttcctgcttctagttgtccctccttacaatctattgtatccattgctcctttctctcatctctttaaagcatggtaacactgccctgtttgagaatctactgttcgctttctattacttattctctgaagtctaaattcttttggttagttttcaggcttttcatgatctagccctaccccaggccattttatatcatttgtcatacgttaaccttcttactgctttccatcccacacgtgcttgctcatcatggccaccaggctctgcttgtttcctaatcttttatttttttgagatagaatttcctgttgctgaggctggagtgacatgattacgcctcattgtagcctcgaccttccgaattcaggtgttcctcccacctcagccttccaagtagctgggactacaggcatatgttaccacatctggctaatttttgtgttttttgtaggggtggggttttgccatgttgcccaggttggtcttgaactcctgagcccaggcctgtgctgggattacaggtgtgagctaccatgcctggcctctaatcttatctatgtagtctgcccaacccttaacacatggctagattgtgcctgtttgtgaactttctagacagcacctatctcctgttgcatttgtctgtattgggcaagtagattaaatatttccccattttcttattttttagcactatgaagtttaacattttactatattatcacagaatatagctctttagaaaacatttgtcttattcactgattgttatatgtgtattgcttgtctctttaaggaggatccaagtttttaatgagtagagaaaatagatgtgttattgcttctttgcagaagttgctaatgaaatgaaatgtatttttccttattataggttgttctgtcttcctgaatatttcattatactgactacaacaacacatgatagtatttctatcattagagatacaaggaaaacatttaaatattaagcagtcaggtgttctttcagtggtagcttagtggtcagaggactaatacagagacaactaagtgtggtagagagtgtgaaccatgtcatcaggctgcctgggttcctgtcccagctccactcactggttaggttacttagcctctctgcctgtcttctcagctgtaaaagagtggtaataatagtgcctatgccatagtgttgttgaaaattaaacaagaccatgaaggtaaagtacttagaagtgcctggtacatattattgtcttacaggtttgatctcttacaaatattgagtgatggaaaagcagaagttaatttttttaacatcgttttgaaatattcttatttttagaggggaaaaaagccctcaattttggaggttggattttgacatgccattaattacttttctcttttaggtttacaggtacatacattacacccctatttctacaaagcttggctattagagcattatgaacattaatgacctcaaactcacgttgtccaaagctgggcaagagcacctactacgtttctggaatgagcttgaagaagcccaacaggtagaactttatgcagagctccaggccatgaactttgaggagctgaacttctttttccaaaaggccattgaaggttttaaccagtcttctcaccaaaagaatgtggatgcacgaatggaacctgtgcctcgagaggtattaggcagtgctacaagggatcaagatcagctccaggcctgggaaagtgaaggtactgggcatgtacatatttcttactgaagtttatttgagatatactaaaattgttcaggtagctggatcatgtcactaatattttgattcatactacattaaaccaggtgacctagcagaaagtgacaaaattgtctttttatttttgatgctccatttaaggcttctctcattcaagtcttaatttgcctccagtctctttccctcctcaatttccatacttctgctagatttcttttcctgaagcacaagttaaatacttaagtttaagctggcttaattttttttttttttaagacagagtctcactctgttgcccaggctggagtgcagtggggcgatctctgcttactgcaacctccacctcctgggctcaagtgattctcctgcctcagcctcccaagtagctgggattataggcatgcactaccacgcctggctaatttttgtatttttagtatagatagggtttcgccatgttggccagcatggtcttgaactcctgacctcaagtgatttcgcctgccttggcctcccaaagtgttggggttacaggtgtgagccactgcacccagcccagctggcttaatctttaaacctgccctaacctgatcctaacccatatttccaatcaacattttagctgaaccaaataattcacctttccctgaacatgataccatgccttccctgcttttgctcatgtttatccttagcttgatgtgccctttgccctttctctacctagctaggtcaccttgtaaggtcatttcttgcagttgtgcagtgcagtagttctgccagttggggaacttacactcattcattaaggtttaccacacataatattttatctatgaccttttcttttgtgtcccaagttagaattagttgttcatgcttttatttcattctagcttatcataagagttcttcctcaataaattgtaaattcttgaagaacagcccatgtactagttgtctctgcatgttacgtagcatttagaacaagagttttatagttataagttgatcaataagtgtttgttgaattgccccaatgcttttcattctaaagcatgtaaaaaaatctttccccttaacctaatactaatttgtgcttttgagaatggcaaaatagctcaactgtagcttttggtggagttgaaagctgtgttttttataatctattactcctctgtaagtaaaatgttgactaaatattgtagctgattccctcagtgttggtacgtgatccttgtcaaatctgggcctcattttctcaactgtgaatgagaacttgggcaaatactttccttagctttttaagacattattttattgcaaaaataatattgaaataacagattgcccataatctcatcaaagctatatttttatttgctcacattaccacccagtacttgattgtgtacatatttttttgtttctttgtggttttttttgagacagcctcgctttgttgcccaggctggagtgcagtggtgtgatcctcactcactgcaacttcgcctcttaggcttaagcaatactcctgcctcagcttcccgagtagctgggattacaggttcgtaccaccatgcccggctaagtttttggtatttttagtagagatggggtttcaccatgttggccagactggtctcgaactcctgacctcaagtgatccgcccacctgggcttctccaagtactgcgattacaggtatgagccaccgtgcccgggcagattgtatatatatttgatttcatagatgtgtagtaatactatacatacaatcttatagtctatatttacaacatggctatttttattttgttttccactctttggcatccccttaccccctgtaaaaagaaagattactggcattatcaacctgctgtatacctctctctgtctttctccaggctgacaaatttactgattttcaaagggtgttccaaagaacccaagggttttcactgttggggaagctgcctcttatagggagggagggagcagatactaaactggtaggtctccaacccctttatcctctactatgagtagttctgcctttttctgttctgtgtgtttgatctttacatgaggttttatttaaaagagtttagaagtttaaaaacagtttgaaaataattggatcttcttcaaggaggtgcttttcagatgtaaaatgcttggtagtagctaacctagctttttacttaggatagggctctgccactaagatgtgagagaatgatgcctaggtatgtccttgtgaatgaagagtttgataccatgacttctattactttggattcactaatccttcccttcttccctgggtttcaaaaaggctactattccaaaccaaaagccacacaggcctttctttaccctctagtatcccagttgcctatatttttcctggggattttaaggggatgaagtcttagtagtaactcttatggaaagtcaacactttgaccttgttggggaacataagccacaattaaggtatcctataatttgagtcttctttatgtcctttttgttggactatgtggagctagtctacatttatgacttttcatgtaaactaaaatccggaactattagaaccaagtatagcataacacggtgcaaacttccttttggcttagtgtcaaaggaaagatatttatctgtagcttaaacagtaagggtggagaaggagactttatgttgacattatatccttttcacttagccagaaactaccgtgtgtctgcaaattcataacaaaatgaagtttctgcagtaagttatcaaagcgaagagaagccattgtgaagatcatggcattgtatttcaggtagtaggaagatcctggtaattgtatcagggacagtttttacttccccacacccccacctcctcagaatgggggaatgaaagcattgtccagtaattgcaaagtatctggtggttattcagatgataatggacatttttacaactggagtggaaaattatttatttctgaaggtcgaatataagtgaccactgtactccttgttgaagagagatcttgctttatttcttgaagttttctgggcagttgtagaaaatggaatgtaaaggagcaactagaaaatctttattttacaaagctgagatcttgaaagagaagtaattataagctttgagaatgctgtattagtaaagatacactgggaaaacctgtttgcttgataaaaattcccattctttattaaaacaaatgcatgcttatttgaacacagatctaccaattttatattacaatatctaattagtattcagtcttagctttttttgcctatgagacattttcctattaatcataatggtgcttctctaccatatagcactatagtaaagtaagtggattatttagaagaaatgcattcttaacattatctcctctacattttttgaaatctagggtactgatgtttttaatagatttgttttattttaaaagtaatacagccgggcatggtggctcatgcctgtaatcccagcactttgggaggccaaggcaggaggatcatgaggtcaggagatcgagaccatcctggctaacacgatgaaaccccgtctgtactaaaaatacaaaaaattagccaggtgtggtggcaggtgcttgtagtcccagctactcgggaggctgaggcaggaggatggtgtaaacccaggaggcggagcttgcagtgagccaagatcgtgccactgtactccagcctggttgacagagcgagactccgtctcaaaaaaaaaaaaaaaatacttattttagagaaattggaaaatactaaaaattacaaaggaaaaaatactaatctctctgattccaccatacagagatactcactagtaatattttacagtcttttctttcacacacacacatatgcatatattgggattgtgtatagttttgtagcctgcacaagaatttatcatgaaaaatgtcaaggatattttgaaacaaatatttagtggcaaatttagtatagtgaacccccacataagcccccttgattaaaaattatgaaagttttgctccttttgctttctctctccctcttttttttcccctttgctgcagtattttaaggcaaatcccaaacatcatgttatttttatcctcatatagtttggtatctatgtctaaatatatgggtgttttcttactaatcacatgccattattatacctaatgaaattcatctaatgtaatctctgctatcaaaaactggttcagatagagattttcctgattagtctgctttttgtgcttactattttggggaaatattgtagtttctttcagctataacgtgattaaaaattaaagacttaaattattctctctaactttcttggatagctttcctttattcctaccagttgagtagcctgtttacccaactccactcatcctggagttctgataatttaaatgaaagttctgacagtgctttacttcaaaaggacctgtgctatcttccttgttaaagtgtataggaggaactagtctaagtaggaagttatccaggaagcatttgacctctgacaggccactgtaaacttttctctctgtttcttgtgaatgttatcagaaaaagtgcttagattctcttgggcccacaatgcatgactctccaaggagagagatactccagccctagaaatgtgtcagtctggctttctttttttttttttttttctaacttctgatttttttgtttgtttgtttgttttttgaggcggagtctcactccgttgcccaggctggagtgcaatggcatgatctcggctcactgcaacctctgcctcccaggttcaagccattctcctgtctcagcctccccagtagctgagattataggcgcctgccaccacacccagccaatttttgtatttttagtagagacgggggtttcaacatgttggcccggctggtcttgaactcctgacctcaagtgatttgcctgccttggcctcccaagtgctggaattacaggtgtgagccactgcacctggccgctttttaaaatttcaatttcagttttgcctgtgttgagttcccttgtgtaggaaaattattaacccttatgtcttatcatggagagatagaaagggtgatacagtgttgaacttttcagtgtttttcagtatttctgcagaggtagctttaggatagaaatttataatttcctaattgtcacatgggtttaaatacatttatatttagttaacatttttcaggtaggtgctgtgctgcccatataaaatttatgttatgacaaaagcagtcccaaaaagcttattgaattttattgggccacttaattcaaaacagcattttatctgtcatcataagacagatactaatttatgtgttacatacttttgataaacattgcaactttatcgtagtaacagctgaagtagatgagtactgagtacttcagccagtgtacacacaatttgatactgtgaacaatagctgtagctgcatttcatttgtgaattacagctggccttgattctccaggaactgctgccttttctcttgtttttcactgtttgctcataagtgagatgtgtaaacaggaagaagttaatgaaaagcctttttattgcaaatatatgtggattgtgttataattcattataatagttgtggttaaatagagatgagatgtaaatggatatctacctggtagtgtacatctgattggcatcatctcagtgccactgttaattggtgacttgactggttatcaggttcggagatggaaagaagcactaaagagcgaacaggagtttaggaaacaaacacatgccatttatctgaataaagaatgaggccactgtgagctgctggttagcaaaactttaaatgtgaaacaactggagagtaggaatgaagcagtaatttagggaacccatctaaggaagagaaaagtttatacagggctattttcatacctggttagacctatagaaagcactgaattgatgttgaatgccatcaggtgagcaggagctgagacatggagctggctctgggagtgtagcttttacctttttcaggtcagttagctgagggaaataactttcctgggactgagagtgaaagtaagaagtcaggaagaaggttggcaccatgttaagagtaaaacaacttaaaacacatgtgccatatgaagaaaatgtactgtataaaaagaacagagatctctgtgtccaaaatgtaggtatttggcacttcttttgaagatgttcagaaatattttttattataacacctttgatggtatgcaagtgtccagacaggagttctttatctgcatttcgaaaatggtacaaaacctgacctgaatagacatgactatttgtcaactttatttatcccacttaatgtgattatagggtgctgtttcatatctgctggggacatatataattataatatagcattttatatatgtactatagtccttttataaattttgaagagttctgcgttctgaaacaaatctgacccatgggtttaggtaagagattgtggactcatattttaaaacaatgctttgtaggtgacagcagaattaaatttattttctagaaaccatagtttatttgatataattcagggaataaccaaatataaaacagttttcaaatgtcttgaaaggttccctgttccctttaaatttcttcatctcagtttttgttatatagtggtttatgggtcttgcttaaggcacatacaaactcagaatggctgttaaaaatttcagtgtttgggaagttttggagaatgttggctcttcttgctcaacagttttttcatttaggatggtgggtaagacagactaaaaaaaaaaggcagcacaacctctggtggcagggtggtgtggtggtgaagaggccctggagtcaggtcctaatcctgattcacatttactagctatgtgaccctgggcgagactcttaacttctctgagttcattatctctaaagtggtgaaaattacacagtaactgcctcttagattatagttactattttgggttctattttggtacacctgattttatgttcttattttcaaactctgatgaggtacaattaaatgctatggagttaatgaggacaattctggttttagggaaggaagaaagaagatttaactctcaggtagctaaggtcagcttcatatcaaaggtgaaaattatgaaaatacataatgtgctgttgggtttttaaattgaaaaaatagcaggaataggctgggcagggtggctcatatctgtaatcccagcactttgggaggctgaggtgggcagatcacttgagcccaggagttcgagaccagcctgggcaacatggtgagacccctgtctactaaaaatacaaaaattagctaagtgcgctggtgtgcacctgtagtctcagctgcataggaggctggggtgggaggatcactcgaacccaggaggcagaggttgcagtaagccaaggttgtgccactgcactccagcctgggtgacagtgtgagactctgtctcaaaaaaaaaaagaagaaatagctggaatgattgctgaataatgttcttggactatacttactaataaaggaaaaatagagtcagaactggctctaaatttataatggagttatttttttcttttcttttctttttttttttttttttgagacggagtctcactttgttgcccaagctggaatgcagtggcacgatctcagctcactgcagcctccgcctcctgggttcaagcagttcatctgcctcagcctcctgagcagctgggattacaggcatgcaccaccacacccagctaatttttgtattttcagtagagacggggtttcaccatgttggccaggctggtcttgaactcctgacctcaggtgatttacccaccttggccttccaaagtgttgagattacaggtgtgagccactgcacctggccgggtttatttttctttatgttgttgacctactagtgtattagctttaagaaaacccaatatgtcaaaaacaaagcacaaagttggtaaatgaaataaacccacattacctaaggattttaaaataattgatagttgccatcactgactgcgtcgtctggcttagcctataattgtggccagtggccaggtttgttcacagaatttctaagaattctaatgaaagtatgaaactcagaaaacaagaacgaaactgtttaccatggttttaattttatagtttttctagcttgccagagacccaatttccacatagcctcttctcacaagctactctgccttatggtactgagactgtccacttttgaataataagatgggtcttaggaatggattatggcaagatttttttttttttaattcagactgagagctcttttgtagcttttatagttacatttatttgcatttggatctcaaatcatcttgaatttattttggtttgaagaataacatttttattcaaacattatgcttgatgactatttattgctgaatattcaactggcaaaaattgacaggcttccagaccaaagaaataaatcagtaatgaagatagtctgagtcttacattcttcttagctggtatagatggcccattttttaaaaaggcattttatttatttatttatttttgagacagagtcccgctgtgttgcccaggctagggtgcagtggcacgatctcagctcactgcagcctccgtctcccaggttcaagtgattctcctgcctcagcctcctgagtagctgggattacaggtgcttgccaccgtgcctggctaatttttgtatttttagtagagatgggatttcgccatgttggtcaggctggtcttgaactcctgacctcgggtaatcctcccgccttggccttccaaagtgctgggattacaggcgtgagccactgtgcccagcctacaaaaggcgttttaataaattaatatatatttacatataataaaatgcattagttgtaccttttgattttgttttgtttttgagaaagagttttactgtcacccaggctggagtgcagtggtgcagtcttagctcactgcaacctctgcctcctaggttcaagcaattctcatgcctcagcctcctgagtagctgggattacaggcatgcaccaccatgcctggctaatttttgtatttttagtagagatggagtttcgccatgttggccagcctggtgtggtctggaactcctggcttcatgtgatctgcctgtctcgtagttttatgtttttgtattttgttttttttttttgagtctcgctctgtcacccaggctggagtgcagtggcgcgatctcggctcactgcaacctccgccttctgggttcaagcaattctcctgtttcagcctacaggtgtgtgccaccatgcctggctaatttttatatttttagtagagacaggtttcgctatgttggccagactgctctcaaactcctgacctcaggtgatccacctgccgcggcctcccaaagtgctggagtgagccactgtccagccaattttatgttttaacaaatgtatactcacgtagctaccatcccaatcaacataagcacatttccatcaccatacaaagacttctgatgccctttgcaggtgataccccaagcgcattctgttgagttgggtttcaaaccagaaatcctaacttcagagcctgagttctcgcccattatactttactactttcctaactgaagatttattttctttatgtagcttacctgctatatttgcatgctcattgattatttattataggctggaggtaatttgatagtgtcatcattcatcccgaaactttggtattttctttactctgtcttttttttgacttgccacatcaattagtcatcaaatttttgcgaaacatttattatatctctcggttcttacctcctgacattatcagcaaaaaatatttagttcactaaaatgcatcgttcattgtttggtgttcggttgggttatataaatttaattgttttaataatagaaatgtttttattagcaaggtagtcatccacgattctatgtagattctgtattctctgtgccttacgttgataagcccctatcttgttatttcagtcccatgtgatcaataaaagcagcaagcaggctttggtccaagccagattctccaccactagcctgtacccaaaatcagcaaatggcctcaggacaagacagctgtatagccttacttcctttttgatgagtctttgctgctacctatgtatatttaatactaaagtgttgaattgtagaggttttgtgatacaagtgttttcttttctaggacttttccagatttctcagaataaagtagcagttcttcttctagctggtgggcaggggacaagactcggcgttgcatatcctaaggggatgtatgatgttggtttgccatcccgtaagacactttttcagattcaagcagagcgtatcctgaagctacagcaggttgctgaaaaatattatggcaacaaatgcattattccatggtaagatacgtctcattattggagtgtgtctgaacatatattgttttataatattcaaaatgcatatatactttatgcactcacagacatatttcttgttactgttgattttcttgggaggtataatttactatatatgttaaaagtgctatatattattgcttgatagatgaccactattgacttaataagcaatatatactcaccgccaacttttacattcctgactgagtaccttaaagtactcagtgagctctctgcatctagaaactcatattttcaggtaccaggttatttagctctcccacacccatgcgcctcttccgcatacacaccaggtgaaagctgcactgacttctgtgctatgggccatacttgtgtcctcagcctctactagtatgctgtattctcaggttctcaggggctccaccttggtcagtgttagttccttccctttttttttttttttttttttttttttttttgagacagggtctgtctcggtcacccaggctggagtgcagtagtgcagtcttagctgaccgtcacctttgccttctggtctcaagccatcctcctacctcagcctccccagtagctgggaatacaggcacctgccaccatgcctggctaatttttttttctttttgagagggagtcttactttgtccccaggctggagtgcagtggcgcgatttcggcccactgcaacccctgcctcccgggttcaagcggttctcctgcctcagcctcctgagtagctggcattacaggcacacaccaccacacctggctaatttttgtatttttagtagagatggagtttcaccatgttggtcaagctggtcttgaactcctgaccttgtgatctgcccgtctcagcatctcaaagtgctgagattacaggcatgagccaccgcacccggctatttttttttgttttttttatagagacagggttctggtctcaaattcctgagctcaagtgagctgcccccctcgacctcccaaaatgctgagattacaggtgtgagccactatgtccagccagtgttagtttcctaaggaccaagagattacagaagatcctgctctgctttttataagtttttggttcagctctttagtctctttccccgagcagttttggaagttagcatgttttgaggggaaaatcagctgtgtgtttgaggtcccccaagtccctatcttgttatttcagtcccatgtgatcaacaaaagctctactagtttctgtccccgagcagcagcctttggtccaagccatattcaccactagcctgtaccccaagtcagcaggtgccctcaggacaaggcagctgtatagcctcagttcccttttgaaagattctgtctctggacttacaatctattttgcctctgaagttctctgatgcctttaaaaaactgctttttgtaattttcgtagctcttctagctcttctcaccacgagtactggcctgctgtgaactgttttgttcatcttgatgcctgtggggaatttggaggaacatctgtgttctaagtggccaacattctacttacagccctggcctcctactatcatgttgaattttcttctctctctttcttccatctcttcacaactcaatttctgttcttatgcagagaagtttagccacttcttctgtcatcttctaaatatatccaaaccttttgtacctaaagttcaaaatatccaggataatttgttaaacagacagatacctcctgtggtatgaaattataccattttgtttattcatttaacaaatattaattgagtgtctttttctaggtattgaggataaatcagtaacccaaacaggcaaaaatcccttcttatatgtagtttacattctagtaagggcaaaagctaccacagtcactaattatagttttagaaataatttttttcttttttgccacactagcatgggttggatttttgtgacaacagaaagtataattatacttttatgatttttaaatggagggttagcagagcccagactgcatttcagatttcaataaaaagaaccccaagagatcattaaactgtattgcagttacccttttcttcctgtttattcagaataggcatttcaaatttaaaatacactttcacagagttctaaaatgtttacttaagccattttataggttctcttgaaggaggtgtgtttagtatgtttaatattgtaagtagatttatttcatacgtaagagttgatgaaattactgaaagaaattccccttgggtaacagctaatgaatgtgtcttacccaggaaaaatatgaaggaagtcaaaataataagcaagtgctttcaaagatatctttagcttaggaaatagacgaaactttattttgccctagtccacctagcacggttgcttagaagatctgattttctcttgtaaggtatataatgaccagtggcagaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctccaggtttgtaatcatccttatttaatggtgactagaaaggataacaacataaatcatcaaatgttgattttctttttaacatggtgattttgatatttaaacattaatatatatgtgttttttgcagcttggaaatgatttaaaaagatgaaaatgcccgttggtgtaatggatacacttttatgcttgttgtgggtgtctgctctatggagcaatttgaggagcattcagggtattctttctctataacaagtattttattttttattttttacaatttttgagacagagtctcactctgttgcccaggctggagtacagtggcgcaatctcggctcactgcaacctctgcctactgggttcaagtgattctcctgcctcagcctcctgagtagctgggattacaggcacgcgccaccatgcccagctaagtttttgtatttttttgtagagaagggctttcgccatgttggctaggctggtctcaaactcctgacctcaaatgatgtacctgccttggcctcccaaagtgctggaattacagccgtgagccaccgcgcccagccatatagcaaatattttatgtatactgcaatgttcatggctacattgtttattatagtgaaaacttggaaaccatatgctatttaataaatgagaggctaaattatagtttaaaaatagcattaattcttaaatagcattaaaataattggtggcattaaattctaaacattatttcagcaagttaagtaagagaatgcaaaatgaaaaactgcatacagtctatgattagggccactgctttgcacaattccaggtagtgcatacacatcatggtttgttaatgggacccactagaattggacagtgtattgcctgtgtagccacattcagtgaccctgagtacaacctcagtctataaaaatagacctactgacagatttatgtttatgagaatctgtacttggaggaaaggctgaaaagaaattaatagtattaacagtggtgctctctagatgtaggcttttatttcatcttaattattttggttaatggaagagttactattcttagctgtattttgtgaagttgtctaatttttcatcacttaagctatggttaaggttgttattggacaaagtacattaaagcagcattataaatagatggagaaagaagaggctttatttatatctcgtttaaatcaccttaggcctccatatcaatctgtttttttaacaaatgatttgatacaaaatacttacgtatttttgagatgggtgaaattgtcagcattggggttataaatacagagctaacttgaatcatacaaatgttaatgaaacttgaaatgttatgaaataatcattgcctgataaaggattttatatcatacaatatattactaaaaggggctgagttaaaaagaaagatatggtttttggggttgcctgatcttacattgatagtgttattctctggatagttaatgctaagtaaccttcaaaatcctatagttcaatttttttgacacctgattccttccttatggatattcagttttcttgcctttgtaaagcgaattttgttttttagggatcttaaccctagtttggaaacaatctttgtgttacctttatgatggattttgatatgctactaatgggctattttgttttccagatgggaatggtggtctttatcgggcacttgcagcccagaatattgtggaggatatggagcaaagaggcatttggagcattcatgtctattgtgttgacaacatattagtaaaagtggcagacccacggttcattggattttgcattcagaaaggagcagactgtggagcaaaggtaatgcctttctcaactatggtgaggcttttgatggtcttgctctgtcatatacgcattccagaagtcaaaccaagtttattagggtgatttgaatattttagaaccatttatctctctaaagtaactaaacggtcccacacccactttttttcttaaattggcaagacttgattctagatgtaatgttgtatacttatcacaggtaagagtttaaactatgtgaggaggatttgtaagtacttcggaaagtggtcatcactagacctgggttggattcattaatatcaaattgtgttcaatcagattaacccaacttttttcctgtgacaaagttattggagtaggtaaggaaaatgtggtagaaataacagatttagacttcctaagtcaggtgacaaggtatcttacgatgttctttcgaataagatagaaatatgcaagttgggcataaggacaattaaagaggtgaataactgcttgaatgaccacacacagactgatactaagttggagggaggtttgtaatgatatgtaatgagtctgttcttggcattgtacttttcaacacgtttttagttgtataggtgatggcatgtctttatggtagcaaaaaatatatatattatagctagaaataaaatagacagcaaacatgcaaacctttaaaaacactttggaagacctaaaaatactgatataaacattactagaagtctgtataggtatccattctcatcaaaaacagtgtaataaaagcccagtcaaaatctcagtgagactattttggggacacttgacagaatgattgcaaagtttagaataaacatgtaaaggtggccaggaaaatgttgaaaaaggatgaagataagggaggaaagggggccgaagaccatctatcaagcattaaaaggaattgtaaattaaaagagtgtggtactggaaccagaatagaatgacagattaatgaaaatagagtaggtcagtcagaaacacatctgtgtatgtataagaagaacacattttataaaatatggcattttgactcagtggaggaaatgaatgaaataactggctaacaataaagtaagatctctctgtcaaagctcatacaaatatcagttttaggtggattacacagttaaatatttaaaaatgaaatcataaaggtattagaagaaaattagaagaattttataattgtgatgcaaaaggaagacctttctactgaaagcagtaaccatataggcttctgacaaaaacaaattcgatttcaaattattttgaaatatctgtatttaaaaagaagatctgccaaagaagttatttctctcaaagttaatctagaaattttatgcaaagtctcattggaagccgaaatcttaaatttactgatacaagttttgagagattaagctgatagacctaataagcctcctctggactctgaaaataagtgttggtttagttcagttatttaagacttctatctgttccaatactctgtgagtatctgaactgtattttttttttttttagccacagactcactatgtcatctaggctggtgtgcagtggcaggatctcggctcactgcaacctttgcctcctgggttcagtgattctcctgcctcaccctccccagtagctgggattataggcacacgccttccacttggtgtcactcttttttttttttttttttttttttgagacgcagtcttgcactgtcgcctgggccggagtgcagtggcatgatcttggctcactgcaacctccgtctcccaggttcaagcaattctcctgcctcagcctcctgagtagctgggattataggcacccaccaccaggcccagataatttttttgtatttttagtacagacggggtttcactatgttggccaggctggtctcgaacgcctgacctcatgatccacacacctcagcctcccaaagtgctgggattacaggcgtgagccaccgtgcccagctggtgtcactcttttttcctaaaatagaaacttaaaattgtactgttacgagcttcagaaccaatttaaactttatgcaatcagagagtgttcaacctggaagggaccccagagatcatctggtcaacccctttgatctcagaaatgagaatcctgagttctagtactttgtttgtttatttatttatttatttatttgacagggtctggctctgttgcctaggctggattgcagtgatgtgatcttggctcactgcaacttctgcctccaggctcagcaattctcctgcctcagcctctggagtagctggtaccacaggcgtgcaccaccacacctggttaatttttctgggtctttttgtatttttagtagagacagggtttcactgtgttgcctaggctggtcttgaacttctgacctcaggtgatctacctgctttggcctcccaaagtgctgggattacaggcgtgagccactgcacccggccagagttctagtactttataagactcaggctcaaggttctttatcacattaacagagccaggattagagttcatgtttcccaacttcctagtcttatattatattacattatagaaccatactcttcagattagtttttgctgacagttcaaaaatctttaaactggtgtgctaacttttgtgagtacactaatcatgcaaagatgcaagtgttaagtcactcctctccattacctgtgggctctgtaggataaatccagactcagtcttccttgcaaagacactcactgtttagtcctgtgtctggcatgtaatgtagtagtcattcagtgaatgaataagtaaatattcagatggaaccaaaacatgactagactggcatatattaaaatcttttagaaatgttagaagccgtttacataattgctcccctgcccttttaaaataagaaaatcaaagcattaaaatatgtatcttaaagcacctaagttaggggatgattcatactgtggtagtagaattatttgcagtactttatttttattgtatttatttattctgagacaggatctcactctgccacccaggctggatatgcagtggcattatcatggcttcactgcagcctcgacctcctgggttcaggtgatcctctcacctcagcctcctgagtagctgagactacaggcacccagcaccatgcctggctaatttttgtattttttgtagaggtggggttttgctacattgcccaggctggtcttgaaatcctgggctcaggtgatctgcctgcctgagccttccaaagtgctgggattacaggtgtgaaccactatgcctggcctgcagtactttaataggcccctgtcttggtgcattaagtattttttatggagtgaagaacatgagaaaagactgaaagagtgaggtagtttgcaaaagtacaaagttaaaaaggtaggaaccattgttaactgaagatcattttgtaaagcaattatagtaactctgaggttaaagtgttattttggactcagcttttctctcagctcactgcaacctctgcctactgggttcaagtgatcctcctgctcagcctcccaagtagctgggattacaggcatgtgccaccacacctggctaatttaccatgttggccaggctggtctcttaactcctgacctcaagtgatccacctgccttggcctcccggagtgctgggattataggtgtaagctactgtgcctggccctggactcagtttttctggattaaacttatgaaatattgagtacaccttttaagtttatactgtatatctttttttttttttctgagataagagtctttctcttgttgccccagctggagcgcaatggcgcaatcttggctcactgcaatctctgcctcccaggttcaagtgattctgctgcctcagcctcctgaatcgctgggattacagtgcctaccaccatgcctggctaatttttttttttaattttcagtagagatggggtttcaccatgttggccaggctggtcttgaactcctgacctcagatgatacacccacctcagcctcccaaagtgctgagattataggtgtgagctaccacgcccgttctatactttatatcttttctgtataatataaatggattcccacttcattcagtttacaaatgctttcttctgtaatgtagacttttaaaatatttagaggttaatagttgccatagaagtaaacctttgggaaatgtaaaatgtgaatatgtatatttttatttttatggctggttgggagtaggagtatatagtggtgactggaaaataaacctgtgtgcgttaaaaaaaaaaaagagagagaataaggggaatctatcccaaattccctgcctagtaagatacccactgtaggtagagtacatgaagtaagagatggtgatgggttggtagataagaattgtaaataggcccatgattgatttaaataatttgctgcataatgttccccttcagtttaatctacttcctcggtagaaagtttcttttcattaagaactgtgttcctttcagggtggcaaacagtgaaccacacaacaggcttacttatccagcagtcctgcctcactgagctggactcagtgcctatatctctaattgctgtgtaaatgaagttctcaatagtggctttagttttctggatgagactgttactgactgtatttattttaagaaatcagttgttgaagaaaagtcttaactttattaatataatttcatgtctacttaggatagacttgtcaaattggggacagagttttaaacatattttgaagcatgctgaattgataattagactggacaaacaaaacaataccttcaaatagatagggatttttgagacagggtcttactctgttgcccaggctcgagtggagtgcagtggtgcaatcacgtttcactgtagcctcaacctccccagactcaggtgatcctctttcctcagtctccctagtagctgagactccagcatgccaccacgcctggctaatttttttattttttaaatagaagccagggtttcaccttgttgcctaggttgacaaatattttttattgtttgtttcttcggttggatatttatcttatctgaaccttgattttatattagtgcattgcatatagttcttttataattttcttctaaacacttaagtcagtgatgtgtgggattagtgtggtggcataccaaaatcacttgtgaggtttttaaaaattacatattcttaattttccctctgattttagtataccctcttttctcagctccccatcagcccagagccattgataaattatcacatcactggttttcagaattatttttttgaagtatagaatcacttatttcaaacaaaattgagtatacaaaacagataaatatgggtgggttttctaattaaagttggagtgggaggctagtgacctgcctgctctaaacccctttacctcctactcaggtccctgaaacacaaggaaaatgccaaaattaaagaaatgcttttttcaaatgaaatatcgggcaatagaaaatgagagacaaaatgcctaacttaggtcttttgtcttgtgaatcccagagaaatttcattttatttattatgaaagtaattgaggtggttaaggataaattaaataaaaagtacaagatacatgggggatgttgactcctgatgtaattattcccactccaatgtgatttactctgtgctagatatatgtatatgatggaatttctagcccaaggtttagttaggtgataaataggaaggaaataatatacctcatttccagttggaaagtgcctgtcaaggtatataaagatggatagttgattgtctaaagttaaagattcttcttggctttataccttttagtgtaagcaaagttgtaaatgtcatctttgacaatggcaaatctccaaagaaacatttaattcaatttcctcctctactgtttttctctggtggacaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaagtatgggcaagatgggggccttttaaaattatatttattgttaatcagaaactaagacacttgagagggatgcagacaccccaagtccatatcccacagaattcatctttcctgaggatcacttatcaaatggacatttatctcatgttgtgattgtttttagtaagatgtattgtaaggtgggaatcatcggagcccattccccagcgcattaatgggaggccaaagcatttctcccttctcaccctcccacccccaactatgtgctaggttctgttgaagcaaagcataagaaatgaaactttctttaccacagctgtgagctttttaaaaatacagatgttcaccttacaccaactgaattagaatttcaggaggtgggttcggggcatctatatttttagaaagctgcccacaaagttctaattcagctgattcccaggctggcatttagaaactagtgtgctaaagagtgaagaaattacttgacacctgcatgaaaattagcgggtagtgctacaaaggataaaataagagctattttatcccaccatagttttaaatgaaggacattctcactatcgatttcacttagcttttagacattcaagatgacttgtctactttttaaaaagttaatatgcattactttagaatatcaactccagttccaaaatatttcccattctatgccatttgtagctgtgttactgtttcatccatagtaacttaatgcgttttttaatgtacatatatacagttttaaggcatttgtaatgaatacagttttaatgcacacgtacacagttttagtggagactgttatttgatttttttttaaatataaagagatgattgggggaaagctattcatttactatttaaatatgaactgaaacttaaatgctcttcactttgaaaatcttagtattggttgttgacacatttgctcctgaatgttgtaagattttctggcattttaaatctggaacgtgattatatcttttctcctcctgcttcttagtgtttatgaacctcagttgcagcaccatgtggctcaaaagaagattccttatgtggatacccaaggacagttaattaagccagacaaacccaatggaataaagatggaaaaatttgtctttgacatcttccagtttgcaaagtatgctttgaatagtaccaataaggttaaataaatgtcttaaaatgctgcttttcactctcttaggcatgaaactgttttcaggaaacatttgatagcacatatctcacatggcattttgattgtgagtatgtagtctagattcattatagttctctggaataaaaccaggagtgtgatctgagttgcctatgagtacaactttttttttttttaaatcaactagtttctggctcctataaagtttttttcatatgtatattaaatatatatattatatatatattttatatatataatttatatatttatataatatatattatatataatatataaatattatatataatatatattatatattatatttaaatatatataatatttatatattatatataaatttatagttatatataaatatatatttatttataatatatataaatatatattgtttatattatatatataaataaatatatatttatttattaaatgtgatggggtcttgctatgttgagcaggcgggtctcaaacttgtggcctcaagcgatcttcccatctcggccgcccaaagtgctgggattataggcttgagccactacgccccgccttggtctcctgtaaagttgttaaagtcatttattttggatgagaaactgaaaaggttaagataaagagttgtctcgttttgtatttaggatatcttcttactgccctgtgaatagatgtttcagtaaacatgtttttagattatatagctctctataaagatcacatttgatgttgagatgcttgtctcagaatttgacgagtgcaaaaatgagaaagacaaataagctgtataaaattaatgcgtggtggctcatgcctgtaattccagcagtttgggaggctgaggcgggtggatgacttgaggccaaggagttggataccagcctggccaacatggtgaaaccctgtctctactaacagtacaaaaattaggtgggcgtggtggtgcatgcctgaagtcccagctactcaggaggctgaggtgagagaatctcttgaacccaggaggagaggttgcagtgagctgagattgtgccactgcactccagcctgggtgacagagtgagactccgtctcaaaaaaataaataaataaaatgaaattaatctttccatttctaaatcattttttttgcctgtttttttttttttccagaacagatactaatgtgatctttgtacattaagatttctaatctttccgacttaagatgaactgttctatagttgaggggggaaatgatttctcattttgcattgaaaaagaaaatttcagctttctttagtccaagggtgagcaatattttattcatcattcagattggaataggaaagcctattgttgagaccaaagccttagctatgttaaagggttagaagctgtgtatgcagtttcataataaagaggtctttatatggtttcgctctaggaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccggtaagtcagtatcttttctcttttgtatgaatcctttcttggacttttcctcttggacttctctctctctctctctctctgtattcctagatcttttttaaaaagcaaagttttgatgtgtgaacagttcctgatgtgaaataacagtagctttgcctattataaagagaatgattgttttactttcttgtgaagaggagtctttcagatctctctttttttaatttttattttttggaaacattgccaccatgacagcaaaaagacttctactaaataatgatcagaagatttttttttttttggtgtgccatatggttaaagcccatcagtaacacactataccacagggcaagtccttcagccacagaggattgtttgttgttgcccatatatctgtggcctcaccactattttttttttttttttttgagacagagtcttgctttgtcaccaggttggagtgcagtggcacagtctcagctcactgcagcctccacctcccgtgttcaaatcgattctcctacctcagcctcccaagtagcagggactatacaggcacatgccaccacacccagctaatttttatatttttagtagagatgggctttcactatgttgaccagagtgctctcgatctcctgaccttgtgatccacccgccttggcctcccaaaatgctgggattacaggtgtgagccactgggcccggctgacctcactactgttaatagtactgtctgtgagacccactcatagctccaccacccccaggctacctacaaattgtagtccaatggcagttttcactgtagcactttcaggtcactgaggaaggtgtctagaagagaagtaaatgtcagttacattcactgatacttagaaatggctttggttttgagaagttaaaaaaagaaggtattgtagttatttaaatccaagataaagtacttttcagctaaatctgtttttttgtttgtttgtttgttttttggagacagtttcactcttgtcacccaggctggagtgcaatggcacaatctctgcccactgcaacctctgcctcctgggttcatgtgattctcctgcctcagcctcccaagtagctggggttacactcgcctgccataaagcccagctaatttttgtatttttagtagagacaggatttcaccatgttggtcaggctagtcccgaaatcctgacctcaggtgatccgcccgctttggcctcccaaagtgctgggattacaggcgtgagccgccatgtctggccaatctttttttttttttaagacaaggtcttgctctgtcacccaggctggagtgcagtggcgcgatcttggctcactgcaaccttcacttcctgggcttaaacaatacacccgccttggccacccaaagtgctgggattacaggtgtgagctattgtgctcagcctaaatcttgtattttatgatgaaaccttcactggcacctagaatttccctttctgaatcatctggtatatccgtacttatgtaaaaagcattctggcatttaatttatattcctaacggataagatggctggctgcaagaatgcctcaataaatggtaaaatattgggctggacacggtggtttgtgcctgtaatcccagtattttgggagactgaggcaggcagattacctgaggttcaagaccagcctggccaacatggtgaaaccctgtctctactaaatatacaaaattagctgggcatggtagcgcatgcctgtatcccagctacttgggtggctgaggcaggagaattgcttgaacccgggagggagaagtttcagtgagctgagactgtaccactgcactccggcctgggtgacagagtgagactccatctcaagaaaaataataaaatgttagagaacactgaacattggaatttactggtacataactggttttacaagaagcagcagtggtagctttcatctcccagtccaaggccacttttgggctctgtattgtcaacaagcttgctcttggcatgtcacattgtcctcatgtttcatctttggccattgagttttatttttatttttttacccccttttggtctcttgggacgaatttatgatttaccataaatacataccattcaatcaagtatattttgcaactccatttcattgttattgtttgatttgcttccattcccattaatccttatttattcccacatagcagtgctacaaatgggaagtcagagaccatcacagctgatgtcaatcacaagtaaatataccagcctgcctacagtgcatggtgatggggctgtgcttccctccatactaactggcatcgtagtttagtgctctgccttttgggggtctggagggaggatggttgaaactttggtgtgggtgcactgcttacttggtggcaggtatctctctggatgacactaactcagaatcttgttgcatgctggaaatggagagcatgctttactaaagaatctgaccacaggtgttagagctggaactgacagattttcagatgataggtaagatccagagcaggttacaggtcagggagaacacattttgcacctttaacataagcttatacggggttaaaaataccattctgaagatgtgtcttgtggaattgggtgtatgctctcagtatacaggctgattgttcctgtcatatttgatggcccttaatatggagaaaactgttctgttgatttattctcacactaacagctctcctttttggtcactgcattaattttagtcagttactttcttgcttctaaagaatctttttatcttaatggcagatcatttttagttagaagtaacacatatcctctcccatctgggtactgacagagtttggaaaagccattatctttatagtttaagagacagcttgatgttattgttacactttgaaagttaaagtttttaaggttgggtgcggtggctcacacctgtaatcccagcactttgggaggccaaggcaggcagattacctgaggtcaggagttcgagactagcctggcaaacatggcgaaacctcatctctactaaaaatacaaaaattagctggtgtggtcatgcacgcttgtagtcccagctactcaggaggctcaggtgggagaatcacttgagcctgggaggcagaggttgcagtgagctgagatcgcaccattgcactccagccttggtgacagagcaagactccatctcaaaaaaaaaaaaaagaaagaaagaaaaagtttttaaggtaatttgggaaatatatgcagggcaaaagatctggagatggaagttatctcagaaatagagtagcaccttcatcagtgtcacccacgtgctttttcctgtctgtgccattcctctgcccagacaaattcctgtgagtgtcagtgtttctgggatgtgattctgtaaacaaggaagtggactcaaagatctgatcaatttcttataggtgctgtagatcagcggtctccaacctattttggcaccagggactggctttgtggaagacaatttttccacagacttggggtggtgagggtggtttcaggatgattcaagcatgttacatttatagtacactttatttctattattattacattgtaatgaaataattatacaactcactgtaatgtatagaatcagtgggagccctgagcttgttttcctgcacctaggtggtcccatttggggatgatgggagacatcatcaggcattagactctcataaggagcacacaacctagatcccttacatgggcagttcacgatagtgttcacattcttaagagaatctgttgcggccactgatctgacaggaggtggagctcaggcagtaatgtgagtggtggggagcatctgtaaatacagatgaagctttactcacttgcccactgctcatctcctggtgtgtgatccaggtcctaacaggccacagagtagtaccggtccatggcccaggggttggggaccgctgccatagatgactgttgtctctcctgccttgggaactgggatgcagagccctttatcactttctgtctcatccaccatttttaatatatggaagcaagctgcttttatatttaagaaataaaactttgattaaatttctttgtcattgaaccatagcttttaacctaacagtgtaatagattgttaattatataactgaagacagcatctagctatcttagttaagatacaaaaagctttaaacattattcttactcttttgtttaatatcccccatcgcccagtttacttcattttagccatttatagaataattaaagtgaaatcaaagtttggctttaaatgataccatgcactgaaaaagagttcctgcgtaatccttagcaccaaaggatgaccttacacagctgaagaacatcatgtaattgtgagagatgaaaaggaagtatattatgtaaaagagggaagaagcaactaggaggtattctgaaagaatggaaacaaccatgctgagttttgactcgatattatttttatttctcaccttaatgcttactgaatagtgttagctaccaaaaggatgcatggctaaagaattgtggggcagtaggtttattgggctaatttgcttatatcctgagattttacatttggtgatggtagcttctgttttccctccttcagggcatccaattttgtttactgaagttcactccttagtttcttggggtatctttgtggtagtagaatggaagttacatattcaggccagctgtatatgtgtttcttgggttcacaaccaccttctgttcctgctacactgaatccttcaggggtttaggtgggactgggctatatacatcttaatggggtgggccctcattttttcctttttttttcctcggcatgcctactcaagattcatttggttttgtatgactttgagttgccccagaaggtctggactagacctcttgagctcttgtggtagaatctggcatgtatgtagagaggtgtgtgccccactatgcctcctcttttcccttcattagtttgtcatcattttcatagtgttatttgttcagacaacaagcattcgtaggcctgctcataggtttataggtgctattagtatcctaggtgctgaagtatcttatacaagagaaataagtcacttcttacagactactgggatgttcaagatgcacatacataaaagttaagtaacattttcaggcagtatgtgattatgtgctaaatgtgtgctatagcaataattactctgggaggcagtgacttagcaggtgtctaatacatttattttttatttattattgttattattatttttgagacagtgtcttgctctgttgcccaggctggagtgcagtggagcgatctcagctcattgcaaccttcacctcctgggctcaagcgattctcctgcctcagcctcctgagtagctgggattacagatgctcgcctccaagcccagctaattttttgtattgttagtagagatggggtttcaccatgttggccaggctggtctcgaattcctgacctcaagtgatctgcccaccttggcctctcaaagtgctgagattataggcatgagccaccacacccggccacattaattaaattaattaattaatgtatttatttattttcgagacagagtctcgctctgtcaccccggctagagtgcaatggtgcaatctcggctcactgcaacctctgcctcttgggttctagcgattctcctgcctcagcctccggagtagctggctttacaggtacgcgccaccacacccggctaattttgtatttttattagagacagggtttcaccatgttagccaggctggtctcaaactcctgacctcaggtgatccacccaccgcggcctcccaaagtgctgggattacaggtgtgagccactgcacccagccacatttattttttatatgaataaatggatggagacaatcactatgaaatgcagtggtcaagagaagattggggcttgagccaaatcttggaggatgagtatggtttttatgggaccatagttgagaatgacttggaataatccaaagagtgtgactgatctggtttgagtggagagtctcaggataagtaaggtgaagtaggatagagagtgctttgaatgctagagaaaggttgacctgtagctaaactcagaagccctctgatttttattgactccagcaaagtttgagactacgtacttggggaaagcacagaaagagctatggtttgacaagagactaatatttttgtgccctgtgtcttattggtaagattcttgaagtggcaaataacaaagaggtctaatgactgcaaactcattgactatttattgacttttgtgttagataacttagaaattcagaattgctgtaaatgttaggttgtgacctagatgaaacaaatagggactttgaccttgccttcgcttgagtgcattctgccttagctctttaaaaagggacttttggtaacagagaagtactttgaaacatattgaataaattagctcagctaatctaggacatttgggttgtacagaaaaaacatgtactgggaaataatttaactgtctgatagaactttctgcagtgaaggaaatgttgcatatctttgttgtccagttttgtagtcattggccattcatggcttctgaacactcgaagtgtgattattatgactgagaaactgaattttaaattttaaattagttttaaaaattttaattaaatttaagtagccctgtgcagctattggcttctgtattggatagtacagctttagaatgtttgtcaacattaatagtaccaaggtagtggtgaagattaaaatgcaatatgaaggcttcagagcacctagcattgggcttggcatatagtatatacctagtaagtagtcacctttttatcaaattgaaacttggaaatggttaaaaatgagatgtatgtaaggggacagtgtgtaaaaactagtgaagtgctgtaaagagctaccagtaattattggcacttgccccaaatagtgtccttctgacctgagaatttcatattaacttaatcctcagggaatttagtgatcatcagggtagcatctattccatttgtttaactggaagaattatctgcaagcttctcagaggaaagttatggtttgtacttttgctctggcaagtaacatgggaagcaaagtctttaacacatacttgttttttttcttagcttgaaggatgccaatgatgtaccaatccaatgtgaaatctctcctcttatctcctatgctggagaagtaagtctgctttactttttcctctattcttttacaaagctttgtatatttcaaaataatgaaaaagtggattttaaatgttctcaccataaagaaaggataagtatttgaggtgatagatatgttaattggctttatttgattattcgacagtgtatatatgcattgaatcatcacattgtatctgaaaaatatatacaattattgtcaattaaaaatgaaataaggttgggcacagtggctcactcctgtaatcccagtactttgggaggctgaggcaagaggattgcttgagctcaggagtttgagaccagcctgggcaatatagtgagacctgtctttataaagaaaaaaaaaattacaaaaaaagaaataaaacttttttaaaaagtagaattctggcattgttttatgtttaagtagggatgtccttagagaagatgcagcattttctgatggtcctgccctgaggagctcttcctgggaacaagttgagaagctgcatttgttctgaattcttctctttgagaattcgtgttatggctttgcatctatcccataagtgggttagttgccattaacagacatctgcaatatctagtccatttcacctactcattgaaatgtagtaggcttttgaaaaatatataatcagccttgttttttagatgaatcacctggctttttttaaatgcaatgtaagttttctttcaaggattctagtttgttcaagtacttagtactgtcacttttaaaacttggggatttagaggtctctactcttttacttatgtaatatttttcctggagatctttgtattgctttgttgtagcattagagatagctttcttgcttagaaagttaactctactggccgcttgcagtggctcatgcctgtaatcccagcgctttgggaggccaaggcaggtagatcatttgaggtcaggagttcgagaccagcctggccaacatgatgaagccctgtttctactaaaaaatacaaaaacttagacgggtgtgatggcaggcgcctgtagttccacctacttaggaggctgaggcacgagaattgcttgaaactgggaggtgggggttgcagtgagcataggggtgagactactccgtctcaaaaaaaaaaagttaactctgtgagagatgattataggaaaaatgtttatcttattaactgtagaaatgatcagagtaattttctttttatatttttgttttatgcttttacaagtcagtcattaagtctactctaaaatgtctattaaatagattttgacttttatattctgcatctcaaccttttttggcatttgtgctttaaatcatcattatagcaagtccagcactgcatgacaagtgcaaattttctaattgtgtttcatttcaatcctctttttagggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtctctgg

SEQ ID NO: 37205 - DNA, 35745 bp, Homo sapiens
cggccgcgagcgcagtggtgtggagcgcgccgggtcccggagccggctgtctgagggatggacgagacgagcccactagtgtcccccgagcgggcccaacccccggactacaccttcccgtcgggctcgggcgctcactttccgcaggtgcccgggggcgcggtccgagtggcggcggcggccggctcgggcccctctccgccgggctcgccgggccacgaccgcgagcggcagccactgttggatcgggcccggggcgcggcggcccagggccagacccaaaccgtggcggcgcaggcccaggctctggccgctcaggccgcggcggcagcccacgccgctcaggcccaccgcgagcggaacgagttcccggaggatcctgagttcgaggcggtggtgcggcaggccgagctggccatcgagcgctgcatctttcccgagcgcatctaccagggctccagcggaagctacttcgtcaaggaccctcagggggtgagtgcgggggtggggaccgccgccgcgggctgagggccggcggcgctcctggggagttgggggcttcgcacagccagagggaaaagggagaaacttcacagtaccagcccctggcaggatttagggatgccactgaggactggagctggggacgctctgcggaatggagaaataaatcagaacctacttggtgggggaggagtgagcggaaaatgaaaagaggaaattgaccagatacgggccgggggctcagcggtgtggtggggcaatccgccgctggacagagactgctttctagtagggtacttagcttcacactactgggacagctattcggccgccgacttgcagatttggggctttaggcctgttctctctttttggaccgaccgaaccagtgtgtcgctgttcacggaggaggatgggtgacctatcaggggatctgagaattcagttccagccttctatgttgtgggggatgtcccctgccaccgtcccagctcttattaacagacgttgaagaaagaatgggcggactcaccagtttcatctgccctgggtattgctcacttctgggaaagggttcaaatactttttgacgactccaaagtttagatagaacttggagttttagaaacatggggccatcagctactttttctttcatttctctcccagggctatcaacagcctgcttttcaactaaggcagagcgtttgccgacctttattttgtcccctgcctgtatataaagggggatggttataggatggggcatggagtgaccagggtatctgagaagtgacctttatccttttgagaactgcagaatttaagaaataccaagtcttccctgttttcagggaagtttcagggaaattttcaggtgtgctgcaatgggtcattggaaagatgtattgttatttaaattatgggtgtcaaagtttcctcagattttccctgacatctctcctgtgtgaactctttagatggccagggtgctgttttaataggagtcctgagtggccaggacgggctgttacttgtagctcttggttcggctcattgaatgatctagttattcactcagagtttgagtcgtccctgaattaatcaagaattagagaacaattctgccatgaactcagtttctcagtttacataaactgagttggggaaagctttgcgagtaataagtctttcgaagtttctttttctttttttttttcttttttttttgagacagagtcttgctctgtcgccaggctggagtgcagtggcgcgatctcagctcactgcagcctccgcctcccaggttcaagcaattatcctgcctcagcctcctgagtggctgggactacaggcgtgcaccaccacacccagctaatttttgtatttttagtagagaccatgttggccaggatggtctcgatctcttgaccttgtgatctgcccacctcggcctcccaaagcgctgggattacaggcgtgccaccgcgcccggcctccaagtttcttaaataaaagagcttgcaagctcaagtgggaaccatcatttctagaagcaaagaaatgtgagtgccctgaggtttaaatgtcagccagaggcttgcttgctttctctttcttccttccttccttccttccttccttccttccttccttccttcctttctttctttctttttctttctttctttctttcttccttccttccttccttccttccttccttccttccttcctttctttcctttctttctttctctttctttctttttctttctttctttcattcattctctctttctcgtctttctttctttcagagaaggtctcactctgacacccaggctggagtgcagtggtgcagtctcactgctcactgcagccttgacatccagggctcaaggtcctcccactcagcttccgagtagctgggactacaggcacgcaccaccacacccggctaaaaattatttttcatggagacaagagtctcgccatgttgccctggttggtctcagactcctggcttcaagcagtcatcctcttgcctcagcctcccaaagtgctgggattacaggtgtgacccaccatgcctgtcctttttttgtgggcagagggtatttttagtttgttggcaaatgtaagaaggggctaagattatctttgataggtacaggagaaggaggaatatttttgtttttctttcatgacactgttagagctgcattggaagtgggttaggtcagctgagaagtgagctggtgctttgacagatggaagtaatacgatctcttaattctacctggcaggtaaagtactaccatctcagtacataggccacagagaaggacagaccataggtatgttacttggtgatttagggattccagtctctaaaatttcctggccactatcctttctcataggggaagtccaaacacagatgccctgacaaaactttttgacgtactcatactgcttccagtgaagaaaatgtgatttagaacaaagggcactttctaaatgcttgcggtgggttagactggcccacagacttactgtagttggaattgtcatctttggctctcctccaaatgtatttactttattaaacaaatacttacatagcatttactatattcctttaagtgctttacaaataataactcacttaatctttataaccacccttggaggtaggtactgttattatccccgcaggtgacaacacaagcccatggtataacaaatttttccaaggtctcacacctagtaagtggtagaggcaggattgggccaaggcgggttggctgtggagttcatgttctcaccactatcctttgctccctcagagtcagtcatcagaatttccatattctggacaggtgcggtggctcacgcctgtactctcagcactttgggaggccgaggcaggcgcatcactggaggtcaggagttcgagaccagcctggtcaacatggtgaaaccccatctctactaaaaatacaaaaattagccgagcactgtggcaggcacttgtaatcccagctactcgggaggctgaagcaggagaattgcttgagcctgggaggtggaggttgcagtgagccgagatcgtaccactgcactccagcctgggcgacagagtgagactccgtctcaaaaacaaaacaaaagaaaagaatttctaaattctcttctcagctactatattggttagtattgaatttgactatatgtgacagatattttaaaataatgatgacttgaaaaaaggttcatttacacctcatgtaaaagaagtctataggctagctgctcaggcatgctcagggctggcatgacatttcactttattggagacatagggttcttcctgccagctgatcagccatctttaggatatggcttctactacatggtccaagatggccgctcaagctgcaaacatcttgtctgcttttcagccatttggaagaaggaaagggagagggtgaatatgcccccatcctttaaggcacttcgtagaagttgtaggagactcttctacttacattccattgtctaaaacttagctgtagtagtggctgggaactatagtcttttttcttttttcgcccaggtaaaaatcatgggtcttgtgtctagggaacaagggggaacagagattgggagaaccagcactttctgcgacagccacttttggatcttagacagtctgaaagattcttgaagataacagccctggtcccatttctcaattttggatggtttctgtctcagtggggtccaagaacagatggaaaatgctagaagtcatggggagagtatacacatacccccctcacttacctccttgtgcttcaggtctcatgctcactcaactgcaaaagggttttttgagctttttctcttttgcgtggagtaatactagattttcacattgccaagaatcataggacagcatgtgactcactaggttaagaggattaaatgacatatcacacatgaaagccctgacgtagttcctggcacttagttggggcagctcaatcagatttttaaaaacattcctactaactgcttaattagggttcttggggtacatggtatcgaataaggctataagagttggtagatggggcgcagtggttcacgcctgtaatcccagcactttgggaggctgaagcgggcggatcacaaggtcaggagatagagaccatcctggttaacatggtgaaaccccatctctactagaaatacaaaaaattagccgggcgtggtggcgggcacctgtagtcccagctactcgggaggctgaggtaggagaatggcgtgaacccgggaggcggagcttgcagtgagccaagatcgtgccactgctctccagcctgggcgagacagcaagactctatctcaaaaaaaaaaaaaaaaaaaagttggtagatgatgcttaaaatctcgagacctacatgtatgacaaacttgactgcctcttaacgttttagtaaaataattttattatattttattatatatatatttttgagacagtttctcaccctgtcgcccaggctggagtgcagtggcacaaccttggctcattgcagccttggcctcccagtgttgggattacaggtgtgagccactgtgcctggatggttttatatatttcaacaagcccttcccttccttttgtaagaatgaacttgtaaataaggcttctctacctaaatagctaaatcaaggactactattttcctccaacctataccatagaatacagcagttcttagagtgtggcccagggatcttgacctctgggagttcctttttggggtccacaggtcaaaattattttcatcataattctaagactttatttgcctttttcattctcatttacttaggagtggagagtggagatttccagagactacatgatgtgtgatattgaaacagattgaatactaagatatgagatatagcctttacccacattaacaaatgctttttggagtccttaataatttttttttttttttttgagatggagcctcactctgtcgctcaggctagatcaggcatgatctcgactcactgcaacctctgcctcctgggttcaagcaattctcctgcttcagcctcccaagtagctgggattacaggtgcgcccaccaccatgcccggctaattttcgtatttttagtagagacaggatttcagcatgttggccagggtggtctcaaactcctgatctcaggtgatccacccgctttggcctcccaaagtactgggattacaggcatgagccaccacacccagcctaatttttaagagtttaaactttttgagaccaaaacgtttgagaactatccacttaatgtttatgaaactttaaaagaagacttttataaaaggtaatttctgtatatttcactgtgcgatgtgaatgatatgcttgaactgtcttacattttaggttcttggagaaaggacctcttttagcatagcatgacaccctcctccttgtcattgctgattagatataggaaccccgctgggttccaggttccagtaattttttgttgttgtttgttttgagaggggggtctagctctgttgcccaggctggagtgcagtggtgtgatcttggctcactgcaacttccacctcctgggttcaagcgattctcccgcctcagcctcctgagtagctggtactacaggtgcatgccaccatgcccggctaattttttctattttttttttttgtagagatggggtttcaccatgttggccaggctggtcttgaactcctgacctcaaatgatccacctgccttggcctcccaagtgctgggattataagtgtgagccactgcgctgggctcaggttccagtaattggttgtgggttctgacaccagctggtgcatggcctcttgctttcttgtgtgatttggtttttattcccaacttcatggactgctactgcttaagctatctgtacctcacccctcctttgttaaaaggggagattagtaaatgggtgttaagaaaagttgtttttataatattggcatcaaactgaagctctctcctagatataataaaggaattgaaaatctattaagagaaaaaaaacacaaaatattaaagaagagagtggatggtgaggaaaaattaggcagtagtcattttcttttccagctaaatactggtgggtgtctttccaatttgagtggttttagagtttgttctccatgaatgagaagagtattcttgattattcagtagcatagttgattttatgaagtgaacattggaaattaggccagagggtattttacctctctgtctaggaaagccaccaaatgcctgcagaatgcttgcacatcgttctccacaggctaggtcctgagcaaatgctaacataattgaattgaactgaggcttacacttagtcctgaaaggcacttgtctccccttctgtctgaatgcccttttgttcctccattcttcatactctaacattccctcattgatctagtccaggcagtattctttaataaaacccctgtactattgcataaccataattactcatgcttttggagtcattgaaatgcttcttattctccttatggtagaaggaaatcaagatgtttgagaggtcagtctttaaatgacacttgactgcaatcttggccttcaagttctgcttgctttttttttgttgttgttgtttaatttttcttttttagagatggggtcttgctctgtcacccaggctacagtgcagtggcatgcttctagctcactgcagccttgatctcctaggcacaagggattctccccgccgagtagctgggactacaggtgcataccaccacacttagctaattttttttttttttttttttgagatgctatttcgctcattgcccaggctggagtgcaatggcatgatctcggctcactgcgacctccacctcccaggttcaagcgattctcctgcctcgcctcccgagtagctgggactacaggcatgtgccaccatgcctggctaattttgtatttttagtagagatggggtttctccatgttggtcaggctggtctcgaactcctgacctcaggtgatccaccctccttggcctcccaaagtgctgggattacaggcatgattcccggctaatttttaaaaattagtgacagagtcttgtggtattgcccaaactggtctcaaactccaggcctcaggcaatcctgcctcatcctctgaaagtgctgggcttataggcatgagccaccatgcccaactttttctgtctttaagtagaagtatttaccagttgacctcagccctggtatttttcagcccccagtagtagtaggagtgtcttggcctccttttcattgaggaccagcttactgaactccataatgtgcctcagttgaactgactgttgcgttctgggacatgcttcaagttgccttttggtttccctgtccagggtccggagggttacagtggactcgtcagtcattctctgagttgtgagcctgttgctactgctgctttgttattcagaggctggggttccaggggagcagagacagagaagactgctgaggactctagctagctgctttgcataagaaagtaattctgaagacttatgatgtgaatatatgcattttgcatttgccagtaaataagttagtttgtctttaagaataaattgattctttttggagggagaaggaggagttctgtatttttcttgtcctctcaaatccttggaaggcatttttaaaggagctggcttcaagatcgaccagttattgttagcgacatggacctagctagttcctaatatgagtactgagttggtaaaagcagatgggtgtatgttgtctgctgtgacctgccattcaggaagtgacacccacagaaaaatatcttatgacccagactagcttgagtaggctgtggggtgaggggacaaggagagtcatatgatatgaggatgaatcacttggatagcatatttgcttttttcctttgaattaccagtttggggactggagggaattagatgaatgtaaaacaacctcagagggctgactggcctgttgaagaaaacactcaggagggagggccatagtttctaggcatcccatatttccaaagaccttagaagattaagttactgtctgctatagaagatggatttaatctgtgtggcatctcatgtcctggtttcttgcctatcagaattacttaagagagcttcattctaaccaagtagcagagtctttttcctgctgtgatttttctctttggataataaggctgcgagaggaaatctcttcatcattgatgaaggaatttccttaacctcattccataatagatttttttttttttttttttttttttttttttgaggcagaggcttggtcttgtcacccaggctggagtgcagtggcgtgatctcagctcactgcaacctccgcctcctgagttcaagtgattctcctgcctcagcctcccgggtagctgggattacaggtgcatgccaccatgcccagctaatttttgtatttttagtagagacagggtttcaccatgttggccaggctggtctcgaactcttgacctcaggttatctgcccaccttggcctcccaaagtgctgggattacaagcgtaagccaccatgcccggcccataataccttctttacttccttccagttggtaaagtttttagtctttctgtaattggtgcagaacaacagtgtgcataatgtaacttcggaaattagagtttatgatgttaaatttctggcataccacatacagaaagatcccgtaggataaatagggcaggggtgcatgcaaaaaaagagaacatataacctgtgataagttaattcctcatttttttgggggaaagattactttagagccctcgatatgtgcattaggatattgtatctttctggagggcaggaagcagtaccatattggcattagatgctgccagtgactcacgatctaccactgaattggcttctgtaccttttttttttttttttgtgagacagggtctcgtttggtcgcccagggtgaggaatgcagtgtgggcaatctaggctcactgcaacctccgccccatgggttcaagtgattctcatgcctcagcctctgaagtaactggaattacaggtgtgcaccaccgcgcccagctactttttgtatttttagtagagacagggtttcgccatgttggccaggctggtctcaaactcctggcctcaaattatccacccgccttggcctcccaaagtgctgggattacaggcatgaacccttgtacctggcctgcttctgtgtcttgctcctagaaatgtagcaatccatttaccttgtttgtttgaagcacaaagttagaggtaggtacttatatgagggaaaagagatggagaagagggaaaaaggagcaaggaagaaagagaagacttaagatgttctttggccacaaccctttctagcagtgggtctcttagctgcacacacgagctggtgtcttccccttaccaactgggagaaacctgagtccaactgtaagtaggaattgtctgcctatgccctgtcatttctttccagattcctgctgacttggtctgtgggctattttggtcaactcggatttaacatcctctttttctttggtctctgtagaggatcattgctgtcttcaaacccaagaatgaagagccctatgggcatcttaatcctaagtggaccaagtggctgcagaagctgtgctgtccttgctgctttggccgtgactgccttgtccttaaccagggctatctctcagaagcaggggccagcctggtggaccaaaaactggaactcaacattgttccccgtacaaaggtcagtgacccatctccaggaagccttactgcctggccacagttttcctggggcctaagccctgctacatgttagtgggaccttgggtccagtggggtcatttataccctaagtctgggttctcgatcttttttcgggaggatggcaggattaggcttatgatttgatcacctgatgaaggctatcttttgaaggatacacacacaatttttgcatacaattttaggaaattcacaaacttctactgcatgtttatggctcccttggtctttgaatcccagctaaccccaagctagttagaaacctagtgactttgtggcttactctcagacttctgagccatcccagcatttcgatacagtctaggactggctgatgacagctaagaacttctgcagggtctgacaaggaagactttaggacaggctgagggttagaacaatggtctggcctgaaccctacagggaactgacatggaatatttctaacttatctttatgctgtcgaattttgggacttgtctgaacacatcaaaataggggtgccagatctaggcaaactcacactcagaatggattcatacacatcttgtatgtgttatagacatagttgaggtctcccccaacccccacccccaccaatatgcttgaatacagaattgattgcatacaatttgagggagtttactgacaccaggctaagaacccctgcactacaaggtattccatgaaactcaccaaaggttatgaggggaaggaatctactggtcagcatatgaacatgtccggacacatcattcactgagtacgtggctacctggggtttagtaacaacttaggtgggactctcatctgatgccctgaggctgctgagtcatctaaacaatcctggctccgtgcttagtcttaactagtctatgctagtttatttagttatttactaaataactaaaactaaatttatttagttatttagtaaataactctttgagaatctgatgaaacctatagaccccctttccagaaaaagtacatatatttgcaattattgttttgtgtataattttagggcaatggttcataaacgttgcagtctatctgttgacaccccagggagcatgtctctagattaaaatccctctgcttaaagttttcttttctttcttatttttagagacagggtcttgctctgttgcccaggctggggtgcagtggcatgatcacaactcactgcagccttgacctcccaggctcaagcagtcctcccacctcagcctctcaggttgggactacgggcatgtgccaccatgcctggctaattttttttttttttaattttttgtagagacaaggtctccctgttttgcccaggctggtcttgaactcctgggctcaagctatcctcctgccttggcctcccaaagtgctgggattacaagtgtgagccaccacacccagccttaaagatgtcttctcaggtttagatagcagattctatgagcaaagagattgatcagcagtagaaacttcccttccgtttgagaggaaaatgtgactattgtggatatttaaccatgtctgctcctttgctactaaactccaaacaattagccaactagtttgtaagttatagaagtcagagaccacttctcaagatttcctctctcattctcagcacctagcaaaatactatatttatagtaagcattcatgaagtaccagctgagtcagtaaatgaatatgaaatcatgagaaacaataccaaagttcttccaactttaggtctagcgagaaaatgtttgaccaggcttctagttcccatttcacatctaattcactgcctggctttgtacagctcattccttctctttatgccttacttttccctctctgtgcagatagttttacagcatgctttgaacatcttgtatgataattaatgttcttaagtctcctaacctgaaatgcttctactaggctcctcttagactctagaaacttttacattctccttgcttatcactctatagttttcttcctttactaggcaaatagcagaccgtgtctggctctatgcctacctgctctgttggtgcttctggagtgtggtgcccaagaatcagaggacttgagtttgaattcttgctctgcagtttttgatttgtgtaacacttgggcaagtcatgtaacctccctaggctcagtttccttactgtaaaaatagggatataaatagttcctactttgtagagtggccatcaatattacacaagacagcctatatgaagcacatagctgagtgagtgccaggcacaacgtaaaccctccatatgttagcctgtgatatttttatcagctattctaatcgttagtgtcacccccacaatccctttcgtccctatctttggtcttcctctttccctgttagagaaccttcacgaggcctgaggatcttttgcatcagaaagtcagcaacaacaaaaatacttgtcttggctgggctcattggctcacgcctgtaatcccagcactttgggaggcctaagtgggtggatcacctcaggtcaggagttcgagaccagcctggccaacagggtgaaaccctgtctctactaaaaatacaaaacttagctgagcatggtggtgcgtgcctgtaatcccagctacttgggaggctgaggcaggagaatcgcttgaacctggaaggcagaggttgcagtgagctgagattgtgccaccacactctatcctgggcaacagagcgagactccgtctcaaaaaaaaaaaatacttgtcttccatgagactgagatgagacagaactttggaagcttaacatatagctgctggagaatagtaagaggactcctctccctgtctccccaactcttgtgacaggactctatccagttgatcagagcatctgtcattatagaaacaaggttcacattgcattggaacttcaaatggtaaggctctaattctcactcactggctgtctctgctctctgctcctatgaggtttcaggttatgatagtttcattagtcatggggaaaaagtggtttgttaggaagaatgatagaaaataaatatgatgggggcaaaaggggatttatggcttgagagagccaggagtttcactgtggacactggcaaggtagccttaggaaagctctttttccttcattcctatgcctgagttttctgatttgtaaggcagggagtgcctactacagtaccatgcacatccattttaggtagtctattaatactagatggtagcatggagcgatagatgagaggcagttattttgcctctcaggttcatgggaaaaaaaatagttatttgtaataaattttacaaggcttaggaaaatacctttcttataagtttgattttaggtatttatatgctaaaactcacttgttgctgtctctgaaagaagcttgtaactcattcttcattcacttaataaatatttaatgagcatatgccagctactgtgttaggtgctgtggatgctaatataaataagatgttctccgcttcctcaaatctcattcattttaaaggaggagttagatatacaaatggataattacaagacaatgtgataagtgtgacaatagatgcatatgtggattacaattacgtcactgcaatttgacttaagtataatattgatggctcataaaaattttttttagaataagtaatgcatgcatctagtataaaaatcagaaggcacatagggtaaacagagaaaagtaattcagactccctgctacccctatctcctggccattcagtttccttcctcagaggcagccaggattacagtgtatagcctatacataaaaatagcagttaattaaaatgaaaaccaattttaatgtttgtgttttgaatacgaataatttcacaaagtaaaaaaattcaaaagggcccgggcacagtggctcatgcctgtaatcccagcactttgggaggccgaggtaggaggatcacctgaggtcaggagatcaagaccagcctggccaacatggtgaaaccctctctctactaaaaatacaaaaattagccaggagtggtggcacacacctgtaatcccagctacttgggaggctgaggcatgagaattgcttgaatgcgggacttggaggttgcagtgagccgagactgtgccactgcactccagcctgggcaacagagtgagactctgtctcaaaaaaaaaaaaaaaaaaaaattttttttcaaaaggaaatgaaggggtacagagtaaattgcaacttgtttgtctctggaaagaagatgggcatttggcctaatctaacccaggagatgacagtgttaatccttgtacttcatactagctgctgtaacaacccttaaatctaagtggtttaatacaattggattgtatttcttttttatcatattttttttgggacagagtctccctctgtcacccaggatagaatgtgcagtggtgcgatcttggctcactgcaacctctgcctccaaggttcaagccatcctcccacctcagcctccgaagtatctaggattacagacgtgcaccaccatgcctggctaatttttgtatttttagtagagacggggtttaaccatgttggccaggctggtctcgaactcctgacctcaagtgatctgcccacctcggcctctcagagtgctgggtttacaggtgtgagccaccacgcctggccaggagtgtatttcttgattacatctcagactcatgccagataggcagctctcctagataccacatcactcatgtagttacaaggtatccgaggttcttccatggtgtggctctgctatttcccagcccttctttcctagctgcacagactggagaatgtgaattaaggattgtgggagattttagttgccagcagtggaagtgttgtacatacataattttgtcattatttcattggcccaaactagttatcttccctctcctagttgctgggaaggctgagaaatgtattctttctgtgccctggaagaggaataggatttgtgaacatcaagctatttattctctgccatagtcttctggttccttaaacttgactctaaccttagtatctcttctctttcactgtaggtagtatacctggccagtgagaccttcaactatagtgccattgaccgagtgaagtccaggggcaagcggcttgcactagagaaagtgccaaaagttggacagcggtttaaccgcatcgggctaccaccaaaggtatagacgcacctctggcttatcaagggtcatgatttatagtgacatagtcatccaagtggtgaagcaaggtgcctacaactcaaatatgggcacgtgaataacctgccctgaggatcctgtcttccttatttctgtcaagtggctaaggtttgaaaagttgagacctaacttttcactttactcctctggttcatttggataggttctttaatttggatggatgatcactgttacatctcttttctcctgtacttgcaagaaatgaggaagtaaagatcttgaaaagttttccttctctgatacaaactccatagggccttaatgggtatctggcatatactccaaaggtctttggatttgggcagtagggaaaaacctttgttccttcctcttggttccaggttggttcattccagctctttgttgaaggctacaaagatgcagactattggctgcggcgttttgaagcagaacctcttcctgagaacactaaccggcaactactgctccagtttgagcggttggtggtgctggattacatcatccgcaacactggtgagcagctgcaggtggtcccatgccctgtgccagactgtgttgaggcatggggaggcctggaggcttgcagggcttgggagtcagagtaccttgtccagacacatcatgtgtagttttcagaagtggtgaggcctggagttagtatttgcattttatcttacactctttcctggttccagacagaagacacttaactcttccaaagcactgtgaagagtactcttatccttgatccctagtcattcttgtagcctcaagacctgtaacaggacagttttgtcttcctctgacttcttgaggtagatgtttagatcattgatatttaaaaaaaattttttttcagtgcaatttaaattcaactaacctggtaaaatgtacatgtattgaggacaaaagtctttaaattcaggctggatgtggtggctcatgcgtgtactcccagcactttgggaggccaaggtggacagatcatttgaggccgggagttccagaccagcctggacaacatggtgaaaccctgtctctactaaaaatacaaaaattagccgggtgtggtggcgggcacctgtagtcccagctattcaggaggctgaggtgggagaatcgcttgaacctgggaggcggaggttgcagtgagtcagaattgcaccactgcactctaacctgggtgacagagcaagactctgtttccaaaaaaaaaaaaaagtctctaaagtcaccttattggagctatattttgtccgatattttaatcatagtaaaatgcatgtaacataaaatttattatcttaaccattttaaagtagtatgaaatacattcatattgttgtgcaactgtcaccaccatccatctccagagctctttttgttgttgttgagaccgagtcttgctctgtcacctaggctggagtgcaatggtgcgatctcagctcactgcaacccctgcctcctgggttcaagtgattttctcacctcagccttctgagtagctgggattacagacacccgccatcatgcatggctaatttttgtgtttttatagagatggggtttcaccatgttggccaggctggtcttgaactgacctcaggtgatccacccatctcagtgtcccaaagtgctgggattacaggtgtgagccaccatgcctggcctccagaactcttttcatcttgtaaaactgaagctctatactcattaaacagtaactcttcattccccctccctacgtccctggcaacaatcattctgttttctgtttctatgattttgactactctaagtacctcatgtaagtggaatagtacagtatttgtcttttggtgattcgcttattcacttagcataacgttctcaaggtacatctatgatgtagtatatatcagaatttccttcctttttaaggataaatactgatccattttatgtatataccacattttgtctatccatttatctttcagtgaacacttgggttgcttctgcattttagctattacgaacaatgctactatgaacatgggtgtacaaatatctcttcaagaccctgctttcagtttttttgagtatatatccagaagtggaattattggatcatatatggtaattctatttttaattttttgaggaaccaccatactgttttccacagcagctgtgccattttacattcccaccaacagcacacgagggttccttccaatttctcaccagcacttactgttttctgttttttccttttcatatttaatctgcattctgctgaatgttttctgttgttttgatagtaaccatcctaatgggtgtaagatgttatcttatagttttgatttgcatttccttaatgattagtgatggtaagcatcttcttatgtgctgattggccaatcatatatcttctttggagctgtctatttaagtcctttgcctatttttgaattttttttggtcattattgttgagttctctatacatttgtttaaagttctctgtatatctggctattaatcccgtatcagatatataatttgcaaatattttctctcaatctcttgcctttagttttattttttaaagagacagagttatgctctattgtccaggctgaagtgcagtagcacaatcatagctcactacagcctcggactcctgggctcaagtgatcttcctacctctgccacccgagtagctgggactacaggtgtgaggaccacgcctggctagtttttaaattctttgtagagatgaggtctcactgcgttgcccagactggtctcgaattcctgggctcaagcagtcctcctacctcagcctctcaaagtgctgggattacaggtgtgaacaactgcgcctggcttgcaactgatttttttgtggattgactttgtatgctgctactttcctgaattattagttctagtagttatttttttgtgtggaaattttagggttatgcacctacacaatcatatctatgaacagacataattttccctctttttttttttccaatttgggtgctttttatttcttttttcttgcttcagtgctctaagacttccagtactatgttgaatagaagtaaaagcaggcatcttttcactgttcttgattttagaggaaaaccttgcaatctttcaccattatgatgttagggtcctttttgcccaccttggcaccctcaagctatttgcaagctgctcctggaacttgtgcacatctggctgccatgtggctgaagggtgggggatgggtagctgcttgtggggctaagagccaaaattgaatgaaattaaccacaatttactgtccaggctttcccctgcaagttgcaggccctccatagactccagagctccaaaataattacatcagacagatttttgccactacaattgttgtccacgtggggagacagatttctgttgtttcctactccaccatcttcccagaatcctctctcttagagtattgatttttaccttttctcctttcccttccttttcttttctttttctttcttttctttttttttttttttttgagacggagtctcgctctgtcacccaggctggagtgcagtggcgcgatctcggctcactgcaacctccgcctcccgggttcacgccattctcctgcctcagcctcccgagtagctgggactacaggcgcctgctaccacgcccggctaattttttgtatttttagtagagatggggtttcaccgtgttagccaggatggtctcgatctcctgacctcgtgatctgcccgccttggcctcccaaagtgctgggattacaggcgtgagccaccgcgcccggcctttttttttttttgagacggagtctcactctgtcgcccaggctggattgcagtggcatgatcttggctcactgcaacctccacttcccaggttcaagtgattctcctgcctcagcctcccgagtagctgggactacaggtgcatgccaccacacccggctaatttttgtatttttagtagagacagggtttcaccatattggtcaggctggtcttgaactcctgacctcgtgatctgcctgccttggcctcccaaagtgctgggattacaggtgtgagccatcgagcccgggctcttcttttctaatatatgcacttcagactttaatttcatcttaagcatagtttagttgtatcttacaagtgttttttttttttaccataatcattataaaatatactgaaattttttttatcctctcagtttatagatggagactgtattttctaatttccattgttcatttcttctctgacccatagtttacttaaaatagttttttagctggttagtaggaaaatttcaaaatacacaaaagtagagagactggtataataaaccccatgtacttgttaccaccttcaacagttattatgtaaggtctcacttcctgctacccccatccctgctggatttttttttttttcaactaaggctttgactggaactgctggattttttaaaatttatttttattttatattttttggagacggagtctcactctgttgcccaggctggagtgcagtggcccaatctcggttcactgcaagctccgcctcccgggttcacaccattctcctgcctcagcctcccgagtagctgggactacaggcgcccgccaccacacccggctaattttttgtatttttagtagagacggggtttcaccgtgttagccaggatggtctcgatctcctgacctcgtgatccgcccacctcggcctcccaaagtgctgggattacaggagtgagccaccgcgcccggccactgctggattattttaaagcaaatctgagacatcattttatagcatccatagatacctccatatgttcttgaagagataaagacttttttttttttttcagtataatcagtatttaatgtcccatcagtgtttggattaccccagttgtttcataaaaaaagatttttataattggcttgttgaaattatgatataaaggtccacatattacatttggttaatatctttcctttctgttttttttttggagatgggatctcactatgttgcccaggctggtcttaaactcctgggctcaagcagtcctcccacctcagcctcccaaaatgctgagattacaggcatgagccactgtgactggccaggttaatatgtttcttaaatgtcttcaatttagggaaagtttcacatctttttttttcccttgccttttatttgttgaagaaactggatatttgccctatagaagttccacattgtggatttggcatccccaattctctgtgtttcctgtaaatttactgcttgagtttaaaggcttgatcaaattcaggtttgatttttttttttttttttttgaggcagggtctcactctgttgcccatgctagagtacagtggtatgatcatagctcattgcagcagcctccaacacttggctcaagctgtcctgcctcagcctcccaagtagttgggactataggcacgtaccaccacacctggctaatcttatttacaatttgtttagacatggggtctcgctattttgcccaggctggtcttgaactcctggcctcaagtgattctctgcctcctcagcctcccaaaatgctgggatttcaggtacagcctctgctgatattcttaatcttgacttttatctttttaaacatattaaggattttgttgtgaacattttaaagtctgtatatttttattgtttggagcccctacagatctgttttaattttcagttgtttctcttttattcctgtcatcttgtttctttgtgtacctggttgtttttcattgtcaaatactgcctatcagaaatcgtagagctgtataaaggcctaagatgtcattgtaaatcctgtctggaggaagatttcttttggcaagcatctagggcaatagcaatccagtatcactttaatttcaggtgttgaggggagcttagtgtatttccaaggtgtagtgcttcaggtcgtaacccaaagcatagatgatatacgagggtcccttacccctgatcagtcactggattatagtttttgtctctctagctccacaaggctcttataattgttctacctctcaagctcttagccagctctttccaaattggcaggtgctctaggggaaaagaagccacagtgctgggctccacgtcctcccatggatttcctttctctcccatatcttcactcttaaatcctttgtggtcttattaaaatctccagtaccttaaaaaagatctaaaaatattttatccagcatttgtagtcattctcagtagaagcgttagtccgagtgtccagaatacctagtccaccattacaaaaatggaaaatcatcccccctttttctgctaactttatatttctgttcacagatcgaggcaatgacaactggctgattaaatatgactgtccaatggatagttctagctctcgggtaagagactgagataaatcttaaagagaatgaagagtatttgcataatatagaaacacataaaatggtcagagatgtagttcatacaagttcagaagaatcggggggcgcatatgtttaaaattaataggttaatatttggtaaagtttttctcaatatgtgtttcaaggacatcctactgacacatgttaataggaatagcatgaagaaagggtcaagtaaatttggaacatattatgtactctgttctttgagcttcttattgcacagtagcatagtaaaggtctgagaagtactacgttaaacaaacctatttaaatttgatttctaccccttttaaaccatgaaccacttttctcacaacagaccgcaagtccacagaacataagtttagaaaaagctgctcctgcaactttctttcctttctcattcctttcatcctccaccatacttctctatcactgttcagtctacatgttttacaaaattagcagaaggctgcctaggggagagtgagattggttttatttcttttttcttttctttcttttttttttttttaagaaacagggttggccgggcatggtgactcacgcctgtaatcccagcactttgggaggccgaggtgggaggatcacctgaggtcaggagttccagcctggccgacatggtgaaaccccgtctctattaaaatgcaaaaattagccgggcatgatggcgggagcttgtattcctagctactcgggaggctgagactcgagaatggcttgaacctgggaggctgaggttgcagtgagccaagatcacaccattgcattccagcccagacgacagagcaagactctgtctcaaaaattaaaaaaaaaaaaaaaaaaaagagacagggtcttgctctgttgcgcaggctggagtacagtggtgctatcctagctcacagcagccttggactcctgggctcaaagcagtcctctcacctcagcctcctgagtagctgggactacaggcgcaaaagttgtttaatgttttgtagagatgaggtcttgctatgttgcccagggtggggttttcattccttataacttttttactttctctaatagtggctctcaaattttgtgcctgaatcttctgaagagttatttaaaatagtacacagattcttcaggcctttcccttagaaactgattcatcaggtctggagtaaaactcaggattctgcacatttaataaggtatctcaggggattcagattcaggcatcctggaaccacagttcttgttcctgtgatggcacccatgaacctgaagcatggagccacatagtcagtgattgtctctgacatgggctgtcacaggtgacatgcccactctttttacattcatctcttgtccttttccttttcatgcaccactgaagcaggagaacagactcccttgtgcaagagcagccagctgttatcttccgaggctctgttttctcactggaaaatgtagttgtcaccagtgaagtaacatctgagtcaaggtccacacaaaaggaccttggccaactgatatggattttatttcttctgttctgctttcaggattctcattttctttccctaggaggaatggcttatagttatctttattattgtcatttccttcttaccaaggactgtagcaactcttggggaagtgtaccttttctaagataagaacaggactcttgaactttgaacaagagccaggtcagaggcaccaaaatgtgctaagttcagataacaacatggaagccagttcagagagtagctcaagataagttcaataagaattcttctcttgagggagttgggatgagttgctttgctactaattggaagggcctgagggagatgggtttcctcagtcattagtctttccttgctcttcaggacacagactgggtggtggtgaaggagcctgttatcaaggtggctgccatagacaatgggctggccttcccactgaagcatcctgactcctggagggcatgtaagtctccagacaatggtggtctggctcttcccttgctcagtatattttctcactgtgcagtggagatgataatgtctctatcataggattattctaaaaattaatgaaataatggagttcaggcactttaacacaatggctggcatatggcaactatttcataatgtaagctgtttttctaatttttgtcttctatgattcccattacaagcataaaggtgattagaaattagaagcataaagatgagttttctcattgtctctttgcattcttctcgttctttctgaggactttttttttttggaaatggagtttcgctcttgttgcccaggctagagtgcaatggtgcgatctgggcccactgcaacctccacctcctgggttcaagcgattctcctgcctcaacctcccaagtagctgggattacaggcatgcgccaccacgcccggctaattttgtatttttagtagagacggggtttcaccatgttggccaggctgttcttgaactcctgacttcaggtgatctgcctgcctcagcctcccaaaatgctgggattacaggtgtgagccactgcgcctggctgagggctatttattttttatttatttattttttttttgagacggagtcttgccctgtcgcccaggctggagtgcagtggcgcgatctcggctcactgcaacctcctcctcctgggttcacaccattctcctgcctcagcctcccgagtagctgggactacaggcacccgccaccatgcccagctaatttttgtatttttagtagagacagggtttcagtgtgttagccaagatgatctcaatctcctgaccttgtgatccacccgccttggcctcccaaagtgctgggattacaggcatgagccactgcgcccggcccttttttaattttttaatttgttattttattgttttagtgtatatttcctgaaatatctttttttttcctgttatctgaggactgtctttccataatttattctaattgtgcctctaaatataagcttcctatcagtgttctgtcttccttgttccatctcctaccctgttgtaactgagaagcttctggaaaggaggagaaataaatgtagggagtcagtagccccttttgcagcattagtcttccttttcagaaggaccatctcagcgtctcagtggcaagtagttgcttctagaccttgcatcttggaaggtcatgtaatgtctgagaatgagctctgacattaggcagccctgggtttgaaccctggttcctctactgactagctgtgtaacctttacagttaagagcacttgtaagtttttgtttctgttgtatgtcagggaagaggggttctcctttagaaagtgccttgactggtggaggacacagatgagcagggacttttccaacaccagctttgcctttgacttttcctcttttcagatcctttttactgggcctggttgccccaggcgaaagtcccattttctcaggagatcaaagatctgatccttccaaagatatcggaccctaacttcgtcaaggacttggaagaggacctatatgaactcttcaaggttagccctgggaacctcagccctattatcatatgggagaaggaatttttaatggtttttttaattggtcctgacaaaagccaagaggaaatggctaacacctttctgacttgagttagccaacgaatagcaagatttccacatgtggacagcaggacctggtttggatgggtttgagagaaatgggcaggggtgagaaatcacactgatgtgtctctcctgtccatcatgtggctgcaatgtatctgcagggctttcattttaatatggagcactggagcctagagtttgagatgcagaggaagatattgacttgttttctgtttcctcatctgtaaagcagggagttcttgtgggagtagttgacttcacaaagctgcagaagccttatgcaggttttccttcttagaaagtttctaactgggggagaaaatgggttcctgtgaggcattcacacaggttccatctccttctggtcttcttttgcagaaagatcctggtttcgacaggggccagttccataagcagattgctgtcatgcggggccaggtaagcctgggacatcctcccagtatctttggcgtctctgggagtgttgtgtgctcaggttgagcaaatgtttgaagtttgtgttttatacccccccctttttttttgagaccgagtctcactctgtcacccaggctaaagtgcagtggcatgatctctgctcactgcaacctccacctcccaggttcaagcaattcttgtgcctcagcctcccaagtagctaggattacaggcgcatgtcacaacgcccggctaatttttgcatttttagtagagacagggttttaccatgttgaccaggctggtctcgaactcctgacctcaagtgatgcacctgcctctgcctcccagagtgctgggattacaggcgtgaggccctgcgcccggccgtgttttacagcttttttaagtccgttgtgtacattatttttggctgtaccttaacacctaggagaggaaaagtggccctcccaattctcccacctcttccctggtatccagtgcttgttgaagcacttaatgtgcactcatctctatgctagttgctaggtaattcattggtaattaaactaatgctctctgtcctagagttgctcaaggcaggctgtatgttttggtggttaagatctgggccctggagccagactgcttcactacttggaagctctgtggcctggggcaaaagcctctgttttcttgttcataaaacaggatagtaataatacgttgcacagttggctggagaatttcatgagataatgcttatcaagcgtttagtaaaaagagtactgggcacatgaagcactcacatattgattatggttataattttgttgttataggtgcaacttacattattccttctccttccacttcaccttcaaagggagctaaggaaaccaaggggattgttgatcttccaaagcatagtaaagaaatgcttgaaaaatggtttgaaaactctgtagggtactggtattatgcctatcactttgaagtcttcttaaagagagttgggatgacctagtggttaagggtgcaaactgtggtcacagtgcctgggtttttgaagcctggctctgccatttactacctgtgagattttgggcaagttacttaatctctccttcccttagtttcctcatgtttaatgtgggatcaataatagtagctgagaccaggcatggtggctcacacttgtaatcccagcactttgagaggcttaggtgggcagatcacttgagctaaggagttggagaccagcctgggcaacatggtgaaaccccatctctacaaaaaacacaaaaattagccatgtgtggtggcgcacgcctgtaatcccagctactcaggaggctgaggtggaaggattgcttgggcctgggaggtctaggatgcagtgagctgagatggcaccactgcactccagtctaggggacagagtgagaacctgtctcaagataataataatggtacccaccttacagaattattatgagataaatgatttgaaacagttagagtagtacctggtatactaaaatactcaatttgtagtattaatagctgttaggattatgatttttgtatacagaaaattcagcttctcccatctttaaagggcaagaggatcttctcagccttaattctgcatttacttcttcctgccatttatctaaagacctctgatgacagcacctcctgggtttgctgagcccatttttccctggaagggggttggacagaggttttttttttcttttgagacagagtctcactctgtcacccaggctggagtgcagtggtgcgatcttggctcactgcaaccttcacctcccaggttcaagtgattctcctgcctcagcctcccaagtagctgggattacaggtgcatggcaccacacctggctaatttttgtatttttagtagagatggggtttcaccatgttggccagggtggtctcaaactcctgatctcaggtgatctgcctgcctcggcctcccaaagtgctgggattacaggagtgagccactgagcccggcctggacagaggttttaagaactacaattattgtagctgtctgaataccagtaacatggtattcctacatttcccaagtaatgtaagggcccaattaggctggcagaatttttggaagcattaaaagccatgtgatagactcagatgttatggaactcagcataaaggagtaaactggcttctccagttgatataggctgtgcctctgtccgtattgcaatgtcttatctaattccatcccagctcagtcccttgccaacccttctcccattactcagatagtgccattattcaggatggtagggaggttggggtagtgcagttttatttatctccatcttgtgctcctaatgtcttcagaggagcttttggtatcttgtaacctaaagtgcctactaccttagggtgaccatccagctccttccaacatgtacatggccagtatatcactcatgtgcttacttgtctaccattcacacatcaaagcaaaatgtgtgcactacaaaatttctgcactacagaaatctgacaaagcacagagaaaagaggtcataaccctgtctacatagctgagccattattgcaggatgggctgtagtacaagggccctgagatgtagggaaagagtgaagaggccccacagggacacagtcaggtgatagaagttgttactcaacttaaaggcttctcaccgggagttaaagaatctagggtctgagagaaagcctctgtaacattttctttttcttttcttttttttaaagacagggtcatgctctgtcacctaggctggagtgcagtggcccaattgtagaccactgcagctttgaactcctaggttcaagaagtcctcccccctcagcctcctgagtagctgggaccacaggcatgcaccaccatttctgggtaattttttttaagaggtggggtctcgctatgttgcccaggctggtctcaaactcctggcctcaagcgatcctcctgccttggcctcccaaggtgctgaaattataggcatgtgccaccacatccagcccaacattttcaaagatagtatttattctttagtattatgtgactgctataatttttcttcaaatttaaaaaataatttttctttttaaattctttattctcctttcttttcagtcctggttccaggcttatcttcagctttttaatttggaaattttcaaacctcagtaaagttgaaagaatgggatcttctagattcttcagttgttatatttaaccacatttatctcatatgtctacgtattatccagtgatgtatctgaataatatctatttaatttctctccctagatattcttttttgccaaatcttttgaaaataagtagtagacaatttgacatgtttaccccagatactcccgcaatctccttttagttcttcaccccaatattgtgcttcagactatttggaacagtgtaggatgctggcaagtaccaaaacaattaagtaaaaaagaaatttgttaccaatagggtaacaaatgacccctgttgcagttgtatctctgctcctttataggcagcagttgtgtaagaggatatttgtggcttgagggctgtgtgtctgtgtgatttcagggtgcagcctagcttacccctccatgttctgtgacctggccatgaaatcttcaacatctagtgttttaaagaagatagggccaggcgtggtggctcatgcctgtaatccgagcactttgggaggccgaggcgggtggatcacctgaggttgggagttcgagaccagactgaccagcatggagaaaccccatctctactaaaaatacaaaattagctgggtgtggtggtgcatgcctgtaatcccagctactcgggaggctgaggcaggagaatcgcttgaacccaggaggtgaaggttgctgtgagccgagattgtgccgttgcactccagcctgggcaagaagagcgaaactccgtctcagaaaaaaaaaaagagagagagagagaagacaggacaccttcagcttttgtactctcctaccagagaagataaatggtggtgatactaattttgacaaagaggagaaactgtgtcctcatggacacataactgaaatacctgtaaaatactgacaaaagatggtgaggactggactcagtggctcatgcctgttatcccaacactttgggaggccaaattgggagggtcatttgaggccagaagttggagggtgcagtgagctatgaatgtgtcactgtactccagcttgggtgacagagtgagaccctgtctcagaaaagaaaaaaaaaaattaggggaaactgggcaaatgctatataggaactctttgtacaatctgcaacttttctctaaatttaaaattattccaaagtaaaacatttatttaaaaaaaaaggtgatgaagagatagtgttagaaggagaatccaaataaaatgttggctttttactttttgtttgtttgtttgtttgtttttttgagatggagtcttgctcatttgcttagactggagtgcaatggcacaatctcacctcactgaaacctccgcctcccgggttcacgtgattctccctcctcagcctccccagtagctgggattacaggcactcgccatcatgcccagctaatttttgtatttttgtagagatggggtttctcaaaatttttgtatttttgtagagacaggctgatctcaaactcctgacctcaggtgacccgcccacttcggcctcccaaagtgctaggattacaggcatgagctaccacgcccagccagctttttacattttacatttatatcatctttgtaggaaaatcataaaatagggatgaacaacaataaataattaaaaccacctataatttctttcttttttttttttgagatggagtctcgctctcttgccaggctggagtgcagtggcgcagtcttggctcactgcaacctccacctcctgggttcaagcgattctcctgcctcagcctcccaagtagctgggattacaggcatgcgccaccatgcctggctaatttttgtatttttagtagatatggggttttaccatgttggccaggctggacttgaactcctgacctcgtgatctgcccacctcggcctcccaaagtgctgggattacagacatgagccactacgcccggaccaaaaccacctataatttcttgagacccagagatgaccactgccaactgccagacttttttctacactatagttagatagaaagatagaatttagaaagtaaaagtggggtcacaatctaacactggttccttttctgctttcctttgcatctaacacaacattgtgatcgcttctttgccaatacatttatatatatatttgatagttccctggttaaatttctatatattttaggataattgtttcttatcccttcaagtattaactagtttacatcttttcactgttataaacaatattacatttgtttttggaactaaatgttttatgcatatccattagtgtttcttaaaaatggaattgccgagtcagagggtctgttcttttttttttttttttttttttttgagacagggtcttgctctgttgcccaggctggagtacggtgacatgatctcagctcactgcaacctccacctcccaggttcaagtgattcttatgcccagcctcccaagcagctgggattacaggtgtgcaccaccccacctggctaatttttttgtatttttagtagatacagagtttcaccatgttggccaggttaggatctgttcatttttaagtgttttttgtgttttttttttttctttttgttttttgagatggagtctctcactctgttacccaggctggagtgcagtggcacgatctcggctcactgcaacctccgcctcccgggttcgagcaattctcctgcctcagcctccccagtagttgggactacaggcgtgtgccaccacggtcggctaattttttttggtatttttagtagagatggggtttcgccatgttggccaggctcgtctgaaactcctgacctcaagtgatctacctgcctcagcctcccaaagtgctgggattacaggcgtgagccagcgtgcctggcaagtatttatttttttgaattctccccaactctgcgtcgttcttttgtatctttactaactggagggcaaaaaaataaaggatttgttttcatttgtattttttaaatgattagagaggtttccattttctgttttgctaatttttacttttgtaaatggcctatttgcatgattttccattggtattttaaaaaattgatttgtaggcgtcctctctactgatctcctttcagaggcagatctggaatgctgaggcctctccctcacccatctcctttttcccactgcagatcttaaatctgacccaggccttgaaagacaacaagagtcccctgcacctcgtccagatgccacctgtgattgtcgagacggcccgttcccaccagcggtcttctagcgagtcctacacacagagctttcagagccggaagcccttcttttcatggtggtagctccagaggcaggcagaggaaatattgtcagagactggtgggaggaagcctggggagtggggtgcaggaaaagccagagaagccggtggagagcagcacctttaagagccctctctctctgcttgccaccctgctcagagctttccacccacagggagaagcacaatcaggaacagtgagtgctcctcgcccttctgatgtgggggaggctggagctccatgcacgtagtccagatgcctgggaaggaacatctcccttccagcatctgctggtagcaggctgggacagtcccttccttccctgaaaccctgctctattgcaattccctattatattctgcatcagaaaaacaaacaaaacaaaaacaactttaaatgcttgtagcagaaccccgggtcatctcatgtcagaaacctttaatccaggcctaaatttgcatagacctgacattcagctgccttgcagttgcttcctcccatgagccaaggtggtgtcagagggcaactggatgactcgcagtaccacagcactgggacagacagaagccacacctttcttttgggtttttgccaagcctcctccatctcccatcagtgctgtgggctggctgcaagcctcgaaacagttctcctggaagggaggtttttgctttacccccgccagcacttccgcacacaatcatagagaacctctctgctctctgctggcctacagcttgtctgtttctcaagcagaggcaggaagagctagtcttagcatttatattttaataggaagttgactcccagcatgtaaaagtgatccacgcagccggagtgtatgccgggagctaagtggtctatgggtgaacatatcccaccttgcttcctgagtccttggtcccaatcttctcatttgttcctctcgttttaaattttttccccccaactcttttgatgtaagagttcagtttgtcttcgggagtgggtctctgcaagggctctgggatgagtcttggcttccaagaggacaggctattaggttcttggacttttttctgtgctaccgctgctgcttggtggaagtaacaggacgtggattctgcctcataagtggcagtttcccttttctctctgacttgtcctaggccgatttctctatggcttccctgagaaaggtgaggcccaaaggagagaggccttcaaactgtcccaggtcctgcgcagctcagtgcgtatcttcttgcttccatgtgtcttttcccctgctgcctcactccccacccccacttgccaggtgtttgagccatttctacaccaaagcaaagtacggcctcaggagggagtaaaaagggtgccatctgtgtctggaggggcagctgtgttcatgccctgtgctactggacatttcacaattctggcaccttgcgattggtcagtcaacctcagaaagtaactatcttgaaggtttgaaaaacaaccaaagaaagggagtgaggactatggctgcatgtcctctgcttgcccggctgcagagcagagatgtgcagccctctggtcagctggtccaggctggtccccgccggtccccttccagtccagccaccaagagtccacttgtcccgggcttccacctggctgacaggaagaatttctgagagctggatgtgcatgccctgtggacgaaggtacagctcgcctgcctgccccaatcccagccccgacaatcacatgcagctgactcggacactggccttgggaacaatgttcgagagaacacttgccccttgactgtaggagccagaaggggacccaggtgtgcatagctctctgtagacatttttacccaaacctgttggtaaagtgcccatctggtgctcaagagagcctgggggtctaacagggagcccggctgcctcacctggccacagcctccacaccagatctccacattgtcttgatccagaccagctctgtgatcagaaggaaattgggtccagtgtaggagagagctggtcctgggcctggcaggcaagagtgtgggcatcctttcctggcctttctccactctccctcaagcctgtgctcaggttgccttgaatgtggactctggaagagccaggggcccagaatgccgggggaggcttctgagtggcactcatggaacaccgtccctctgccagccataggccctgcctccagtgtcagggaatggaggctgggctgcgagagtgttgctgccccctgtgtcattcttctaatccaatgtagaaattgtacgtaatgtatttaaatcaacgcaaatgtatgaataacaaatacagttctgaccttttttgtccagtttctttgggggaaggaagacaaagaaggtaggaacggaattttgagggcaaagaaacctgtgtttccatggaattgctgagacgtggctcctggggctatttctccctaataaaggatgatccaggtcctcatttccaaagtcccaatgctctgaaaaccaaaagtattttcataacccatttgaaaccaaacctgacctgaacttacactgataggaagctatgggtaattatgatgtgttccttttagtgtgattctttgttgcagaaatgtcaatatattttatgacatggttccctactagggattatacagtatttgctgactacttcctaagagccaaaaataaaaaatctgaattcc

SEQ ID NO: 37206 - DNA, 85319 bp, Homo sapiens
gacctcgtgaaataaaagtgcagaaaacaaacccaggcgatcacagcagcagccgccgcggcagcagcaccaacagcaggaggagcaggaggagccggaggaggaggaggaggaggaggcaaagttagagttggggctggcgctccggagttgctgggctcagcgcagctcccattcattaaggaaccagctgcggaggaaggtggccgagcgcccgcgctgcccactcgctcgctcgcgcactcagacgcgcgccacaacagcgcgccccaagctgcgcagctctgcaaaagtttctgctcgggatctggctctcttccccttggactttagaacgatttagggttgacagaggaaagcagaggcgcgcaggaggagcagaaaacaccaccttctgcagttggaggcaggcagccccggctgcactctagccgccgcgcccggagccggggccgacccgccactatccgcagcagcctcggccaggaggcgacccgggcgcctgggtgtgtggctgctgttgcgggacgtcttcgcggggcgggaggctcgcgccgcagccagcgccatgcaaaactacaagtacgacaaagcgatcgtcccggagagcaagaacggcggcagcccggcgctcaacaacaacccgaggaggagcggcagcaagcgggtgctgctcatctgcctcgacctcttctgcctcttcatgggtgagcccagccccgctgtccctcggcccctcggcccctcgtccctcggcgcgcgtcccagcccagtccggggccgcgcagcgccgcgccgcgccgcgccgtcagctccggggggcccccgcagccttcctggggagcctttgcgccgcccaggcccgaagcccccgccctccccgatcccaccgacttcttggcctgtacttgagtgggtctgggcgtgcttaagcgttcgtgggcaactgttaaaccagctcagtaaaagtcgtctccacgttggaagcccgggcggaatcccgcggaaggtgtgggttcgtccttttagcgtaggggaagttggttgagccgcgctctagagccagcgtatagctagctggtcgccctccatccgagtgaaatggatcgccccgagagtcgggctcctgcctggagccgagctgccttcccggcggctgtatgtaaacatccagcccttccgcctttgctgcccaggctcgccagactggctagccggccttttcacttgctcctctcctgtaggtgctttccccgggcttggtgctgggcacggcttcagcaatcacttgagtgcctactgtgtgccaggtggtaggcggcttcaggggcatcagttttagctcgcccactctctgactcggtgcagcaggggtgatgagccccatttccctgatgggcacattgaggcactgggaaagccagctgcgatcttgtttggggaccacaaatttaattgcgcccccagaaagttgaggcgatggtccacttctgttttccaaagtcgttggaagccacagctggaagagcggtgggagttaaaggaattggagtgggagggcgaggaggatttatgaactcggtaggggagggagaaagcgcttcacaagaatgaacaggacttccaaggttgaagtcagcctaggatttttttttttttaaagcgaatcatggtgtaatggaaaacgcacagtacttgtcatcagaacactgccactcttgccacttgctgggtgtgccacttaactgcctcatgggcctcagtttcctcagcagttgaatgagtgggttgaagtagatgctctccaaggccccttcccgcattaggaactcggatttggtccagaagctgttctgccaactctgctaactgaagaaacatctgtgttcccaattcagttcccttaaaatacagctcctgcacagacttaagtcccctttgaaatggatttgtccatgcagattttgcagaccagagacttcttaggctggagttatacctctctggtattcatgactctttctgtagcactgctcttactgtgcagtgtcctcttgatggtccatagtaaagaaagataggattcttagagtttaaaaataagaacggcccccttcaggtaagaagagacagctgaaggtataattgtgctctgtggaagggtggaggggtggaaaggaagaaaagtcactgtagttcaggtggcacatcccatttccacgtctctcaacattaattcaacattaagatgctatgtaaaggaattgtcactggggggcctaccttcctgaaggcagctggctcattatcatgcacagtgggacagattactacttaaagtcttgtaatcaagctgttgaatttttaaaagaccctctctggtcccaggggagtacaaggaagcactaaacacatggaagctgtttgctgtaaacttgcctggaactccctgtgtttactcagtgtgttttgttggtggcagggtaagctctttctagagtgcctgtgcaggataccctcctacctcctactttgtgattaagaaagcagagctagaacatgcttgacagcctttgtacaatttcctttccacccttgtgattttagaaggcagtcccaagagatggtgtcttatgaaagtgaaaaggaaagagatgtaaaggaatttgcaaaaagacacaaccatcagctgtagtttagccagggatgtaaaaacccaagctactctgttgtacattgaaggtgtaaaaaaggtgtgtgtgcatgcatgcatgtgtgtgcatatgcatgtttcagttcttcatttccccactatcccccgtccccccaaagctaatattctaacctgtttattatatttattcactgttggtcttatgtttgaacaaaatgattttgtttatctccaaaaagcaataaggcgtcaggaccatgtattctgttatagaggcacatagctacttgttttcaggggtgctttgccattaaaaccatggcaacattttcaaagtgacttattgatcaatgtttcccctgagcacaggccaattacaatatcactaattaaatgtctctcaaacacctttaacaggaaaaattctttgtaagagaaatatttaggtgagatatttatgcaggagaactctatttggcttccaaaagaaaaattaatagcacaacatgtgattttaatattccgcacaccacagtcctaaaaaaaattgtttccactttttgcctaagaccgtcagtataatttaatttttatatagtttattgatcatatggtctggattacagggcactaatatattaagaagagagacagttttctgtttattctctcacaggaatatataagaaacttcatctagtatctggaaaaaataaaagctgatgtgctatgtcagtgttatgtaagtggaaatatgcaagtagtttaacttgtttcacatacctttttagaacgttaaattcttggtgaaaaagcagaagtctactcttgtttgaaagccaagacaatctggtgtcaaataacaccagtgggagtttacctttcattggacagctatctttaccgattaattgcttttaaatacagttatgaatctttgcgtgatagttttcctgaaattgattttgttttccttttaattaagtaatatttatcacctcctggtttttgtacattgattgtggtgtatggggttacaggagagcaacagacgattcccaggtaagaagggaggaacagttattgtctttctaagctctgttagtctcttttttatataaattcatatatgcatgctttaatgcaacccctatgaataaattatctccattttataaaccagaaaccatgtctcagaaaagggaaggatagactaacactgaagtcgatttgaattgatccccagttctcagtttagcatgagtggaatcctttccccacctgaagaatcttgaaattcaggttcttatcagaaaattctgaagctcggtttgcagaaagttctgcctctcccgatttcccagttacccatttgcaccaaagcagaaaaataaagttggtcccagtcttccagtcagtaatacggaatttgggtggtcagcaaccgtgctatttaatttggttgctccaccacgtttttggatgttttttgatttccaactaaatggttgagctaaaattctagaactggttctatatatgggatacatagagtcatcatttattattatttactttaaatagtgagagaggggcagcatggtatagtgcaaaaaagacacttagagtcagaagcttcaggttccacgttggccagtgccactatcgagttgcattgtgtggatgagtcggttttctgtgtgtctcagtttttttccacctgcaaaatgactgtgtgggattatgtctattattgccattaaacatgcggtgaccgatttctagtagaggcttgacgttagagacttgacatatgctgaatgtctaccctatgcatctactctgctgagctcttcattatatattagctctgtgaatcatcacaaactagagacagtcattatagtcttgtactgccactgcactgtacagctttggaaaaattcatttaaattttctgagtctcagtttctttaccattgcgaaaaagggaaggaactagaccatctttcagtgtccttctagctgtaacaattttataagtctaggctggtaaatattgtgatgtagtaacatacccactgcccctcttagaccatttgtcattaattgaattgttatatatgtatgaccaaagaattaatgttgaaaattagcttaagttggtgttaattctggaggggaggtaagcactgcttttattaaggttaaggcaatacgttgagaaactgactagatttttcctacgccggatgtgtcctttcacctgcttcctgaaatttacatattttcattaatcaaccggtaaattgcctagccaaccatccttcgtagattaaaataaagaaaagagcctcgttgggtgcagtggcttactcctgtaatcccagcactttgggaggcagaggcaggaggattacttgagctaaggagttcgagatcagcttgggcaatatagtgagaccttgtctctacaaaaaaatcaaaaattaaccgggcgtggtggtgcaagcctgtagctgtagcccagcttcttgggaggctgaggcaggaggataccttgagactaggagttggaggctgcagtgagccatgattgtgtcactgcactccagcctaggatcatttagtaggtaagccctgttgacttttctagtatggttaaaagcttttattcactgtccataatggttagggtttttttttttttttgagacagagtcttctctgtcacccaggctagagtgcaatggcgtgatcttggctcgctgcaacctctgcctcccggattcaagcgattctcctgcctcagcctcctgagtagctgggactacaggcacgtgccaccatgcttagctaattttttgtattttagtagagacagggtttcaccatgttagccaagatggtctcgatctcctgactttgtgatctgcccgcttcagcctcccaaagtgctgggattacaggtgtgagccaccgtgccaggccccttttctgcttttaacccttttgattacctgtcaattttagattcttcctttaccctttcttgtgcagttgtttgggctagaaagcccagttggtcacagcgtgatgctaatgagaccatagtcaagggcttcttccctgtgtaggcagttatatttatggagaaaccctgtcctgtgtgtcagttcaatccagtacacgttatgtgaggagtaatactttgttttggggttgcctattacaccagtatttcataaactcacctaacatggggcctatctggtatgaaatacagattctcggactcttctccaggatattcagattcagctggctttgagccaggacctgggattctgtgttttataaacgctgccggtgattcttatcaggccaattttagaatcactatgttgtttaacagctgatatcttaagggcaatttaattatgtagtgggctttttgtccctgcactgaatgttctggcattttctgcattgttaggttgtctgtactttttttgtttgtttgtttgtgaccagtgcacctgtctttttcagtaaagataatcaagtttgcaagaattcttccgaatggaaaattacccctggatgcagacctgaaggtgtcctgtgtctttcagtgcaaagacttggtgttgtttctaatgccaagaggctaaaatctttatgtattttctggttgtaaaccgaactctatgtaattgaagttgccagccatgtgactctttggataaatgaggtgttaattttaaatattttcttttgagatattgaagtttgtgcatgagtgcaaggtgaagcaggaataaattagattcctaaatagagcctttagaagataaaataagcttggcaaagtagtgtagaaacaatacaagctttggatttccccaaatctgtgtttgaatcctgacataaagcaaacagccaccttttgccagcatgtaattttgggcaaaaattatttaacctcctccaggcttcagtttcctcatctgtaaaataagcaaacctggtaatacttgtttgttgtgaaacccaggtgagataatgaaactgaaagcattttgaaaagttcaaaatcacgttatcattatcaggtaggaatgaagttgctgttgttcttcatagagtcgaattttcattttcctcccagttttcttactcctcaatggttctataaaatcctcttatttcttggcagcaaagttgcctgaactatattaaggaaaaagattctgagaagaatcccaagaaaacaccaagcagagtggacacaaatgttttccattagctgaagaaaagcagtggcaggtttcctgaccctttctgggaaagtcaaagtgcaggaacctcaataggctttggtggttgcattcttcccctttgaaagggacaaagccatattatcttgagagaaagacagatatgccttaggaagggtgggagagaatttagacacgtggtctgttttagggtcaactctcacttgggtcattcctgtcattcaacagcccagaggaaaaccaaactaaaagaacagcaaggccaggcgtggtggctcacgcctgtaatcctagcactttgggaggctgaggcaggtggatcacctgaggtcagaatttcgagactagcctggtcaacatggtgaaaccccgtctctactaaaaatacaaaaattagccgggcatcgtggtgtgtgcctgtaatcccagctactccggaggctgaggcaggagaattgctggaacccagttggcagaggctgcagtgagccaagatcacgccactgcactccaggctgggtgatagagcgagactctgtctcaaaaaaaaaaaaaaaaaaaaaaaaccagaaatgattggaaatgatcgaaacgctggtcatctaggggaccctctgtatttgctgaggaaggaaggtactgagctaggctaccatatttattatacaggccaatcatgtggtatagagacgatcccttttatagaagagggaactgtagctcagagatgttaagtaacttgcacaagggcacccagctagaaagcagtcaccaacttttccagagctcttgtcaggttaccttgctgccccacttttcaatttgcaattaattgattgcaattaatgcaatcaaagcagtctttttcatttctttccattttgtttattttggtcttaaggatattattgggcagtggagtagacagagtaatatgtaaataattgcaaaacagcttaaagcttgatgaataagcttctctgtagacataataaagagaataccattggagcaattcctcattgcctagattcatggaatctttagaatttggaagtaccttggagatttcattatcaacgataccaaggtcattttttaatgtcagttagaaaaataggcctttttgagctggggaagggagagaggtgtgaggggaatagcacgggctttggagtcagactggagtctgctcactattattggccatagaagcttaagcaagtttacttgatctctgtgatgcctcataaatcctcatttacgaaatgagattctgtgtgcactgtgacgtggtggggacatgcctagtacagtgcctggtgcatagagacactcaagaggtagttgctgcagtcattatcatcaccacatcctagtcaatgcccttggttcacaaatgggaactagaggtcttggttggttagtaattgtccagtgacagtgaaagaggaggacctagaaccaaggtcttgcctttctaccattctgcttttcggatgtggacttgttggtttgaaatttgatattattcatgaggagagttccctggagagctttctctcttgcgtgcgtcagtagaaaaaggaacaagacaaacaggtttaacttttaatccatatcagtggatgttagctgagtgaagccaaagatacatgggacaaatgtgaaggactaggcagtgttttgaaatattacttttcttcaaactggtattttttcaggaaagtacttattaccaagatcactgctgaatgatttgagctggaacaggtgccacctttttcaaatgatgtatctcaggggagaaaaaagagactccatgttttcaaagtttttgctttttattatttatttatttatttttgctttttaaaagcctctcaacaaactctccttattcccatgtgactgaggatgaaacagtctcagattaaacagacttctcaaggtcacgcattgtcagtgccaacattcaaaagaaggctaggtcaggttcttgaacatccttgtgaaattattcttcccttaagtctgggttaaattataaattatgatctgcatttaaattcccaaatttaaaacaaaccaaacaaaacaacgcacttcagactcttttggaaacctttgaaaggaacttgatttctgtgtgatttgaaagtatatattgcaatcaaggtattggtggtaagtgtgtttttgaggtttgtcacaaattaacaaaattatatgcctaaagagttttgcagagaaatgcaaatcattataagcgccttgtcataataagtagtgtgctttggttcctgtttatgtatccctaaaacacataatacactattacattgacacgaaggaaaccattctcattgatggtttctttatatctggcccccaaattagtttgtggtatcaatcagtataatttctagagagcctattaagcctatgtttgtacctgtctttcaggtataagccttgtcttctgcagatgattcttgagcacctactatatgccaggccccagggtttccatggccttaaggaattcccaggctggtgaaagtggaacaggcttttgcctaatgacaaacactatataagtgatgactttggagccttaagggagggcctactctagcagcacagtgaagagtgatgaagcttgcctgagggtgtggagctgggtcttgcaagataaataatagctcacaagccaggaagggggagaaggtattgcagcagagtgaagcacaggtgctgagacttggaagcagggacctatttgggaagagtgagtagctggaggctggaatgtcaatattgtgtgtttgcactgtgcgggggaagaaaggaggacattggagatgaggctggagagataggttagagctagattatgaaaggggactgggtatggcaggcagctaaggaatttgagttttattttggtgaacgaggagagcaaatgaagttttctttttgtttttctttttatttttatcttggaagatttcatagagaaacctactacctaggagtgaaattgctgggtcctatggtaactccacatttacctttttgaggaactgccaaactgtttttcatagtggctgcaccattttagaaatatctaaaggcggctgggtgcagtggctcacacctgtaatcccagcactttgggaggatgaggcaggcagatcacgaggtcaggagtttgagaccagcctggccaacatagtgaaaccccgtctctaacaaaaatacaaaaaattagccaggtgtggtggcaggcgcctgtaatcccagctaatcaggaggctgaggcaggagaatcacttgaacctgggaggcagaggttgcagtgagctgagagagccattgcactccagcccgggtgacagtgtgagactacatctcaaaaaaacaaaaacaaaaaactaaaggctagttacagtatgtaagaaaaatacaatagttttataaaagacctttggaatgaacatattcatgaaaagattggaggagggaattaatttaatcttatttgggtttgggagagatgactggatttgagggtaggcaaatgggaggcagaggagctaaagaccagtggggtggcaagtgcaagctgaaccgagggtactgtggtgggagcagagagggctggataagaaagacatgacagggccgggcgcggtggctcacgcctgtaatcccagcacttggggaggccgagtggggtggatcacaaggtcaggagttcaagaccagcctggccaagatggtgaaaccccatctctactaaaaatacaaaaaaattagccaggcatggtggtgggcacctgtagtcccagccactcgggaggctgaggcagagaattgcttgaacccgggaggcggaggttgcagtaagccgagatcacgccactgcactccagcctgggcgacagagcgagactcgtctcaaaaagaaaagaaaaagaaagatatgacaggtacttcctgaactccaggttgggagcctctgaactatggtgaggccactccttccagaaacactttaaatgcaggatttataggagatttatgaaatctattagtaaatgcttttttatgtgcatagccttattatgaagacgaggctgtgagttatattcttttgttctggactttttaagtttctcaaatgccccttaaaataagtgggctataaatcctcttggcttagagaaagggtttttcctgggttgcaatggtattttattcaaagagctttattgagatattcacatactatgcaattcatttctttaaagcacacgattcattggtttttagtatcttttctttttttttggtttttagtatcttcacggttaggtaaactatcaccacaaccaattttagaacatttcatcactgcaaaaagaaacgatacccactaccagtcactccccatttttcctccaccttcccacatctcatggcaaccacgaatccaatttctttctccatagatttgcctgttctgaatatttcatgtaagtataatcatataatatgtggtctttcgtgactggcttcttccacttggcgtacggtttttaaggttcattcatattgcagcatgtatccttcatttctttttattgtcaaataatattccattatgtagacataacacatttcatttttaccttcaccacttgatgaacatttgggtgatttccactttttggccattatgaatagtgctgctatgaatatccatataaatgctttcagttctcttgggtctgtatacctaggagtggaattcctggatcatatagtaactccatgtttacctttttgaggaactgccaaactgttttccgttgaggctgcatcattttagaaataccttaagattgggctgggtgctgtggctcacgcctgtaatcccagcactttgggaggccgaggcgggtggatcacgaggtcaggagattgagaccatcctggctaacacagtgaaaccccgtctctactaaaaatacaaaaaattagccaggtgtggtggcgggtacctgtagtcccagctacgtgggaggctgaggcaggagaatggcatgaacccgggaggcagagcttgcagtgagccgagatcgcgccactgcactccagcctgggtgacagagcgagactccatctcaaaaaaaaaaaaaaaaaaaaaagaaataccttaagattaatgcagacatgtaagggaaacaatgccagaattttcctgaagatttggaattaacatattcataaaaccactaaagcgtcactttgtttttagagggatttttcacaaagaaacacgttttgaatcagtttagtggtgccactgggtttaagatgagtgagcagagaacaataagctgactgggaaatcgatgctgggtggtcagctagacccgctcacccactgagtagcacttccacaaagcaggctgtgactgtgacgtacagactcttgtctcagcagaacaaagaatggatcttcagagtactttgaaaacagttaaacatgcaaatagtaaaacctatatatccctgggatctgctttacaatattttaaaggcatgaaatagaaacccatctattttcagttcctgatgaggctgatttttcacccttttccccacctctggatatatggctgtgtatgtgtagttgtcatcttaggaactaaaattaccatgtatcttttagactcatgtgctggatgccaagaaatattaaagaatataagacacaaatacaaatcctgaataatgagttgatctataaatgcactaaaaaatcaagttgtaagtatgtgaaaattaaacctcaaatattacaaaagggtgaggaaaagggatccccatttattgttaggtgcttcacatgatatctcacttaacctttttaataacagaataagggaaatgtttcaaacctggttttgcagctcagagagggtaaatgatttgcccaagttcttacagctgatatgtatcggggctggaatttggactcaagcttgactaaataatgacgattgctgacatttattgagtgctagctaggtacctctcaccaggttaagcagcgtgtatacattctcttatttaatcctcccaatgagcctataaagtacttgttactattgtctccattttacagaacggaggtaagagaggttaaaaataacttaccaaaggtggtgcagtgagtgagtttgagaggtggggtcagacgtctgcctggtgaggtcattcttaactactaggccctactgcctatattctccacgtgtttctgaatcccatgcttttctccactactccatgctggctttcgcattggcaacccctgaagcgtcgtccaaaatgagttggactagtggttctctggacctgtgaaggtctgttaggtcaatcatggggcatcctctgctattttcagtacttcagaaatatctaggcatactgaactttcaccagtgattaacttgtcaagcctaactcacagcatcagcctctgcctagactagtcaaagtatcagcatgctgtgtttgtgatgtgaatgactgctgtcagttcactctggtcttgtttatttctgctaatgatgagatgagacactttttgtgcttggattagcaaaaataaacgatgtgaaatatagtttacttggtaagtacagatgtcttctagatgtgtcatagaggggcaagaattaactatgagggatttttgttgctgaaaaggctggacaccctagaatggaccatcagctctaaattttgaggtaaggaagaccactgggtcctggatcctatagaaggctttctaaagaaaggaggggctttaggccaggcgcagtggctcacacctgtaatcccagcactttgggaggctgaggcgggcagatcacctgaggtcaggagttcgagaccaacctggccaacatggtgaaaccctgtctctaataaaaatacaaaaattagccgggtgcggttgcgggtgcctgtaatcccagctactcgggaggctgaggcaggagaatcgcttgagcctgggaggcagaggttgcagtgagccgagactgtgccactgcactccagtctgggcaacagagggagactctgtatcatttaaaaaaaaaaaagaagggactttaggccttttatcattcacatcaggcagtggtaatgggtcactctgtttgtgaccctttttgtaccttaggctcgagctactgtccttgtggtttggtgtaacctttaagtcacattgaaagattttgagcttctctggttagtggctgcggatgcagctccttcattaaatgcagtacatggaacttctaccagtagcctcttccccacaaatgacccacattgttgtaaagttagcaaccactgacaggaagtggcagaatgcgtctcagccacacagcagatttcattagacactctcccaaagtagctgtttgggtcaatttggcctcagtaggtttatagagaagaatggcttaatccattatttctcattgttacatttgtcttgctgtcatcttagccttaatggatgttttcattagaagcacagtgtcttccttggaagcaagtgcacacacatatgatcagagagaggaacttccagcaagctgagattttaaaaatatttccaaagttgttaccaacttactggagaatcttttgtttattgggtttgtcatttaaatctgtctggagagtagcagctccagtgacaccgcaggagggattttgggctgcactcacctttgtgactgattgctttgaaaggtcagctctatagatgttatatgaaagcagaattcctagggactggctgggaaattaaaatatacttcttgagtcaaagcattcaaaatacagggctttcaattcgaggggaataataagctgtcttgattttaggtttaattttcctaaggctattaatggagttgagggacctttacttatgattttgccataaatttgttgttgcagctgtgcttgccctagctgtgaaatccaaggatttattattaattaataatcccttttactgaacaattctaccaaatgataacgtttgcatctgagagtttgaatttatatattctttcttgcctcaattaatttttctcattgtagatctccagttacctagcccctcaaagcaaacaaaacatcagtaccaccacatgcaaaatatcattgttcacatgtcagttggaacaaagctgggaaactaacctttttgagcattgacagtatagtcagacacatccacgaatctcatcaaatcatacaagcctgaaggggaggtattcctctaactggttttatagatgagacagtcgttgtgcagagagattgaggggcttgctcaggatcttgggactagaaaatggtggagcttgtaggctatgacccaaccaacacctatgctctttcctccaagaattaagattgcaatttgaattttcactattagtttcaataatgagcatatgaagaaagcaagcaagtcagaaaatttaaaaatgaaattatcacaccttgtaaagtgttcagatttgacttgaagtttaaagtcttttgtccatttcagtatttcctgtttctttgtaaatccgtagaggatagacgtgaactccaaacctttacactggaagagagaggcatgaactttactgaatacttaatatgtggcaggcagtgagctaggggcttttcatacgttattaactcacttggatttcacaacaacactatgaaggtggaggttgaagttcattctgtttttctcagaacttggtcagcaatgtctatagcaatcctcattgatgggttggtgacacactgttaataattcagctaatcagtagcagaggtcatttactaacatttcagggaaaatgctctgctagaatctgctttgagctggtcacttgggccatctatccacttttactgaaaatatatcagagagaatctcagttccagttctgtagagccttagaagaaaaggtcaggagccatggtaggagaatacttggccaattttctacagaaatggaatatcttttctgcagagagacagcaatatcagattgtattgttaattcttcttatcagtcttctccaaaggtgttaaaaagccagggaaatgaaacattttgagtgaaggagcctgcactttggaaaacgctccgtgtatttcccaggctattgtagggcccctattcagttgggatttgaatggtggtgtgattagcatgaaagcaagtgtataaagtaggtcttttctccctttcctaaaagaagttttgtggcatttctttttctgacagagttggcatgaagctttgacaaacacagacccatggaaaagttaaataggacttagagtaggtccattttgtacagatcctacacacttagaatgcagagcaggaaagcagctggcaagaggcccctcaaaccataggaatcatagcaagggctcttcctccactgtggaccaaggatgaataggaaacacccacaagaccaatgggaaagtatatcctgggctgttgatcattttctgtattaccagaaaatgacagataagcacatgcctgtgagtccactgcctatctctcccagtatttgtggagataaatacaaagtgctgagggaaagtctaagaaatataagaggtggaacctgccctaaggaagaaggtgacaagatgagaagatggacacacagatggaaaaaacatggccaggtgtcctgagctgataattaaatgaaattttaaaaatattgagtctaagagatagcttgatgctgttcttgcctccagtctcagctttgctgtattagctgagtgaccttgggcaaatgttttctattttgtgaatgataaaatggggatgatgatttgttccctgcctacctcacagagcttttgagaccaaatggtatagtatcccacaggtatagaaaaatattttgcaactgcaagctcttgtttgtacaatgaatattttttttgttgtgtctgaatttgctctcttttctccattcttcctttttcgactgcattttaggcacatgctatcatttacccagatctgaaaaaatgtctttacagattttatttctaggttgatagtctctcctcccccgtgtattctttatgcagtgagtctacagggtcatttgttactactacaatcccgatcacataggcctgtctcttcagaacaggactttctgaccccttgttgactacagaatccatttctcagcatatttgagactcttcagaatctaaccctaaccaaacctttcaatttcttgcttctcatccccattaccccactctctcccaaccccttcacacccttctcccagacatctccactctggggcttttccaggtccttttctaccatgccattctttctctttgcttggtatgtgctatttacttcctttttttttttttttttttttttttttttttgtgaaacggagtcttgctttgtcacttaggctggagtacaatggtacgatcttggctcactgcaacctccgcctcccaggttcaagtgattctcctgcctcagccttctgagtagctgggattacaggcgtgtgctaccatgcccggctaatttttttatttttagtaagggcagggtttcaccatgttgcccaggctggtcttgaactcctgacctcaggtgattcacccgccttggcctcccagagtgctgggattacaggcgtgagccaccgtgctcagccaaaaaagaagctacttacctcttgatagtcacttcaaatcctgcctgcctcctctctgaaatctcttctaaatagattttgaactccttgtacataataggtgctgaaaaattttcattgaaaaaaagtatataaagatattttataaaatataaacaagaagtaaaaagaaaaagaaaaattttgttgcctataataccacaatcctgaggtagccactggtacagtttatcttttctataaatagctgaattattattaagtataattataaagctaaacactgggtgcttaaggcctgcttcctgtaagtcagtgtgatgaaatggaaaaaccctttacttgctagagtttgcagcggtcaataataaagtattaactaacctgagagaattgagaatatgtaactaacctaagaacagctaggtattttacattcagttttgcattcatgtagtattttgaacttgtttaacaaacaaaatttgtgctaaccatgatagcttctattaaaaaaaaaaaattctaacctaccctaaaagctagggctgtatttagaaggcattacttttttcatcctcctctcttgccttaaagagggctctgggccgggtgcagtggctcacgcctgtaatcccagcactttgggaggctgaggcgggcggatcacaaggtcaggagatcaagaccatcctggctaacatggtgaaaccccatctctactaaaaatacaaaaaaaaaaaaaaaattacccgggcatggtggcaggcgcctgtaatcccagctactcgggaggctgaggcaggagaatggtgtgaaccctggaggcggagcttgcagtgggccgagatcaggccactgcactccagcctgggcgacagaggaggactctgtctcaaaaaaaaaaaaaaaaaaaaaaaggactctgaatggggagaggaaaaccccctgaagggaaaacataggcaaggtgggagacaagaaatctgagtttacatcttaactttgttactaactgctatggtctgaatgtctgtgttctgccaaaattcatatcctgaaacctaatcaccaaggtgatggaaggtgggggggctttaagaggtaattaggtcatgagggcagagtgctcgtgaatgggattagtgcccttataaaacaggactgagggagctttttagcccctctgcccttccatcatatgagaacacagctagaaggggccatctttgaaatagaaagcaagtcctcaccagaccctgaatctagtggcacatactttcagtgatgctgagtttattccatggaggcagttctaattgttcaaaaggttatgttgatataaaatcaaccttcccataattttaacccagcatcagctatgtttggtacagttttggtaattagtagcattaataatagtatctatcaattttataattgaaagcacctgaacaattttataattaaaagcacctgaataaatgatggtgatgagtcatttccacaaatatgcattgagcacctttaatgcaccaggttctgtgctgggtgtcgaggtctaatgatgaatggggagaggtttcagtccttgaatcttctggagtagatgttgggcaggtgcagttctagaaatacaatgtatactctgtatagaggtagccgagttgaagggattattaacactatgtttgaggggctctgggggaaggcttctgaaagtggtaacatcacggttgtttggacaggcaaattagcagaatgcttttaggcaccattgtcaaggaagggactgcactgaagaattccctttagcagaatggtttctttgcctcagctctgcccagtaccagtgaccatcctttagaataatcttagaatacaggagatgaaggggacaagcatcaaaagttcttccttcctcatccccattttccagatgggaaaaccaggctcagagatattaactgtcttggaaaatgagtaaaatatagagaaaacaaaactcttaccttgtgcaggttcaagttcaaatccagtaaataccatagtttaaagcatccctttacacaatggatttggttattttgcaaaacagatattagccccatgtgtcagtaatctacagtcatttgtaccttaacataaaatgccaaagcacagtaatatattcttagtgtaaaaaaaaaaaaaaaattcaaggctgggggtggtggctcacacctgtaatcccagcattttgggaggccgaggtgggaggatcacttgagctcaggagttcaagaccagcctgggcaacatagtgagacctagtctcttaaaaaaaaaattaaccatatgattatgtttaaaaggaatagccccttgcttactgttcctctaaattccactccccagaggcatctattgttcacagtttttggttctgctatccttattttgaatgcacaggtattctcattgataactacctttatccatattagtctccttgcttcctggaagcaacacacagaaatctgtattccagcctttgtttatgctctttcctctgctaacgcacccgctccttcttctctgcctatacgaagagtttccattctttaagctggtttctgctcaccctaccccctcactactccaacctgaggtaatttcacctcctaatctcaagccattccagctctggcactagttagtgaccttaaacaagtcacttgaactctgttggtttaaattttcttccctaaataatgaggcagttgaattaaatggtctttcagaactgcagaggtcatcaagtataaaagactctaggacagtgcctgatagttggaggtcttgactgtgttgaattaaccctgtcacaaggtacaaataggaggaaagatgaagagattcaccaccacgagttaccacaattttaacccagaatcaaagttttgaagtttaggagacattggaacacagtggaaagaggatatgtcttagggccagacagttctgggttccgatcctggccccatcacttggtagcttataacctggatcaagtgttgtagtaaacttgagtttcctcacctgtaaaatggagacaatgatttctactttacaggtgtccggagagaaaaaaatacctcacagacagtgggctctttgacatgaatataccctgacccttaagtgtttagaaactgttatctgtcataaataattggcaagctttggaacaaataaatgcataagagagtgctacctgggtttataaaatgtgtaagtacaaagtatggattagacatagtttatctgatctttgaaaagttaccttggagtcctgccagagaatcatatggcagctgcacagatggagctacctttccatttgtgcttactaaagcatgtgttttccagttggaaaggaagatgctggaaatttgtctttaatgcattccagtgttgggagatgaaacctacctgagagattgagcagagcttattaaccaatatcatttcaagttgattaaaactatcatcttaattaaataccagagaacaagaagttctcagtcttctggtagcaatgaaagaccaaagagtcaatctgaagttgtttttgcaactcttaaaataatactccctctcctccctcccgtgaaaagagtttcttagctatagacatgccctcacattgaggtttctgaaagctgttaaggaccacaaacctgctggcaaagccttctgctgccaaggcatcagagttctcaaaagcaagggggttcaagctcaggatacgctgatttggaaagagagcccaaacaaagggccttttgaggcaagaaactgggctttggctgcagcgcagagcaatatggggttggaaaagcgccccggggacttgcagagaagaaggactatgagatcgatggaggaagtataaggtttctccatacagtgagggtttagatttcaaaaccctcgaaagttggtttcagaagctatctttcctctgtcagcttcaccagcatgtctataaaatgtggacttgacaatgttatatgtctttgagcagaaaagggaaatgatccatggaggtacatacacataaccattctagtaaagatgtctgacctgaaagccagtggttttcttacaagacccaaagcaactgcattcattagtgcattcattcacccacttaattatacgtgtatcaactgcctactgtatgccaggttgctatagctatgaagttaaaagatacgattctatcaattctgattcagctcaaagaactcaaaatctagttcatcaaaactggaggattgaagtaaaggagacaatctttctttctcttcctttcctttcctttttcttttgagaaggagtctcgctttgtcaccaggctggagtgcagtggtgcgtctttggctcactgcaacctctgcctcccaggttcaagcgattctcctgcctcaacctcccgagtagctggggttacaggtgcctaccaccatgcccagctaatttttgtatttttagtagagatggggtttcaccatgttggccaggattgtcttgatctcttgacctcatgatccacccgcctcggcctcccaaagtgttgggattacaggcatgagccaccgcacccagcctctttctctctctctcattttttctttctttctttctttctctctctctctctctctctctctctctctctttctctctctctctctctttctttctttctttctttctttctttctttctttctttctttctttctttctttctctctgtctctctctctctctctctctttctttctccctccactcccctcccctctttttctttcttctctcactatgttggccagtctggcctcaaactcttgacctcaagcaatctatccacctcagcctcccaaattgctgggattacaagtgtgagctactgcacctgcctgcccagggacagtccttcttgataaatacttcacactacattcacctatactgtccctccctgaaccacccagaccagtttttaaatttggcctttcctgaagtgaaacttttttttttcttttgagacagggtctcaaaaacccaagtcatttttgacactagcataacaatgttgctttttttctaaaggtaaattaatttatcattattgatgctttaaactataccacctaagatttggaaaagacagggaacatcactcataatctaccataaatactattgccattttggcatatttctttttactcatgttgattttctttcagttattaggtatatatacatatgatcttctatgttctaatagtcttcataattaaaattattttatcattacttgatcaatgaccctttaacatcattcataattaagtattcctgtatctttgtgtaatctcacctctctatatatctctgtgaccaaattcccccattttatagggacaccagtcatatggggttacagcccgccctaatgccctcactttaacctctatgaagaccctatctccaaataacttcatactctaaggtgctgggggtgaccacttcaacatgaatttggtgggagagggcacaatttacctttaaacctcttctctctacccctcaaattatgtgtgaggaaattgaggcccaagccaagtagtttgatttgcatttaggcctgactctaaaatgatacattttcatcacatcctgtttcctactcatgaatagaaaatactgtgaaccagggggaaaaaaaatgtcttcctcgatctgaatttgattagtgtgagactgtttgatggttattaactgctaaatttaactaagtttggccagttgaagccagcatcatcatgttatttaaaaagcaggttaagcacacacactagacttacctaaaactttttattgaatttaaaatatgtggctcacacctgtaatccccagcgatgtgggaggctgaagcaggaggattgcttgagcttaggagttcaagatcagccttggcaacatagcaagaccttgtttctacaaaaaattaagaaattagccaagcatgatggcccttgttaagcatgtttcacaaattgttccattcagggacacagtgacctagaggctaactggcatgccaataattccctggtaattggaccacattccatagtaaaagtaggcagtgttggatacttatcatcgatttttctcttgtttcttcatcttgagtttttgggtgtttttgtttgtttgtttgttttttgtttttttttttttttttttttttttttagtgtttggccttccttctcctgcataagtgattatggcaaattgcacacacacaccccaacaggcactagggaaggccagaaccagtataacaataacgagataatgtaaccagccagcccatggtccttacggtgtccatgtgcaggggacagataaaagtccccggggaagtcaccaagcaggagggattggatggggccggttcagctgcttccatgatggaggagtggaaatggcaacagcattggtttcagccctaactgagattgaagcctgtgagtggtgttcctcggagttgtgcagggcatggccacctctgtccctttccactaagtatcatttggcaaattacaactccttttcttaatttcctcacatgaatacaaaataacatttgaactgtgatcaccacatataccccattgctcctaagtctgtgctctgttcatcataggtgcttcataaatatttattgggaaaaaaaaatgaatgaagggagagtgaaaaatactgtgaaacagagatagggattgactatgagtgtgaagtgaacttgggaagttccaagacacattttatttaaaccaatgtggagtgctaagaaaatccccagttattttcctttagctggaaataatggaacattgaaaagacattggtatctttaaaactctacataggctgtttcccttgcctgctttaaagggagggaaatactctcacacagagacaaagagctaccctagtcatctttctttattctaatgtattttgagagaagaccatgaataataacaatactttccatggattgagtatactttatatatgacactgtatttcttttttttttttttttgagatggagtcttgctctgtcgcccaggctggagtgcagaggcgtgatctctgctcactgcaagctccgcctcccgggttcacgccattctcctgcctcagcctcccgagtagctgggattacaggtgcccgccaacacgcccggctcattttttgtatttttagtagagtcagggtttcaccgtgttagccaggatggtctctatctcctaacctcataatccacccgcctcggcctcccaaagcactgggattacaggcgtcagccaccgcgcccggccatggcactgtatttctaaacttcacagtaacccgtcaagattgattctagcctgttttacagatgccctagagaggttagcagcctgcttaatgtcacaggactaaaaaaaaaggtagatctaagctttaagctttaaacacaaatctatttgaccccaaacctgtgctttttctgctatccatattctcaatcacccactcgagtctcattaaaaaaaaagccaaagtgggggggaaaagccaaaggcttgatgactttcataatacgtggtcagtatgtgaaataaataatggatctctttatgggccaagacaacacttgtctctttccttcttacagaaggcacatcattccatattcataagagtaacatttactgagcattttctgtgtgccaggcattgtatgaaccttcttcgcacactcggttttattcctcccacatcactgtgagaggttagttggcttgttttaggttaaaattaggacccaagtgtatctgactccaaaatccacatacacaactgtatacatgctactgtttgccattgtatgtcagttgccagtggatagattgcccttctcttgctatttagttcgaatttagtcttaggtatggtcctgaatatatgtgttaagataacctgagggagtctatgtagggaaactccagcaatgagtttcagagaggtgtttgaaggaaagaagcaaccagccccagatgctcttggagagcaggcagtgtttatttgagctgtgctgtccaggacctggtgtggtgtcatggctgtaagaggccttaatgcacctcattcagggtggatgggatgtgtctccaagtgcagaaggcttttccttgggaaggtggttggtcacacctgggttagcaggagccagctaactaaagctcccataccccagtttatcttccacatgtctggctggcagggtgtactttctaaaacacagccttgccgtgccactcccttccccagacatagtcatattttgagtccctgctgggatatccaggactgtggagaggataaatattaaacattggccctgcagctaggaaatcagtcttgtttgaaagccacacacatgaatcatatttttaggactgattagaggttatttaggccagcatttctcagagaatgctctgaggaaaccaagttcttctgggttgcacatctcccaggtaaaacttaacaataaactctgatgaaggccctaggatgaaatgtccatgttgaatttgctttgggacatgaccagctagtctagcctcttctctctaatacaggctcagcgaagaaaagggactttcttcattcgcagaagaatccaaccttgaactcctgagacccccagcccaggactttttctgctgcacagagggcctctgcattttactcccctctttcagtttttgtctttaggcagtcctgaggcacatattttctcctgtatcttgaagccatatgtttctcaggcttttctcctcttctaagataggctgctaatgtttagcatctgaaatcatcctgtttctttcttaaagttgtcctgggaaagatactggaaagctaagttcccaactaggctgatgagaaagggagaggagaactgcaggtttgagtcctcacagggtccctgtaggggaaagatcaatttttctatgagaaccaggagctctctgagggcagaaaccctgttttactcatctcagtatttctcactcctggcacacaataaggttgtcagtaaatattgtatattcagtgtggtttaaaattgtgttgacttggtatatgcatatgtaaattgcatgctatgtaaattatatatcaatttttttaagcccttttatttaaaaatgaaatttttaagttttagagtagtgattctcaaatcaccttgggataaaatcacttggaagtcttattaaaaatcagaattctcatgcccttcccctgaaattcgggtcacgtagatctgggcagggcccggaatcagtctatctatctatctctccttctttcttttttttttttttttttataagtgcctctgatggtgaatggctaaatctgaaaatcactgtccagaggataatccccaattttacatttaggaggcagacatgaaaatatgccttagccttcaggtctggaaccttaaaacaaacaaacaaaaaccagtgtgcataggaatatggaaagaacatatccggaacagtcagccagtaataccttgtgtcagatgcaaggggctatggagagaaatgatttgcaagcctaattagacctgctccccagttctcaaacctgcagctctaagccttctgctaattggcagtcccttaatagattaggacttggcatcaggtttgcatgttattataaaccacacacagaaaaacccagtggctgaggaactcctgccaaaccccagcctaggttttgtgaggcttttgaagtgcactggtcttttcagtattttgtatagtcagtgcactgaaaggcatcaaaccatttctttggatgggatttgcgaagggcaagtttgttgaataattaattcgccaagacccattctatcatcttgatggacaagtaggagctcacgtatgccgtttgctctcagaagtacctggggtatgataggagagattgtttctcatggatcctgtcccattcccaggcatcttctccttccccttcatgctttgagtggggaggggaggaggaaacgtgtgtgtgcacctgttcgaggcaggctgcttaccacgccatctcttctgccatcctcatgtcagcccttctagactgcaggacctgtcttgaagatgagcaaatgaaggtcctgagaattcactaatcaagtatcacactgccaggacttggcagaggtggaaggggagggacttgtatctaggtctgctaattgcacaccaccaaaccgaaccgaaccgaaccgaaccgaaccgaaccaaaccaaaccccaaacccagaaagccatttttgatttctctggtgttcgcttgattaacatgggctgtgaaatggttttctgcagttcacattgtgcgcaaggatacctgtgtacatctgtggataatatgtatatactgtaagtgcttccctccccctcacattatattatagagtttccattctgaggtgaggctacccacgacagagtacaacattgtgcagtaggacagggagggagggtggagagtggggctttgccagagttcgcaaaggcctatgggttcccaaagccacactcaagtattcctcaggcctttgaacaattccgggggccttgctctcccctcttgtccttccaattagattccagttggggattcttccacttcttttcaaggccacttccacaaagggggagctgtcgtggaagctgatatttccatgaaaaccttccatttctcaggcaaacataccaggcagctgtcatggcaataccatggtgaaggggaataatgttatttggcatttcgccctttaaaaaagtgtatgtgtgggggtgggtgggaggaggaggcatgggcagagagaacagtgggggctttgtaatttactgcaatagaggggtcaggtgggctgggttacaaggggaggaggggcatagagaaggcctgaaccccccttgggcttcgcaaccctcttcctcccctctgcctgattcacacgttttgagaggttgtaaaggggaagctggggagtttttatgttttgatttggaagagggactctagacattctgtccctctgagagaagctggctccttgctgctttgcaaggattaagggcctggcttccagaaccattgaagaaacatcccaggatctacccttttctctcaacagctgaaaaatgcattacccagcagtggcttcctggagagttctggcaaaagagcctccctctggaacaatagggttcctataacaaaccacctaggagttgtttactgtagccagttctcccagtgtatccgaatgccttacattttgttattcccattctggtgggggaaggggcagcgctgcaggagcaactgaggatggtcccagagtacctggatttctgactacaggaagcagctgcccagtttgtgagtggctcccctccttagctccagttaaaagtacctaaagatagaatatctggtggcttcacagttccatggaaagtcagccggacccagcgtccctttctggcctacttctctgtggccttatcactattcttcatttctagtctttgtaaaatcaggctcatactccttacccggaaaggattattggtcagaataagggaggtgcagcaataaagtgaccaggaaagtgtctagcggtagctaatgttaattcccacctccctccaacccaccgcccatttttgctgatgcctactacttcagcagagccaagagctgccaaacattcgttcaatttttatctgaaggtctgcagattttggggtgttttctggagctgttctttataaatgagcatctttgaagtccagaggtctctactcagccagtctgccttcacaaacctaaaagaaagttgagtgctcctcagttaccccagctgggacaaaggtaggtagtgaagcccctctatcacgtaaagatgctatggaaatgaaaccttgcttacaaaatactctgcagtccttggataaagatgaaaactcttaaaataagaaaggtccacaagacacctgggaaaaccagccctttcattttgcacatgaagaaaatgaaccccagagagcagatgaggaagtgtgatccggtgatcaaactggtagttggtggcagagctaagactgatggtaataataacataaagttattacttaactcccagacttgcttgtgcagtcttactgatatcagacatttcttcattgaaccaatgactagtgttgacttactttccctgccaggatattgacagagctgatccaccttggaccacttgaggcttccattacccagtaggcaaaaagaacggccacacagaatagaacgcctccagtggatttcaatttatttcattttacaataatcctagtgatgactaaagtagaaaccttttttcccaagtaagaaaattcttctggatttaacaacattaacatctttcactgccagttcgcttcctttttagcaagcatcttttcagcatctattgttttaggaactagacgggctccctcaaagtacttttctaatttttttccttagcattaaaggttgggagataataagaactgaacaaagcagcagttttgttaacttcttgggaagaaaaccttttcagttctggatctttttttttttttggtatagccttaaattggctataccaattggcattcaaatgacatggcattcaaatgacagcaaggagtatttcaaattcatttactggattagtcagtaaataggtattgcatgccagctggctgccaggtcatgtgctgagggcatcctcagtgctctcactttagtaatgcccctgtggaagttcttgtcacattgttgatgggtggttattcccagagtatgcatttttaggggggcagagaccacatcttattaacttctgtagctcataattctcccagtgaggagtctccccttcaaaggaggaattttctccctcattttcttgccacccattgccatttggaaaactcagtgggccatggagaagccttagatctctgggaaaagaagtttgcgttgtacttcagttgggtattttgtaatgccatttactccctggatacttctaaaatgaaaatgtagcctgtaaggacagcacagagagaggaaatcaactacaaattaaaaagtgattagtgagtgtttaggcagaaggtcaaagggattagtttggacttcaaacttttcagctttcaaggtttgtattgagttacaaaattacatccctgaattatttgtgcaggtggcagctgtcagatttgaagaaagtttctgtgttttacaaaaggaacattgacaggactgggaatggggagtgtgctcccagggtgagggttgtcctatccacagcaccctggaacggctccagtcttgctcaatgcaagtgacagtccttgtctgagctgacacggccctgtccaggttactccaaccaccttagtgaggaaaccagtcaagccagttgattggcatcatgtaaacagcttgatagtagattttcaggactgggaaggaagagaactaatctttgttaaatacctgccttctgatatttcatcctcacagcttttcaaagtggatattggcatcctctttttagagttgaggctcagagaaattaggcaacttgctgaagatcacatagagtgtcagtggcaaaactggttttcaaacccaggtctgagttgctttcttgagatctgtgctcttcctcttacttggagctgtctttagggcagaaattcccaagaggatcccagcaaatgggttaggggtgtgctgaaatggatcccttagcccttgggcagctgggcagggtggggcatggcagctgaatcactgagcagcagtctcctcagcttgcctaggagtgccctatagtgtattttctaatagtatcactatgtggaaaaggctggaaactgaagataagtgtcttattcttagccatccggcctaaccacccatctgagacttgaagctggttaggatccctgtaaacaattcctgatggaattgtctactctttattagggtatgggatgttgtgctgttttgggggattgcattaaaaaacaggatttgggatgtgggagagattaggttaaaatttagaaagtggggagaaaacgatccacaagtcctagagtgtatttggtagggggccaggtcttccagattttggtttgtttcctatgcatttattcagtacacatttgttgaactcccactatgtgccaggaattcttccttgtatcagggacacagagataaataacatgaacccttttctgaggatcttagctagtgcaggagatttatgggaaaggaataattatgatgttagacagagggggccctcaaccttcccatctattaaatgaaaacaaatgacattaagatctcttacagttctaaactttcatcaggatattactgttatgcacctaactccattctgagtaagatttatgatgccaacaaatatctgatggactttaatttttaactcccttctcaccttgcttttattttttattctttagaattagtgggcttctatcagaagattgtttttgttttgattttagatagctattgcttttaaaaataaaactctctgatattcccatttagtatcacatagagagctataagttgggtccactgtatcttctgaagcataaccatgcaatttattaagataagctgtttacctggccagtaaggtagatgttcattttgacctaaccaccagcctcatggagtcaatttggtaagggctttctatttcagcaaggctttgtttcacatccctgttcattttactgtgtgacctttggcaagttacttagcttctaagcctcagtttccccataactaaaatgcagaaatgaactaccttgccctggtgacttgacatgatctttgggtttataattgaaaacatagataggaggctcagtcttgggttaagattaagacatacgcataaatccatacacacacataaccatatacacatatatatacatgtctaatgtggccattacttactatgggagacattacggcatcaagagttatttctattttcataggtttacccaagagtcattaaccaaggactcttactctctacagcaaggataaagtcaaatgtttacaaagccaggcaattaacataaatgactacagtggaccaggtataagaaaattgacagtgcaagctcaatgagaatggcaacccacagacagccttcatgtcagggagatagtggggagtaggtggctcctggagaatgtgtatatgctccctgcgggaaggcagccgctgttattactgcctgcattgccacacactttagagctggtttaagaagctgggaatctggatgttatctgcctgttattaaatgttaacaatttaaaacattttaaaccctgggtaggccaaacggaacatctctacaggccagatttggccatgggctgccagcttgtgacctttgagctagatcgcgggccatgtagctcagtggcatacctggagtgcccttggattgctcaccagggtgattttgttcttgcagggcctcccataatgctcacctcttcgcttttggcactgcatctggctccagtcttgccttttgactatctcgatctttggctgtccctggtgtctggtgtcctgccagtccacgtgttgtttattctgccacatagacggggtgttttgtgtacacctgggtagcatggcttggatgggagtgcacatgctgacgaatgaatttttaactgctggaaaaataaaaataaatgtatttttctcaaccttattatagacttgcctccgatacagcatcatgtgatcttttgagaatatatggcagggttcccactgtgatgtttcttccctatgtcagggttccgggtcttgctaaccactgtcaaagccccatttgtctacccaatcccaagaagttcctggaattataggacttcatgagcatgcttttccctgcagattagattgcgtatgggaagtggctggtgggcccatggctacttgcatgagctttggacagaaatctggtcacatcttacccccacataaaagcttttggtggctccctgtcacatataagagcaagaaataacttattttatcaactacatcttagtcctcctaatcaactctgtacattgggaattaatgtgccaactcttattgtacagtgataaaaataaagttcagagagttaaggtcatacagcaagaatgacagttgataggagtggaatatgaaatcttgtctgcctgactccaaagatcatgattaaattggaaaaaataaagaagcaattaatcctgttagagtgggttacatggctaagtaaatcctttgttggagagatttaagtcttgaaggatatttaagtcttgaaagataaataggagttgttttaattcagatgttaaagacattacttcatggagttgttaggaagatcaaatgtgatgatttatgtaagagctcagaaatactttgcatggatgggactattgctgtgtcttaactctgggtagccatgttgcaaatgaatgcctttgggtcataagggagacttatgaggcagagagagagtggctggatctgtatggttccatcttaacatctaaagaggagccttggtttctgcccttgtccactttcaagagtttcgtagctgactttctaggttgctaatatgtgaatagacatagttcatgtatccttagcaataaaggctaactggtcccatctctgaatgaattctagagtcagacagttctattacatatcttgtttatgcctcttatcctcagagtggatactgaaacaaattacaacctctctgacccttggtcttttgtctatatcctaataattaatttagaaaattgttttgagaattaaatcaattgatgtatccaaaactcctagcacatagtgggtgcccaataaatgtatacttactctcccttatttaaagaggattcaaaaggaaggaggtcttgggaagtgactcagctttacctgggatggaaggattatgagtcctgttggctctggtagttgtgtttcactagaaataaaacacctcatttgtgaaatatataatgatgacaaaagaggtttggagttctttcaattaaagatatgaaccatgagttgctggtcagtttgttttatttgcagatgaatgtggcaaccctttaaaaatccaacagaaagggctgaaacagctggagctggggattttaaggaggctgatgttaattattttaaaaataaaatgttttcactgtaagcactttcaaataagaaaggacatccaaagttctttttaacgcccatggtgaaagtaaaacaggtttctctttgtcatggaaactgagactttcagaaggcagggaactcaaaatcactgcagtattttactcacctttgttttccccagcacctaacacagtactcagtacttaggaaagagccatacttgtttgttgagttggactaaagaccttgatttggggtcaggaaacccaagtactaggactagatctgccactggtttctccatttctaccacgtagttgcttttggttccaacagtcttctttttgtggagaaagggcctgaactttccagtactgaagaatgagcaattgctaaggaagacctctagacccagaatattgcgtgttcacaccagccaacagcaagtgtttttcatggcagcctgtttcaaaggtagaaaaatgccttcatagtaaacttagttttgtctcatctggattgtgtccagtctaaaaatctggacaaatatcgtaaaccaaagaaagtttgcacacttctaagaccagtagcaattaattactttaaatagaagccctgtcacttacaagcaacataaatatttgtattttgaacctctaagtaatagttgtgttgaccattctggccttaagtgatttaaaaaaatcagtgagtgatattttaacagggaatatgtttataaagaaagggagggtcaggtcatagagtaagaaaatataagccaaaagacagacagatgtgggttcaaaacccagtgaccaatttactcacttgaggaccttgtaccagttataaaacttctggcctcagttttctgttgggtatacatgaaaataataacccacaacgtttcatagctatcgtggagattaaattaatcaattcctaaagtctaaactccttcaaggtccagggtcttcagtctatattttgaataggtggtccaaattgggaccattgctagctctgcattttaggtgaactgatgaacatttctgatcctcagtttttccatttgtaagatgggtagaacagtacctactcataactctgtactgtaggtaagatgtataaactttttatcacagagttctttttttttttttttgaaacaagatctggctctatcacccagactggagtgcagtggtgcaatcttggcttactgcaacctccgccttctgggctcaagttatcctcttacctcctgagtagctgggactacaggcatgcaccaccacactcggctaatttttgtttttttggtagagacggagtttcatcatgttgccaaggctggtctcggacttatgagctcaagcaatgcaactgcctcagcctcccaaagggctaggattacagaaatgagccaccgcaaatggccttgtcacagagttctaatagctgcccaatttgagtaattatgctataccagatgcctatttttgtgcaaccagtattattttgtggatagatgtgtaggctttctgcagatgttagtttaattattattctcgcagatcctggacttcacgtattttataatgactatggattgttttgagtggaaaattgaacaactctggaaaaggacatgaaggacctggtatgtagaagacataaaagtcccctcctggtgctctgattttggtcaaaaaatgcaaagattccttcttcacccttcccatcattctcttcttagcctcaccaagggctttctaaaaagcactttgtgagaaggaggctgtgtttaattttgtgcaaaggtgaactgtggctgcagggagcagggctttggggccaggtcacttgggtaacacttcccacatgagtttatcaatgggtgggccacaaaaacttagtctgtgtttttttacactccacccccaaaccacccaacctgccccagtgttagtttttcaaagccagagaagtttcaaaggcctgaacccaacacaggggcctttcttcatgctttgattttatgcccattaagtgtttgtcagtgagttcatatttcacctcctctgcaacctacacatcccaagaaatccccagaggtatatgaagttaattgatccttgattaaaggaaggagaaatgcttgggtctgggtctcggtctgcactcactagattcttttttttttttttttttggtcatgctttgcaaaaattttgtaatgcaccttttattacgaatacatttaaactccaggctattgcgttcagagtttgatgaaattagttacctagcacatgtgtgatacacagtgaaagttcagttaacttgagccagtgccattcccttgattgttctgaacagtgcctttttcatcagaggccatgagatttgctgagcttcagttaatttactaatacttatagatgcttccttctctgaagagtgactcacttactttatagaaagcacccaaaatcagagtcagatcatttgaaacctgttcagctccataacttacttgcagagtgactggtaagtcactttaatctctttgaaccttagggtggcttaatgtattagtttttatgactgtttatcctattagcctttgggccacttgaaggttggaacgtagcctctttcatttcagtggcccagtcaatgcctagactgtggtaggcagccaggtttgtcagtctacaatagtttatatggggaccctcaagacagtttgggcacatactaacttactaactgtttagtaaatgttacctattatttatgctttgtgctattttcgcctttctttccttcattcccttcatctcctctagctctatagcaaactttaaaattgtatttgtttaatagccatcagttttgtgactgacaatattgaaatccctaaactgcactgatttttttatggttgtacttagcccgtggactctagaaacccctcctacttatataagggttaactgaagtctcccaccctctgttggacaccttgaaagactctagtagaatagtctttgtgtccttggtgtactctatgcatatgtcagtcatcacactagaaataattcagggttcttgcttttttgactatcttacaacactgtgaactcctccggggcaggtactatgatgtattgacttccagaattccagtgtctagcactgggaaatttctccaaatgaagtgataagggactatagtaattggtaataaagatggtgatggtattggaactaaaggttgttggagaagaacagcctcttctctgtgtcctggaagggcaaggcacagtgttatatctctgcctagttgcctagttggactagctgcctagttggggggatgtttatgcttttcccatcaactgaaggaaatctgtggttactcttcctggatcaaaatcaagatttgactggcatcaccctcaataataccacaagtttataggggagacaaaaaaaagccatcgggttttgtaaatgccatctgcatgcctttcaagaaaataaacagaacatattcagctccaatttcttgtctgtttgtggtcttcatccacataatcagaaccggaaaccctccccaagccataggcaaagaaagaggaaaaaggatttggactgttctcagtttaaaagtgggcaaaggactgaccagatttttttcccttgccttctctgtgaggcttttttcccttctctttttaacattcattgagtgtccacagtgtgtcccggactctatgctggcattactcagtgctattgccttgactttcttctcaactgattttgatgatatgtgtcttcccctgctggattgtaagcttcttgagggcagggtctgggtcatctttgtgttccttgtaacttaatatatatagttaagcctcaataaatatttgttgaatgaatgctttaatttttatataatcccaaccaccctaaagttagatttcattcttcccattaaacagatgagaaagggagttttggagatgtgaaataacttactcaagtagtagggagcagagtcaagatcattaacccagttctgtctaactccaaaactcttttatatgtgttttattgtccatagaaacatatgttttacaggcctatcatgtgagcactattaaaaatagaagctggaggtctgagagtggagtgcaaatgtaaggaacttggggtctgttcccttcctgagtttattagcaacactttggctcctaggcaccagagcaactgcagctcaacttttaaatctcaatatgtggaactttaaaagcagactattaataatatcatactgctggcttctcagctacttttcatagccaacttggttgcatttcaaaatgtttaggcagtggcatgaagatggttcgggaccatatgatttctctcccaggctcctaacccctaaagatcatttctaagccagaacgtttatccactgcctttccctgcccccctctcctccattgcagagacaaagttttaaaacctaatggctattgcctgtcatggcccctctgtgtttactttgagaaggtcaggcacaatactgtggtgtgttgctgttctttcttttcaaagcaccagtatgaatttgataaagtaaattgttgttctagcaggaagcagttaggggtcacaaaataaatagccatagaattcaaataaatccaaagaataaaaccaaataaatccatgtgtgtatgcacagtgatacataaatacactttttagaaagtgagcatttttatcactgctggtctggaccaaagtaattgaaaaattgtggagttcatggtacttttttttagaggtggtctgggacttcaagcaacatgatgtgaatttaattctttttgaaaaacatgaaaaatgggattttatcttttaaacaactgtttatcttgggatttttcagctaatgaaattcacatttgaatgaaatcaatttgcaaagttaaattagggatttaagcatttggaggtggactaagagaccctgaatgagctcagtattctctctgagtctctgttccctccacttgaagatgggtggtagtgcttaaataatacttcaatgcaaaaatggatataaagaacccaacacattgtgagtgtgcattcaatagtggctgtattatccactgtgttttttttttttgcagcccagaagtcttgtatttattttattttatttttttaacatctactatgccatgagttcatacgttccagcagcaggctccttccccttggttctcacaaagttgcacttctcttggtagagcaggctggcacttcagttgaactctttggctttctttttctgatcattttccttcatgttttttaggaagttatctcagctcttggagtgcttaatgtgctcaatatgcacattaattctcttggcaagaatcttccccttaacttttttgtttacaacagtaccaacggcatgctggggaacactgcagactcttccagtttagccatggtaacacttgtggggcattctttttagagcagtacccattcccttagatgtctacagcatcacctttctcatagattctcatatacgtggccaaataaacaactccatgttttctaacaggcctagagaacatctatcgggtgcctctcctctttccctttgtgtttgtcattttggtgaattactggaagatggcagttccagctgaaaggccactgtgtttttggtggtcttccctagttccaagatttgtaaaagaactggtccttttactttgcgaagtgtcattggagcttggtattgcagttgggtagttggggaggaagaggtattttggtctaagagaatagcatgaatccacagtctctgtgtactggtttcttggaggcttactgaagaggagcagcagagcatgaagctggagagatgtccaggtcatgggaactcctaaagtcatacttagggactttatttcaccctgtgtcatggggagccattgaagaggctttagcaaggctttgacatgctcatggtccaagcccttcaggaagcaaactggtggctatctgtagaagggaatgggggccatgagcctgattaggaggctcttgtagcatccagacaagagttatcatgggcctttgctttttaagtcaaggttgtgagggacttttcttggcaggtgatggaatccatttgccatgacctttgagagaatagtatctgagctggccactgataaccagcagcaactgcaagagtcacttggttctcctgggtgccctgggccctctatccaggtctgcaggcagcagggccaagctcagctctgctcactcttattggtagttctttgaacagtgaaagaaaagcctggaaaatggcattcatgaagcagctactatgtgccaggcactgtgctagaggttgtgtgtgcgttgatctcctttagtcatcaccacaactcattttactgtgggaaaaaactgggactcagggaaatggagtgggaaccagaggaagtgctggatctggggttcacatccagatttttttactccaaggccttcactaccccaggcagcacagccttagtgaacttctcaaaggggaaatggttaagagctaagaaatgaatgcccttggaagcataaatcatgagatttggggctatattagtaaatgttgcgattcgggctttaatttttagcagggtattgtagaacagtgggaaaacccctgctctggctctttcactgcctacctccgagctcttggggaagagaagaggataatgcctctctcctcatgggggtgtggaaaggaggaatggggttgtgcatagcgaaagctctctctaggcagtagatctctacaaatggaaggaacgattatcactctcagtgatatttgggatggtcttttcttgaagttcctctttggcactgatgttttccccttcctttttttctttttttttctggtatatgccatggttccacctggaccagcgggcctccccttcctcatcatcgagacaagcaccatcaagccttaccaccgagggttttactgcaatgatgagagcatcaagtacccactgaaaactggtgagacaataaatgacgctgtgctctgtgccgtggggatcgtcattgccatcctcgcggtaagtgtccagactctgctatggtggatcctgtctgacttcttcctgtattgtcatattatagaatgtctgagccaacagagacttataccaagtagaagccaactttctctggcctatatttagccaagaaggaaggtagttaatcctgagaacactaaatgtgaagtaagtgctatcacccccattatacagatgggagagttaaatgacgtactcaaagactacagctacaaaaaattcaggttcagcctgtgcctggctgatttcaaaccccctttccatctcgcagacttacagttcaggaaggctaacctgtccaaatgaactgctcaaggggataggcagttagcttatcttgcctactctggatcaaatgtaagctgctgatgttacatgtaccacatttcatgtagttttcttttgacttgcccactctggaggttggttgtaaactttgagacccctctttgttttttaataacatcgtaaaccaggcacacaatcaacagcttgaatttggggagggggaagggaggctagtagaattctttccaacctttaaaagaaaaacagtccatttggcagtagtttcttaaaggtggactaaggatctttgtgtttgaaaactgaaaaatgaaaggtctagttttcctgtgtgctccaaattgacagttgtgggtttgagtttctaggaagaatggctttccctgaaaaaggtgtttgttgtggaaagcaaataattgcacagtatcatgtattgaggtttgaacaggtgtttttgaaagttggaggatcagttaattgaacgcttcaaaggagcccgctatacccaagagtgtggtgagataagaaaagcacagggacaggaatgtcacatgctcgtcactctctgtggcattattcccagcttgcctagtgggctgctcccagacacagggcagtggaaagagacactcttcagagcctctcgtagctatgtgaattaggtggatcattgatttctttaaccttcagtttcctcatctgtaaaatgagattgctgtttggattccctcaagaggattgctgtaagaatcaaatgaatgccataatgcctggaattgcactctgcagcagtgggctcactggaacgttgagagtcttttagttgggaatggttctggttttctgacctggccccaggatgggcaaaggaaaatgctaaagtagcttctttagagttcatgtgtctcctcccatccttccttccccaagcagagcttcagatcagcagctcttcgcttgctgcttgccaaggccaatccctttctccttaagggatgtcagcatttcttagaaaaaaatgtgctattgagagcttcattgtggcttgcccctttccttgtgttatgttgatattttaattacaatgcttcctgacctcccaggttttcttgaagcagtcatgtgctgtggcctcattatacaatgagcaacagcattgcttccccaacccatacaatggcagcaaaatggattagatagtgctttcctatagttccggagaaacacaagccaagaaattactgcaataattgttatctcttgtccagtgctactgtgtatggggatacacgtgaaaaatgtggatgcatttcacccttgaaaccccaagagctagatattcttagggttttcagtttagcacagggttaaaagcacatgccctggttcagacctgagcacctctgctgtggaccatgtggcaaattaaccttatggtgcctccggaaatacatctgttacatagagatactatgtctacttactaaggttttgagaattaaatgagctaatgtatataaagtaactcagtgcttggcacatatggtatgcccagtaaatgttaactatttttattctaaatgagtaaacagagtcaaaaaatggtgaagtgacagccagatgttatatctggtaaaaatacagtaaggaaaggaaccccagccttagctacaccccccactcttatcttatagttatttaattagaacccaggtctcttgattctcactcctctttgcaataggaatttcttacctcttggtccaactgctgttgcatttcagctggagacacgtgaattgggggctcctaatgaagcctcctagcctgcttacctgtcataactatcaagggtactcacagaaaaaggtaaaagcaaagacctcagaggtggaggggataattcacttttgcattctcagttctggaaaagctatagagtttaaatttaacaacaacaacaacgatgacgtcgacacatttcccactttcccagctggccccatccagaacccggttctgattagagggcaagagtgacagacgtggagggtggaggggcccagagctggaaattgaaccatcatcctgctgcttgcagtcctgagccttctcctgctgaatgtcaggtttgtttaaaacagcaagagaggccttgactgagttggatgcccctgctcccattcagatggtccccacaacaaaggaacggaatggcagtggaggagaccagtgtggtttagagatgcaaatcatcacgcgttatggagaaagcagacacctttcaatggcaggagatatggaaaaacctagtcatgttgacctctttttcagatgtatctcagattctggaattatagcataataggaattccttccaaatccacaaagcaatggttcctatccctgccttgcaaaggcttaatgactctagcagcagtaagactaggagcaaacagtaaaatatcatctcctatctctcagttttgtcttgcactgtattacaaagagtatcatgggcaaagatttaaaatgggcagaaatgctaagtattcattttaaatatacatgggctcagtgcttgcctcgctcagaacctaaaaggggtttatacagattcttaatatctaggaattgatgcatggttgagtcacggatgaatctccttctctccctagccataaaaatgctacctaacttgactctgacttctgtaataatattcctaactagagaaaaagtcaaacttaggcatcatctgacttaggtacatgtcccaacttgagtgcttactcattctgtgacttgtccttcaacctcagaagagccattgggccccttggagctatactttgcttttctataaattggtcacaacggttcaccaatgccataggcttgttttggttgtcaaatcatgtgatattgtgtgtgtgataagtgagaatcatccttcatatgtctgtagtgttgtacagtttacagcgtggcttttatgtgcacgctcttctttgcacctggtagtaatcctgggaggttgattcttacagctaactcaaccggggctcaaggatattaagtgactctctcataactaagtagtggcatggccagaccaggagtcctctgattcctactgctgtcttctgcagcctaccctccttccacaattacttatcaagggcctatgatgtgtcaggtgttcaccacacagtagtgaacctcagcacaaccagctgcatgttgtctcttgtcatgaaacttagcagctaccccatctcgagcaggcaaataacaccttaatacaaactgtcataggccaaggcaggtggatcacttgaggtcaggagtccgagaccagcctggtcaacatggtgaaaacctgtctctactaaaagtataaaaataagctgggcttggtggcatgtgcctgtaattccagctacttgggagactgaggcaggagaatcgcttgaatccagggggtggatattgcagtgagccaagatcatgccactgcactccagcctgggcgacaggatgagaccacgtatcaaaaagaaaaaaaaaaaaagctacataataggttgctggaagacggggccaggtcttttcctctgggcacatggtaggtacttaaacaccaggcggacatttctccaggaagcattccgtagctgtctcctcccccaccttccaaaggtcacagagaaccctgggcccacctctgtggctgcagtcactgtgctgattgtcatgtctgtttacttgtatatttcttggctaccctgttagctgcacaggggagagacagatctgatttgatttggtattgctagtgtgagacatagaccttggtgctcaatatatgtttgtgaaaaatcacagaagaggccataaactgggggcagaaaatcaaaagcattaggtcaaaagatatcagaggattcacagagcaggggaaaatgtcctgttttcttccttaaaatctcaactatgctccaggaggcacatgggaacacactctgtaccacatgcaaatttcttgctggagagacaagaagaagagcttagtacctgcaagacttgtttattcagtatcatgcttcactttgcccacatctggacttcattagttcctccccacccctccatctccctttatctacaagagccctgccaagaaaacaaggttcctcaacattgcctcctcattaaaggctagtcgagttttcaactctgaaaaatgtgcagttgtgctggcccagtggtgcattagtgggagacccagtcccccagtttacaatccactacatctgtgcaattaccaagaccaccaacagagagaggccacattaatccttcaactgtgttgtcccctgatcagatggctacagagttcttctgagaccttcttatccctgggggaacagtgggagggggcatctatttgtgatttaacaacacaggcatggagagtgcactaaattttcatctgttccctttctccaccacccacactcactctcatgtcctggaagaagtgagaacagcagcaattcttccttagttaggtacagctcttagggattcatgactatttgaaaaacgtatcaatacggaggtgatgatatgctccatttgaagtcataatgcttaggaggccgagaaatactttctgtgaggggcagtgtgtgttggggatggggtggagagtcagataacatttatgagctatttaatggaccagaaactcatgtcttatcttaaatcctcttcaacagctatgtgaggttgctattatttaccacatttgacaaatgagggaggacactgaggcttataaggttgaagtgactagcccgaggttactctgcttagtgaatgggggaacacgaattaaaacctagatctgtttggctttcaagcctaagtgctttaacagatgctaatgaaggcccactctggtcggtgctatgtagagtgctctttatttagttagctataaaagcttttagttactgggcttggagagttaaatgtatggaggaagataaaacatctagaccactgggcagatgactgcccaagattgacagtgtgcatcaatggtttgtagagatggtgatcacctgctgtgtgtaggtaggtgccgggtgatacctcccttatagcaagcaggctttgtggtaggcaccttggcctataagctgatgtgtaaaatacagatcttgcctttggatcttatggtttaaagggaattcaagacaagtacaagtctgactataggattagaccctcaaggaaaggaaataattagtctgagaataagaggagagtcagggcagtgcatggtggtggctgctagggaggggagagcttcaaggacgaaacatatcagatgctgcagattgtctgaggtctaaataaagtgctatgggagttcagaggaagagcacttaaggctaaggcttatgccaaggcttcatcatcatcattattcactgagcactcgtctcatataattttcaccacaaccctgcttttgatactgtcatcatcttcatttttagagataaggaaactgagacttagagagctcagttgtacaagactcataagtcaaagagccaaactctaacccagaacactagttggcacttgagctctactttaaggcataagtaggattttcgtcagagaacctgacctaggcagaaggagtggcttcagccattttagagacttcaaaacaatgaagtgttttcagggaatgtagagcagacctgtttggctgaatgaatggaatataagggagtagacaaggttacagcaggaaaagaagattgtggcaagatcgtgaagacccttgaatgctgaggaatttttactccagctaattggctagaggttgatgagagtattttaagtgagcttggtcaattttctaattaaggtaaagatgaggcctgaaccacagtggtggcaatgcaagggaaatagaaaaagatggatgcaaaagaccttgcaaaagccggatggacaatgggataagggagaggaaggagtctaagattgcacatctttgtcagtcatatgcttggtggcatcttgagcagaactagagggaagagaagtgaagtttgggacaggagtgggaatgggtgtgaccttagacttggttaatttgaaatggtactaacatctccaggtgggagagttagcagaagattggaattgggccaattaggggaaaggggtaggctgaagctagagagagacagagagatgcccttttgaaggtcatcttcacagaggtaacaattgaagctattgaagcagctgagatcacagcagaaagccaggaacacaatcctagggaagacccacatttattgggtagaagtcagatgtggaaccactagaagaagcagacatacatttagaaatagtaacaaaagcatggtggtgtgatattaaggaagcctaggaaattcaaggtaaaaaaaaaaaaaaagagtaagaggttgcagtaggcaatgctgcagaaagaacagccaggagattcttgcatggactggcagagttgggcattcaggaggcccatgactctgagtccctgacttttgggaaaacaatgatgctttatgcctcagactctcttcttcatgagacttgtgggcacagggcagccactgctaatttcaaccataaataacttctgtagcccctctctggcctctttgctgtctttattctagatattggagttctgacttacccataaagcccagaaattatactggtgtctttggacagatctatgtcttcattacctttcccagacagtgaggcactgatcttctgaaaaaggctgaagatgataaccaagtgacagaagaatcagagaataaatttccaatcaactatttctagttactaaagacgctgcactttattgcagtagatggagcagtcagtgccagagaaaatacagccatacatctgtctccatccttagaaacaggacccagtacattatatttttcctttcctttgggactgagaactaaagtgagaaatgtgattctcccttcacgattctccatcatcaacagtttgttgaattaatcttttctgggcaaaagaagttcatcaattcatgtaaccgagatgtaaaagaacaacttgaccctctgtggctagcaggaacttagaggtgcaggtgcctttcaagatggcaggcccttactgggtgttctgtgaacatatgtctctctggagacatacatactactgcctagtaggacttctaagagaaagccagctcgatgccattgggaacagcacaggaattagaaggaggaagccccagcttcagtgatggtcttcttgctgtctcatttttatcagagtgattcactgccctctctggccttcatcatactcatttatataagtgttggtaataatttagtaattcatatggtgttgtgagaagcaaacagtatagtggatgtgaaagtgctttgaaagctgtaaagtactaagccaatattattaaagcagatcagagtataggaaagtttgtccttcagactcagcggtggaagatgagttctcagtctctgaaagagattgttaggctgctgtgcaaaaatattacttttcttgggataatttacaaatagagtggaatgttaaaaataacacaaaacagtagagtagggttgtcccttctgctttgggtttagactttgcttctgtcttgatctgctgaaaaatacatactagataaaatgatcaaaagcaatgtcatccatacatacattttctggtcctaccctggaggggtggtatttccaaactcttcatttaggtatggtatcgtccaaggagctcttggaagagatactctctacaaaacatgttttttatttgtttgtttgctttcctcttcaatggagggaagaaaaaagttaacttttggagggctctcctgctaggtgccaggcgattgacatatcaccttatctaattccctggcaatcctgccacatagatattattaaccttattttatagatgaggacatctaagcccagagaggtaaagtcacatgcctaaggtaatagacaagattcagacaggtttttctggctacaacgttgttgcttctttcaccacctcttgctctatcttttcccaaaaatctatcctaatttttcttcatatttcctctccataacagttaaatatttgtaaatatgtgggcagttgagctctttttcaccagaaaagacaggaagaggagctgtcttgcagttggagccaacctctctccaaactgcagcccttctcaggcaaggactgatccctttctgtccccttgtagcttaattgcaatgctttcccattttattagtttccagattctgtgccaagtgctttaaaaggcaggtaggggagaattctctgcttgcctggcagcctgccatcacccccagaatctgttgcttgctgtttcagaaagggatcaacattgaaggcatttttctcagcagtgaaatttacatatcagaaccttgctgactgaggcagaaatgagggctctaggggcaggagtctgggagtggggacagagtctttgtaggaggagggggagggaagagcttattttcttacccaggaataaaaacattgtgagtaatgaataaagtccgaaagcagtaaatctgggactcgagagttaggtgtgtaacgtgtcggagaacaatttaagccttcgcctcgtctgtagaggtgaggtattcaggctgcctttcacaacccaaatttcattaaatagacttttaagggttaggattacaagaagccaagtccgcctggttcataatgatgatttatggctgtgttgtcgactccctgacccttctgtacaaggggatagagaaaatacataatttgttgctcattcactctaaaatctgtcaaggctgccccagaagccatgtggtcctggagtcatgtgtctgctaaatggcttcagcctggccctctccttaaaaatctgcaattgctcttctgcagtggaaattggttttaataacaatagaaatgataaaattatctcagtgtagtctgctgtgggtctttgagcttaagagtcagaatacctgggctctactcttaactctgtcacttactggcctcaaatccttcagaaaagtcactgtctcccagagccttagtatctccatctgtagaatggaatatcttcttcacagagaagattcaatgaaactacagtacaaaataaatgtaagagatggctgctgttaacattattattaggaatttgaggtactgcaaaatgttcttttcatctccttgttttcccttgagtgaaggaaacattttactttgcaatttactatcttaagactgtgacactaaaaatggaagttttagagatgggacattagagctgaaaagaatccctgaattgtaatcaaaccccgtctccctaaagtaactggagcagaaaggtgactcatctgagattaatcagtaaattcataaaagagatgctaatttgcattggaaactcacatgttctttctcagcatcaaacaggaaatcgtgttgactgatcctcaggccacacctgcttagaaacagttccttaatctgtagcagtgtctggttcagggaaccagagagcaatctgaggtcagggattttatctggggccttggttctgctccctgcttctggtgtcatctctgagcaagtaactttcctctgccattgcttattacctgtgcttggttggcaggctagtggtggatggtggacgtagcccaggaaagttgagaataaatgtcattgcagttatgaagtcataaatcagagtctagcaccctcgttttgcaaatgcagaaaccaatttatcccaaattcactaaacaagtagggacttgaacctcggctacttgactcctagttcagtgctcttcctcctgcataaaaaatctcatatgacttataaataaggaagaataaaaaagattaagagaacatgattgtggtaataaacatctggaacttgtttgcctgtgaggttacatagggtaaatgtataaacaggttcaaaaggggaattagatcatgaatggtaggaaagaatgctgggcagggagtcagtgcacctgggtttaatctttagatgggagctaatttggacctaagtttcttctaaatataatggtccctttcattaatgacttgccatgcttcctggagtttaatctctgcaacgtgttatcaaagcattcttggtaatgttgaggggatacttccaattttgtaataaggcaactctgaggactaccgtcctgctccctttccttcatttgttccttcaactgatagtctttgagcatctatgcagggtcccatactagttttgctctctcaggaaacggctatgccaagatgctggctagagtggcctttgcctatgttcctctaatacagaattgtactcaatatgttctgggaaaacaaaatgtagctcttatatataaagcatttatgaacacagagtcactgtgtcaatgttggcagtgataatagctgttctcactgctgcacctgtttgtccctgggcccagctggtgtttccttcctacgtggtcgtcctcccccagactttggagcccttgaggaccttgatcagacctcatgccttgatgctttcctccactgtaaaagaatattgggagcctttgcaaaggagtgtccggatatgccagactattgcttcccttgtggctgtgcacatgctctcttccctctgaaagggcaagtgtaactcatcatcctgccctgggaggaagtgtgaagggacttttgtggtgagtgatgagttgaccatcactgtctctgggctgtggttacaagcaggaagtggccatggctgggctgtggagttaagacaaaggcagcagggtgtgtggttgtgcacatcataggcatttaccttacagaacatcagctgtcccccatccttaatgtaaatgatgtcactatatctatcttgagcatcaggatttcgtgacataaagaatataaaagcaatgtctggtatataataggtaatcagtaattggtggattattttcagtagtgataaatctcctctaagcatcatatcatagatacagtatgaaaatcaagaaagatttgagaaggatcgtcaggctcagagaagacagcacaggctgactggaggaaattcacaaacactgaagggcatcgtactacaagtttcttagttgttagactggtattctattcatcacactctgcttctaaaaagtaaaagcatcactttctgtgatccaggtcatttcccattcatgttatcctatttgaaccaacaactgcaaaggtgagcagcctccttttatggagcagaaggccaaagcttggaggatgtagattattgctgaaggataccagattggtggcagagtctgaattccccaggacttaaccatggtgtgtccagctcttcttacagaaactctcaccatggccaatgtcagcacaaggctgaggcccttactagagtcaggtcattgttggtgatcctttaccccaaatctcagaatctcgagatttgctcagaccctgtgacatcatagctaccctttaccttgtcgttgattcttcatttagtatttcttttctatagttaagttcttgtctctcccttaaaaaaaaagatacacacacacacacacacacacacacatacacatatatacatataaatatatttggttgtatatttttgttgttacaaaggggcttaaaacacccaactatattagcgctttgatcttttcttctgtgcatatttgtgtctgtatatttcataaatagaaaattaggacactcctttgcaaatactgaatattctcctgtgttgttgaatatccgttacggcatcagtgttgatgatgaatcttgatactgcctaattcccctgttggattccttttagatcatcacgggggaattctaccggatctattacctgaagaagtcgcggtcgacgattcagaacccctacgtggcagcactctataagcaagtgggctgcttcctctttggctgtgccatcagccagtctttcacagacattgccaaagtgtccatagggcgcctgcgtcctcacttcttgagtgtctgcaaccctgatttcagccagatcaactgctctgaaggctacattcagaactacagatgcagaggtgatgacagcaaagtccaggaagccaggtgagacaccacctccgcatggccagagcctggacccctttcatacagtgcagttcagtgagcacttactagctgggccctggtttagatgggtgaataaggcatagttcctattcttgaggaactcacagtcagatgattgagacagatatgtaaatcaatacttccgatatagcatgggtaggtacattcattcattcattcttttgtttattcatgaattcataggtgcctgctatgttccaggcatgggtccaaagcactaccaaggatgcaaaaatgaacagggcctagtgcctgctctcaaggttacagtctagggagggaagacagacagacaagtgtgtatcagggatgtgaatacggccctttcatggccctctcttgctcttgcaggaagtccttcttctctggccatgcctccttctccatgtacactatgctgtatttggtggtaagtacccaccctttgatttgagcagtgctcagttccagcttcgatcccttctgatatgatagccctcaaaatagtttaggggcatgccatcactgtgaaatccttgaaaaagaggttagctagaaaagttaggtttaattctgagcgctgccactgccttagcagaagttattttactttctagttttttcccccatttttcaaataaaaatagtatttgccatagctgcttgataagcattgtggacacattttggaattttaaagtgataaagacacttgtattaggttggtgcaagagtaattgaggtttttgccgttacaaaaacccctggactacattacttaaatggcaaaaaccacttactcttgcaccaccctaaatataacattttagggtacaaacactgttttctgaaaatctatggtgggaaaagattgctaagtaagtctcagaaaattaaagtgaactgccaaaatgtacgtaacagcaggactgttgctcaagcccaagccttctgataaatttttttgcaacgttcaccatgtcagtcctctatattctacggatggaagggctttaaggatcatcattacctaagtatttagaataattttgagttttgcaaaatacttctgctccatgaggacgcatgacttcataacaacactgtgaagtataaaatccatgccccatttctcaaatccacagaccaaggcccagagaggataagcagcatgtttgagttccttcaaccagtagtagaaccatgatttgattcccatgctcttctcatggccgtgtctgctctgatttcctggagacggttgggtaatgcaggtgaagtgccctgcttgcctccagctgctggacagacagagggctggtctgtttttctttgtcagttacatgtgggtttccctgccttgcctttccccttgaatgaggtccgtgtgtgccaaggcacttcctgctttcagccgctttgatagaattcagagcgagaaggtgctaagaggtcagacatagctcagaggagcacaagctgtttgaaaaaagaacattttgatttcaacttattgaaaaagcacaattaggaattgggaaaaacagcagaaagtttgttttatttatttatttttccccccaatcctttctaagtttagaggcctctaaactaagccaacattggcttcccattaccgaggatgcagagctgaaagatgagccccaacttatgacaacattaaacatggattttatgtgttcatgaatagcacttccctccattcttcatctttttttttgttttgctcttagaaaggaaaatttagcaaagatatttaggttcctgctccctttgtgtattttacccagggctggaaacaattttaaaaatgtaatttcgatgttttataaaagtgcttagaggaactgggtatgtgttcatttttttcatatcccttcattttattccaaatgaaaaatactggattgttttgaagccagcactgtgcactgtagccttcacagctgcgcagcaggtgaagatgctgacacactttggatgccttctgtgtgccaggcaccatatctacttactctgtgacatttgcttctcagtgacctgatgaggtgcattttgattatcctatccaatttgaatctaagaagttcagtaacaaaagttctaccatcagtcagaggcagaaaaggtatttgcaggccagactccagcattgttttatgttcttttcattgtactgtgctacaaaactcaaaacaaacaaaaaccagacctcttcaggttgaacttaaggaatattacctcttaaccctaacttaaattttgcctgaaggagacctgtctccttttgctttgatggttgagatgtcccctccctccggtccccaactccaattacctccttaccatctagagatctctgtggggatgatgggtgagaggtatattttgattgaaggtttatttgcatccctcagagggaggaaaaagttgtagtgcttccatattgctggaaggaaggaagagaaagagggaaggaagagaaaagggagagaggaaaggaagagagagggagggaggagagcctcctttggctggatggtggcttatacctgtaatctcggcacttaagaggccaagataagaggatcccttgaggccagcagtttgagacaagtctggacagcacagggagaccctgtctctttaaaaaaataaaagaaggagagcctccttaatccatcctctcctcagcatgttattatatcccccacctcccaccccactgtgcacatacgctcttcagaactcttgcacaaacacacattcaacactcacaactcacatatacaacatatatatacacagctctatttttagctctaaggttatcttgccctaaaacaacctgtgaagataagggtcaaaaagtgaggacagcactctctgccagggcatgtgtttatgtgatattacagagaaatcccagctcttgtaacatctgatctgcaaaactttctttgttcttcttcttcttttttttttttttttttttttgagacagagtctcattctgtcactcaggatggagcacagtggcaccatcttggctcactgcaacctctgcctcttggactcaggtgatccttccacctcagccacctgagtagctgggaccacaggcacatgccaccacacccagctaatttttgtatttttttgtagagacgaggctttgccatgttggccaggctggttttgaactcctgggctcaagcaatccaaccaccttggcctcccaaagtgctgggactacagatgtgagcctccgtgctaggccgatttgcaaaagtttctttttttttttttttttttttttttgagatggagtctcgctctgttgcacaggctggagtgcagtggtgcaatctcggctcactgcaacctctgcctcccagattcaagcaattctcctgccttagactcccaagtagctgggattacaggtgtgtggcaccacacccagcaaatttttgtatttttaatagagacagggtttcaccatgttggccaggctggtcttgaactcctgacctcaggtgatccacccacctcagcctcccaaagtgttgggattacaggcatgagccaccacccacctcagcctcccaaagtgttgggattacaggcatgagccactaggtttggctgatttgcaaaactttctaaagaaaattgaaaggacacaatttcggcccaccagaggaggtgggaaactctgcagtcagtccgagaagcccttagaccctcccccagggcttttatgttgagctgcaggaagttctggagttgggcaaagagactggactccccggtgtacccagtgctgtttttttgttcatgcagcctgtgattcatagcttccctggggtgttggggagaatcacatttgggtcagccaggtttagcactgacagttttgtctttagaatcaagcagatgtggaatcaaatctggctgtatccatgaccagctctgaagccatgagtgggttacatagctttagagcctcagcatactcatctggaaagtggaagtgatcatgtctattttgcagagttgttgccacttttcctctctggaccccactttccccatctgtcagatgaaagagtgggatgagatggcctgtctatttatctctcaatcacaatggctctatttgaaaaaagtttgaactgccctaagtgctaaaaaggaagatggggagccatcaagacaaacttaggcctacattaccatcgagttcagagaatggcagaccggaagcaccagccagctccactccaggcttttcacagcagccacttctagaggctccataactttaagggcacttcatgttaggtcaatgaataaattttgccaaatgatgagcttggaaaaaccatgccccaaacaccaaattatcctgcacacagaagcttaagggtgaggttaaggcttgttagagattaatgcaagttctaattaaaaaaaaaaaaacaaacccacagcatatataagcacaaagtatgctttatacctctgagccctggcctgaaccccagaggaccacgtctgtattgaccctgcacctccatggtcggagactgaggatgacatgctatctggataaaatgtcaacaccagggcagacaccaattcatgcagctgaatgtctgctgtgttgtgctgagccctgcccttaaggaactcacctgtgcatccaacattgagcatttggtatatgcttagtgagggactatgatgcaccaagcaccagctaggagtgggaatggggagatggttacagcccttgcataatttagtctagagaaacagtacacaatgataatagtctgatacattgtccctcaggggcaaggggatatgtaggttatattacggactctcagaattatgacccctaggctcacctggagcagagagtggcagtagaggtagttagtcacatgaagatagaggagactggaagaactacatgtgtgaaggtgaaaaggaggaggtgatttggagaactgcaggtattcagttcagtacagcttggatggctgctaggaaccagggaatggagggcacgcttgagagtggaaaatacctttgggatcagtcccagctcctcattttgcaggtgcattaggcagccactttgtgtcaaggcctttccttagctgctgttctccccgcaccccaccccgaaatctgcaccttgcccccacccaccttctttagaagcctttcctgactaccctgtttagaatgacaaccccctcctctgacactgttctccctatgcccctttgcagccttacgtctcaccatctgacatactacatacttacttgcttttttgtttcttccaactaaattataaattctggctgggtgcagttgttcatgcctgtaatctcagcactttgggaggccaaggcaggagaattgcttgagcccaggagttcaggatcagcctgggcaacatagtgagaccctgtctatatatatatatatatataaatgattaaaaaaggctgtaaattccccgggggagagattttttggtctcttcattcactactatatcctacttcccaaaataatgcctgatacctagtaagtgtgcaataaatatttgatagatgaatgaatgaatgaatttcaggtcttctgacactcgggccatccgcctttccattctgatcagaactttttttgtctcctcatcacggacttgatagattgctaagggcctgtgtaatgtagggaaagtctttgctccctctttgctgagctctctccctattgaccctttactgtgctgtcccaggagaactgtttgtgtgtcagagggtttgttgggtgccaaggaaatggaagtggctgtgctctgacagccctttctctgggctgtgcttgttagccattgaggttttgttcagcatgtatggcgccctggagcctagggtctggtatgcccacgaggtgtacccacagatcctgggagcagctgtagaaactcctttggggagcaagattgttgtttccaaggggaatctgtaccagatgtttttcctcttttttctccctatatcattcactcaccccaccacacatccatctatttctgagtacctcttctgtgacagaccctgtgtgagtgcctggggacaccaaaagagctcataattttgtgtggaaagccagagaagtaaatagtggccaaacagctggatgcattctctgcttaggggtggactcaggggatggaagtggccctcacctctgctatgaggtataatgagtcagctcttaggctcccttcagcttcagatcaggtcagagattattccactgtaactcttacaaaagctgtacgcttgtgtttcaaatgtggaggttgatggaagtgtgtgcaggtgaattagaggagtctgaagttctaaatgtcccctggaggttgtcctttggtgttttgccctcaaactgcctcttttctccaaagacagaggtccagtataaaaagactaagactttatgtgaagcagtaattccctaaggaagccaggcggttctgtgcttagagcacagactcagaaagaggcaaatatactcaatgtacatcatatctcttggttaccttgagcaagtactgtggcttcttttagccttgatttcttcatctgtagaatgggcacagtggtatccacctaacaggattattgtgacaattgcaggtaatgtaatttaaagcactactggcccaggggctacaccaatgctcagcaaaatggtggttttctttcctccctctgatagtgacagaagataagataggattttcttctaaaggaaaagtcaatcgaaaattcttttgtcctgaaagtagttaaagaacattccagagagattctacaatatgtttgcaagctacccaccaggcacatgaaccagagcccagtgaaagccatagaggaaattagagaagggagaaagtttctcactgggtgtcagtggtctggactggcttccaggaagagggtaggcagggacctaaggaaggacaaaagccttcttttcactcttagcggagctgtcccaagagcaatggaaatgaagtgagaggacagtacagacctgttccaccagtatgcaaatcatgtaatgaaacacaaatgacttagcaagaacgaatgtgactcacacactcatctgactctgctggttcagaccagaggaacagcctcaagttcagtcggacctttctaaggaggttttgttggaattccacaagaccctagttctgaaggtaggacaaagaaggagaagagaactgcactgacagagtgagttctacatgccagggccttacatacatcattttggggtatgggaaacagacatacatctttctttttctcatatccacaatcagcaatttttttttttttttttagcaacggaaagcgaaatcttaatacaagaaaaggcctttaagattatatacaagctgtacgtagcagagaaaaggttccaatctagttgctgtggctgcaaatcactttctgcggtgtcattgtggggcttgggaagtagtttcagagggctgattctctagcccagaggccttcatgcagatgaggaagtgaatgcagataagccagaatgtcagcagtagactagaagaggtcaagatgattagactttcaggttttgtccagctctacttaccctttcagggcacctaggactttactaaagcccctctgggtattctgatctgggaaagtgtgttttggtctagaatagggggatgacatcatctatcagcagggtttgacttcctttcttgaataagttgtacctgtcttctgtggagtgggaataaatggagcctccagagttacttgtccccaggctccagaatgtactcactgatcctagtgaggcccaaacctgtggcctggagtggcttgtgtgaactgggttctacactggcaaaatccaatccatttgacagcagtgaaattggagtgggatggagaaggtcatcgtatcctttcatcaatcccaaagcctgttgctactggcttttttctcatatcagatgtagccactggatggaaagtcattgtgcaatctcattctcgactcttctttaagtttcaccaaaacttacttgttttggtgaaattgccacagtcattgagtaaatgtcattcaccagggcagaaaggtaacctggatttctgaaaagtatcctgagtgcccgtcctgtgccggacaggttcctttccatgtcatctcctttgatcctggcaacccagagaaggagatagtactgttctacctattttacagagaaggagactgaggcttatagaagtaaactgaccacccacttagtaagtgacagagccaggactggaatcagggctattgtaccccaaaatgcactttactattgcactgctttccccaaaatcccctgctgcagacaccaggatcagtgctgaccttgaggcattcctccataaatgtgttagttaactgatggatatcagggaacaagctctcatctgcttactgtgatgtctgactgactgcttcccaaaggcgttcttttcccttggctccctactcctttctcattcataagcactcccttcctttctggagctattctgatgactggtctcttcctctcttctcaaattcttatggtgtatttatttttttcttgtattaagctccaaccttaagtatctgaatcaggggaaggggagatgtgggctttgtccggttgggaaacacgcccttcctctgccccacccttgatttccaaggcttgtgatctaagcctgcatgcaggggcagggggaatggttgaaggactcgtaacaagcattttccgaggacctacagatttttcagcaagggaatttagaaaatcttgccactccaaattaagaaatgtgattaaagaataaaatcacctatttgttgagtagtatttcatgctatcctcttgatctacattatcaaccaacctggaccacagcctctaagagagtggttgctacacttattttatatgtgagaaaatggaggctcagggaggttttcctgattaaaatctgtgctctgtctgttatgcaccccacccttgtccactgccaagaatagctgagggaaggccaaacatactgagtacactgcaagtggatgattccttgttcttgaatttgccattgtcctgaagacttgtgttgagttggagctagactaacaccgtcttcatccccatttccaaaaggaggcatattttcatccactggtaggtcattaagggagtagtctttggcctatatagctccaattcactgactttggtattgcctatagtgacccagtcttgcctagagctcttgaaaagcactgagagtgtggtactcagtgctttgcatgaaatcatttaatttttcaccattgcttacagtaatattttccaattgtgattcaaataggtagatgttctctgaaaatagtgattaaaggtcaaataagtattctttccttcaggacttctcagaggctttagtaatcttataagcatgataattgacaaaaataaggatttagtatagaacattcacctatcttttttgaagaaacccttaatattcagtggaatatggtttgggaaagactggcctccaaaataaggtctgggttgcttagtttgacactgaaagcccttcgtgaactaggccctccttgtctctgcagccctatttctcaccactgctcacccaccttccccaacaccctcttctccagctatactgaactatttgaagttttggggaacttctgtggaaggcctctgagccacccctctgcctggaatatatatcccccactcctgcccccttaaacccagcaaatactcattcacctttaggattctggtcaagtatcccttccaaatagtaattgaccccagcctctaacttctttcatagctcctataaaacacattagtatacttatttattttcttgtatccctcaactgtctgctctatatgtcaggatttataaatcctcatttttctttgtctttagcacttttcatagtgcctagcttttttctttttttttaaatttaatttaacgtatttatttatttatttattttgcctagtaccacagatttggtcttttagattatctttagaataattttttccccacatctttttcggatgtccatggcaatctaatagtatttacatatcaacttctgaatttaaaagtttagtgttctaagtaaaattctccctctctgtctcttcaaattgtcctttacctcctttattccataaaggctctatgctatcttcttttacatttttaactggttattatttatatatgagaaaaccattgtttttatcccttgtttagcaggcaacggcctcagtgtgatcttttttgtcagtattcttattttttcctcttaagtttttccaataatacatttttataatttcaaaatgattataaagtagtctgctgtcttccatgtctgcttatttgaaatagtgttccacgtagttgaggattcagtcctagacacttatggctaagaatgattctgggatcttccactcttctgtctcatcaagactggccactggcttgctcttttcttgccaccgaaggaaggtgtccatctgtcccaggaaggacaaactcatgtcttcagcactgccacaggtctatctttaggccatcagccacctcccctccgctctcttcccttctcctgcctctccaagtgctttgatttgtagtcggaagttcctcttgtccacttgcctcttccccctcatttcccaagttcccacaggaacctgggaataggttgtgcccagaggttagaacggaaactgcagcaagataactctgaggggacaatgcccagttgacgtcatttcaactactttgcttcagctagaggtggttttttttttaatcttccatttttcttcaggttactcttctactccaccctgtctagtgtctgtcaacttctatttgaaaattccctggcattgtctcgttggtttattgtttccttatattctcattcaatatccatagttccaagtggtgacttagaaatgtgtccttgatagagttgctttcttctgaagcagaagcatctcattggggatataataacttcctcttatcattgcatatttaatttccgtgctgacaccaggtagtgtagggattatatagccgtaatccccagggaaatacacaaatgtgttaagtaagttgtcatcaattgtaaaaaaagaaacctttacaagccctggttactgctctttaattattagtttcagtcaagaggaagataaaaggaaactatcatttattacgttcctactatgtggcagtgtgctaaggccatttacatatattatattgctcagctttccctggtttatctccctagataaactctatttttcctattttttagtgtgagaactaagactcagcatttatttatttatttacttacttacttacttatttatttttttgaggcagagtctcactctgttgcccagaccgaactgcagtggtgcgatctcggctcactgcgacctccgcctcctgggttcaagtgattttcctgcctcagcctcctgagtagctgggactataggcacatgccatcacacccagataatttttgtatttttattacagatgaggtttcactatgttggccagactggtctcaaacacctgacctcaggtgatctgcccacctcagccacacgaagtgctgggattacagacgtgagccaccgtgcctagccaggctcagcatttaaataactggcttgaggtcatgttcaaattgctgtatctacaacatgccacccaaggtccagatgatccctgttcgtagaaatgtagtgtgtgtcacctggggttatagtgcatgtgagtggggagtcacttaatgtctgttcctttttgtctcctttctccagctatacctgcaggcccgcttcacttggcgaggagcccgcctgctccggcccctcctgcagttcaccttgatcatgatggccttctacacgggactgtctcgcgtatcagaccacaagcaccatcccagtgatgttctggcaggatttgctcaaggagccctggtggcctgctgcatagtaagtagcatcttgtcctcaatatgcaagtggagccctggactgttgcttgttaaatgtttccagctcagtgactaaagctagagagccctcgttcctgtcctctgcttggtgtctgaagagtcacctggccttaggccttaggccttaggactccttcagtaaaatgagaataattcctgcttcttcccagcctgtgagttttgatctgatagggtctgtaaatctctgtaaatacagaggttttgggctcgtagaatgttgcaattggaagagagctgagatattgtccaacttgctcatgttatagatgaggaaatttagggaagaaacttacccaaggtcatgtgtcagcaggtcatgcttagtgtcatgctaagtctgttgacctagtagcaagatctaagtctcctgactcgagtgctcacatgctgttttggtggacacagtacgcaatgggacttctccgcttcttggaaaatgcctcctcttccctctgtgaccttgggagtgactcacacagaccctaaactcagtgttcattggagaagaggaggttatctgaaggctgagccctctctcagcctgaggccctcgtacatcgagtcacagacttcctagggataacttgggatggaccacatactgatttgccccaaatgaatgggttaccttttcacatacttcatctctgactccaggtgaaggtgggagaaggcattgcacttctctgagcctccatctgtaggcactgcttttcctgcctgctaagagttttgaggggcttattcagcgaacatgactgagcacctactttgatattgtgacttcctgggccctactgaggggagctcaccccagcccagcaggaatcccagagtacaataatggctggatatttaagcaccacacatgtaggttgtattgttgttagtattatccttgctcattcacagtaagaattatgaacaatagagagatctaaaccagcttcttatcctttcctggtttctgagcctggttgcaggcttatgtctcactatgcagcctctccccagctcctctgtaacagcacttaacactctggattgaaattgtcgatgggtgtcttcttttaggctgtaagttcttgggggcagggaccatgtgtaatatatatgttactctccctatcttatcaaggcctctcagggattctagctcagactaagcaaatgtgtgcctaacaagcaaaaagccagaatcaatgagttgatctaacctttcttgagaacactgtaggaagttatttcttgaaggtataggaatgaataaggctcagccctcccaaggaaattccatccttgctcctctcacagccaggccaagcacaggagcttaatgctgtgggggctgtcatagtgacatgtgtagggggcttcagcaggcagggaagcacctgactccatgtgcaggggtcaagaagagggagaaggagttgcagcaatcagagtgggcaccacgaagaaagcagtgtgtgaactgcctgcagcctttgacatgggaatcccagcctactggactggctgttttaatggctttctcccttgctttctttttcttttttctttttaaaagtaaaggccagaagggagagaacctgggggagcaaaccgttaatgagagcagctgtcactgaccggcttgttctctggtgcctggccctttaatgtgaggtgacagtgggggatgggtgtttgcactgaagggtaaccctttgctgactgtgcccttctgagctttgctctcagcaggaggacagcccgcgggggcctgctgttgtggttccttcttggcgccactgccctaattggagtcccctgcacccccagttaaaaaaattaaaaggttgggggatccttactagccttcctctcttttatatcctaaaacatgggccataagcaattagacagagcgttcgggaggactatggcttatttccaagaagtgaaatgaaggttctgacttgtgtcctgtttggctctcgctgactgtagcacagtataggaatttgatcctagcgtttacaaagcacctactctctgctggtaccattctgatactttacccattgtcttcctttttttttttttttttttttgagagtctcgctctctcacccaggctagagtgcaatggcacgatctcggctcactgcaacctctgcctctcaggttgaagattcttccccctcagcctcccaagtagctgggattacaggcacccaccgtcatgcctggctaatttttgtatttctgtagagatggggtttcactgtgttggccaggctggtcttgaactcctgacctcaggtgatccgcccgcctcagcctccaaaagtgctgggtttacaggtgtgagccactgtgcccagctgcccactgtcttcttttagtcacattaagccattgtactacagccattttacagaagtaactagctcagagaggtaacttaagtcatccagggtcagagagctaatagacagctgcaccacgattctcatggactcaaagctatgccctctgcactctgcaaggagaaggggtccctgaagctgaaggccctgcagttaacccgaaacagaagctccatagttagctgcttaaagagtatcatttaattgtgtcacggagtccttcctaaccctttgggtggatccagttattgctttgagtttgaaagcctgatttacaatgtaaagatggtttggaaaggggtgataaatctctttccctgccttttactcactcacctgtgaacatgcaagaacagggactcaatcttacctatcatttttctccaaatgcctgacacccagccttgtgctcagtgggacctcatggtccagaatggcttggaatcgcagcactgagagattcatttcattgaagccatctgagaggccaggacagggaagtgcctggaagctgtggctactgagaataaaagtttggaaatgttcagctgggaggaaagaaggtagtgtcttttccagccgtaagctcccaggattctgttgtcctgggtttgattgtgagggagacagaagcaaagctcaggaccctggattgaggagagatgggtagatctgtgaggaggtgtggggaaccagagaccatgtgatgaaggcaccaggtgcctgggagagggaactatgagtaggatgacaggcatctgcctcatgggttttgcagctttatcagggttgtgcaatgtagctgtcacgtgccaagcaggagtctgtgacctctgctctgcttgtgccacatgacagaactcttccccacgaatcagggccgctgtcccagggaatgccaggaaggagcaaagttctcttcttactcacaactatggctgtattgaatggtttttgaaacacagagacatcacctgaggttaagaggattgataaaaaagcagcatgtatggcacaaaggccaccacttgaggtgccaagaaacacagaatccattttccagtctgccagataacctcctgagccaagcctttacggactccctgttaattgagttgtaatcttcgctgacatttgctgagagcccaagcactcagagagaaggtagcaaagctggagttgaccccagacagcctgacacagagctggcactccaagacccaggctttggcaggtctcctctcatctctccaccccttcacctcccggcatgtcaaacatttcaatattttccaacacctgagtttctgtattagatacctgtcccctttgatggaacacagttccagtgtcacctcatctctgatgaaaccttctgtattagctgcctctggctgctgtaacaaattaccacaaatttagtggcttaaaagaatgcaagtttcttttcttacagttctggaagttgggagttggaaaagggtctcactgagctaaaatcaaggtggaacacattccatctagaggatctaaggggagatctgttttcttgctttttctagctttctggagctacctgagttccttgactcatggccccattctccactttcaaagctagcagcatagaatcttcacttctccctctctctctcacacacacatatactttctctggcctttgcatccattgtcacaccttcttctgtgacttttgtccttttgcctccctcttttacagatgctgggaccaccttgataacccaggatgatctctccatctcaagatcttaacttaatctcattttatcatgtagcatcattcattgcttctgggacttaggatgcgggcatctttgggggacattgttcagctttccacaacttccccagtccctggagacagtattgtctcacttccttccagtcccccatggccttttgcactttcttcctaccatggctttaggcctcatctactcatggcctgctcatatgtctgtctcttcagctagattgtgggtgccttaatagcagaatccatggcttaaccttctgattatttattctcggtatgtagtacagcagctgacacaataggtgcttcatcagcattgggtaaatggtgaatgatgaattagcttgtggcttcaggccagacacttcccttctgggcctagtttcctcacctgtgaattgaagctggaggccttgtagctccatgacctttgtgcacagacattctatggcacagctgactttgtagtaactgactgaggtacagtgcattaaccctagaatgctggttccataactgcagagccttaggcaacaggcatgacagccgagaacttttacctgggtctgttgagggtagatcctgtcacaacaggcagacttgtctagacaaaaatcacatgtcaaatggaagtctggtttcctcctccattgcttactaattgaatgctttccagaaaaggaagacaatggaagccagcacagacagaaaacctatacagtgtcatgaactcaacacaaagacacaagcacttagggtcggataggcctgcctgcacaccttcagagatctggacagaggtacacaggacaaaggagaaggccacagcccagatagaccatgaggtgcatgggcagacccaatcgtactcagaaccacagacacacataaacagacagacgaataaaaaaaaaacacaggctcatattggctctcccagccccctcccgcctacacactcactaagttacccctaccaaagatgtgaactttacagttggactcacacagggactaggacgaaggaacagacatcggttcatttcctgtctggtgacaacttgcatatctggtcacctcctccctgaccctctaacagatggcaaattaggggcccctgggaggggtcaggggagggcccggctgccattgctgtgggttcagcagaggaagcagctgctcatggatttcgtaaatacacagcagagtctttcctggttttcctcttcccgggggtgtggctccgcttgccgttgctcttttgtgtgctgctatcttcctccagatgtagggaagggcgagggcgttctttgtctctgccccagtgaggtgaccttgggaaaagacaccagcaagaatgccagtgtgaagaagagttcagcgatgacaacccctgcaaaaggaaactgcagtgcagggagaggccaggacacgcccaaggacacatagtagcagagtaggaaccaaatccccagtttcttgattccatctaaagggctaaacagtaaattccaagcatgcttagccatggatttgcaaggcctcttccttctctaacaggagagagtcccatctattcccttctgatttactccagggctgcctgggcacaggggaatggatgaaatgagctcccaaacctcttctggccctgcagaagtctagctctttgcccagtaatgtgaccttgaggtaatctgatcttgccactgctggcccccactcttaggcaggcagaaacatggatgtgggagagagaaggaagcaaagaaataaactttggccgccaatagataacgacactatctttgtagtactctacaactgttcaaaatacagttgaccttgaacaacatggggactagaggttccgacctccagcacaataaaaagtccaaatagaacttttgactccctcaaaacttaaaactactaacagcctaatgttgattggaagccttactgataacataaacagtcaattaacatatgttttgtatgttttatgtattatatacagtattcttacaataaagtaagctagagaaaagaaaatattatcaagaaaattataaggaagaggaaatatatttactatacattaggtggaagtgatcaccataaaagtcttcatgctggttgtttccatgttgagtaggctcacgaggaggaagaagaggaggggttggtcttgctgtctcagggttggcagaagcagaagaaaatttgtgtttaagtggacccatgcagttcaagctcatgttattcaaggatcaactgtacttataaaacttcctttcttgttcccctgctaagatggatgagctgacgaagcagaggttcagagaggaagttatattcctgccacttgctaggtaggctgtcagggcaagtcacttcacctctcagccaccttttccaatcccatgaggttgggatgataatgcctaacatgatttttggattgaggattcagagaattaaagatacatcatgcttggcacatgcaacatattgattgtgaattgtgcgttaagtactatgctttgtttaaagattcagagctaaaaggagttggtccttaaagagcttatctagtgcagtagctttccaagacttgaccgccatctataataagaaatacactttatatcataacccaatagaggcacccacacgtaactaaaacaaatatttcacaaaataagacttgcccttactgtgtgagaaattctgatattttctattaaccttcaaaaatgctggtggtaaccacctagttagttgattttgtagcttgctaatggcttgagaatgatctagtaggaatagacatgtaaacagacaagtatgatagaagggcacggctgctgggatgggatacactactgaggacagtggggttacaagagaaggggtgattaattcttcttgagggtgttggaagactagaaagaatttttagagtaggtaattatttaaaaatgaatggtcatttgctgtaagatacaaaagataaggaagggaattccacgcagaaggaataccatgaagacatggcgatgggtgagaacatgatatgttttgtgaccctagaaatgcagaacaacaaaacttgggggataatggggagaggtgacctcaatgaatagtagcctcattctccctttcagcttcaaaattggatggtttctgggaatggggtcccctgcctttgttgagccttggtcatctttgggtactatgttcctaagctccagctcctactgcatttagcaccccatagacagagctgtcagtcccctgggtactccttaccagacaccctccctaatagcctatgaatattttcctggaaggttccttggcatagattcctgttctccatcagtattgcccacaactttctttaaagggcgggggcgggtcttcctatgttgcccaggctggccttaaactcttgggctcaagccgtcctcccacttcaacttcctgactagctgggaccacaggcacacagcagcatgctccgcaaaattgctctcaactttctttcctcctctaaaccctctttgttcattttgtgggactacttttcttcacattcctcaatagcagtgatgatgtgaatagtccttcataaggctgggtgcgtagtggcttacacctgtaatcccagcgctttaggaggccaaggtgggtggatcacttgacttcagaagttcaagaccaggccagccaacatcccgtctctactaaaaaaatacaaaaattggccaggtgcagtggtgcacacctgtaatcccagctactcggaggctgaggcacaagaatacttggactggggaggtggaggctgcagtgagtggagatcgtgcactgcactccagcctgagcgacagagcaagactctgtctcaaaataaataactgaatgaatgaatgagtagttcttcatagctacaaagtgttttcacatatattccatgtaagccttacaggaaccacaggtaggtggattttttttggttttttttggagatggagtttcactcttgttgcaggctggagtgcaatcacagctcaccacaacctccatctcccaggttcaagtgattctcctgcctcagtctcccaagtagctgggattacaggcgtgtgcaatcatgcccagctaatttttgtatttttagtagagacagggtttctccatgttggtcaggctggtctcgaactccccacctgaagtgatccgcccacctcggcctcccaaagtgctgggattacagctgtgagccaccgcggccagccggtggattttaaaaataacatttccacacaaatacagggcagacccatcatctgcaactataaaaccttttaatcttgtataaattcaagacaagtgtaacagcttggatcacacaccagtagaaattttgggactatattctgctgtctgatttccagtgtcacactcttttccacctcatcattttccctctcagttatactaggaagtcactcaacagaaatgctcacaaattcccagtgccaaaagccgctgaaagccctttattgaggtcaaaaaataatgattgcagttggataatcccatctagttaaaaaaaaaacggctgccaaagatggcttttctttagatagcacttactgtacttagggcatgagggtgagccaggtcccaaggctttctcctccaaagagggttattccttccttaatccatgagattgttcagtatggtagaccagaaagctaaaaggaaatcccagggccaaatcacatgggaatgcatgcaaaaggagcaacagccatggtctttacgctcacatggtggagctctattaagagctacagtttttgaactctgaaaacagggatgactcaacacgatccatgcccttgagtagctagctcagtctagaaggggaaatatgacacagcatttaaagcgtcacgtatcaaagcctacggcctaacactaagatggaaggttattaaagttcaatatgggtaccaaagagagaagagaagggtggttcaagaaaggtaatgttgtgcccagtgtagattgtctaagacacacagccatgcaatggcagatctaggatttgagcccatctgttcatctccacagattgtccactaatggctcttttaactgtactctggataacaaataactgtagtgtttgctaaaatgcagattccagattctcagtaggtcttagatgggcccaggaatctgctatttcaggaagctcccaggtgattctgaaacagatggtttgaggacaacactttaagaaataccagaatagatgatgctcaattttcttgaggttctaagattctaaaattcttctgcttttatagttatctaccctttgctagcattttagctcaatgtgttacgtaaggatgggattcctattttcaaggagttcacttacactcagggaccctaggaacatttaaaggataattttattgtcataatctgcccttaacaaaattaacaaaatgaccctcaaaatttgctgattcagccattcctagcaatgaaaggaggaacctggctacctaccagacttcttatttctggtgtacttggttcttggtgacctctaggcaggcagcaccccagcagggctggactgtgtgtgctccctggaaggctgacatttccggagtgtgaatgctggcagtaagacatcggaagcatcttcctctttgagtgtgccaactcttggccaaagatagctctagaaattgtaagaactttgagagcagattctgtttgtcctatagaaaactcccatcagcatattgcctctacatccagctagaatgtgtcagatttcacatgttcattcatagtctcaaccactcttttttcccccctctctttttatctttttccagttttttgtttgttttatctcttcatcacggtgaatggggttcttacagcttagagttgtcttgtttgtgtgtactcatgctcttgaaggaaggggctacattgtccacagtgcttgggtaaattagatcatattccaccctgggatcacagaacagtttactccttttgactcaggaggaggtcagaatcacttccccacagataaatccatagaaacagaaagtagattgatggttaccaggggctggggagagaagggaatgggacatgactgcttaaagtttatggagttttattttggggtaatgaaatgtcttggaattagataaaagtgatggtggtacaacactatacagtactacatgccactggcgtggggggcaatcactcccccaagacaatgtcacaggcataggaaagcagagttatatatatttctttcctagcatagttatcaaaattttaagagtttttatgggaataagtgcaaagatttctagagttgaaaacagaactagaaagaaaaacattgcctccctcgcacacatacccaccccaaacatataacctctatcagctgcagtcctgtcctcaacatttcaaaatccatctcttcttctttgtctttactgtataggtgttgttcaggactcatcctcccctagactctgtaatccctgcctccaggctcactgcatgctttttgactccgtctccattttagttaccaacatgatttttttttttttttttttttttttttgtctgagacagagtctcgctgtctcgcccaggctggagtgcaatggcaccatcttggctcactgaaacctccgcctcccaggtccaagtgattcttccacctcagcctcccgagtagctgggattataggcacccaccatcatgcccacctaatttttgtacttttgtagagagggggtttcaccatgttggccaggctggtctctaactcctgacctcagatgatccacctgcctcagcctcccaaagtgctgggattttaggcgtgagccactgcacctgacctccaacatgatcttaatgcaggtctttccaacatgttgcttccctgctttcaccttgacaatgattcctagggccaaaagaatgagatctgaacttttaacatgtcccaagacgcttttcaatatctagtcctctcctctccagcctctttgactgctccgccttagatatactgagcttcctgcagctcctggatgtgctgtactccctttctcctgtacctttgcacacactattccctttgcctataacatcctagcattcactgcctggttaactcctccttatccttcaaagctaagatcaaatagacaacctttaggagaagccttctaaggcctgcttcccactccccttcagtctgggttaaatgccacattctctgtgcttcctcaacacccttgcttccctccatcataatccttaatatgctgtattgtggtcatctgtttacctggctgtctaactcattggcctataaactccttgagggtaaaagactgtcttatatatattcatcttcatatttttggagtttaacacatagcaggaatccaataagtatttattgattgcattcattcattttccaaaaaaagagtaatttataaaattcaaagaattggagaaacggaattgaaaacaaatgttctgcgcatcgtaacttagatctcttctctgtgcttagggtatagtttttcttgtttgttggaactgtatttattgtccagtgtgtcctttcacacagcagagatctgtggagtaggattgtgggctggcagtgggtttatcccacagacctaagacagctacttaatttgtatagacccttcccagcctgggcctctgggttttccttctgggtggagatcatcttctgtaggaaatggaactgcttcaagccaagaagcttttacttttactaggtctttttgtgtcctgctgttcaaatattaggaagactgaaccctgtttcggtcttgacagtattacgtttcgtgatcccaaaaaaaagtgtttgtgtaacctcaagtcatgctgaaagtgaaatacagcttaaagtgggattctgctggacctgactcaacttttcacctcaccgcttggctccgtgcaggcagtatttgagtatgtggttccccctcaagtctgtaggagttgtattgtcaataaagtccaaggccagagtgcttgctttctagtaagtagagagaatttttgaaattcaacgacaaacatttattaagcccttattgtgtacagggctcaaagctaagtgctttgggtgattcagggtgattagggataggattccatcttcaagaagcctcccatctaggaagaaaggtcgataagcatagttttggacacacgggagagcatggctttctctgggcccagtaattactttggtatccagatcattagagaacggaatgccttctattgaactatgtaacagtcacaggtttagatcttctcaagttattattgcctttaatcttcatatgattcctatcctgcagttaggaaatggaaaccctaggatatagtgactgtgagctcagaaaattaggttgggagataagccagtagattgaggtggtagattcttcaagatcttgaaggggggaaggtgggggggggggacgggggagctgtccccagctatatttgcccttggcagatgggatggattctgggagaaagctctaagaaattaggcctgtacgacttattttcatgaatctagctgctaagctggaataagtgaagttaaaagtagtgatgggccaggcacggtggctcacacctgtaatcccagttctttggaaggctgaggcaggcggatcatgaggtcaggagttccagaccagcctggtcagcatggtgaaaccccgtctctactaaaaatataaaaattagccaggcatagtggcacgtgcctgtaatcccagctactcaggaggctgaggcgggagaatcccttgaacctgggtggcaggggttgcagtgagctgagatcgtgccactgcactccagcctgggtgacagaatgagactccgtcttaaaaaaaaaaaaagaaagtagtgatggggagggattgatcaaaacctcttcctctgagacaaagtgaaggataaaggggaggataattttgagctacagatgaggacattgttgtctgtacctctcagatgataacatcattttagtacaaaaagaagtaaggccactgggggagataagggaaaatgtggagctggggctggggctgggcctggggcggagaagagttgaaaagtttaattatcttctcattgaactttaatcgagtctgtttccttatactggggacacttgaaaacagtttcccaaaccaactacaaagaattttctggcaggggagcctagagcctactggcaggttgtgcacagatcttttctttcctgatcctcaagtttgactctgactaggagacaaatcttttggtaccatggttttcactgttcaaacctcctgacaaaagaaagggagaaaagacttaactttttcctttgcaaagtggtacatcaatagcactcaaactgtgaatgtattaagatgttacacttctcggctaatatttcattttcttgtagtagcatagaaatagcctagctttttttttttaacaacaaaataatacttattatatgttttggtaggtaatatatgcaatgggtacaaaattcaaaaggtacaacaggttttacagtgaccagtaaatgtctgtttcacctttgccttctagccacccagttcccttctcttgaggtaacgagcatcaccaatttcttgctgtgatttttatagcactttcttgattgccgtgttgctacagaagggacactgtgaaaatgagtttaacaaataattcaagtccctactgtggccaggccctggatcgccagagccttagttttggtaaaatcttattaagaacttcattttcttgcctataatgtggccagagtgaaaccacagtgctgtcattagtagtgagcacattaccatctgcaggacaaagactcatcaattcagaaggctgttgggtgtagaaactttgatagtgttttagtcgctattttgaaatccagccaagtgtttcctattaaattacatgactgatagctgccgcttatggttacttagtaaaaactcctgttgctaaatggctcaaatggatgtctgtgtgtttattttgccatctaatacaaagcataaatttttcttactccagtagctcatcaaacccttgaatctttcatcataagcacattgaggcaggaactatgcctgtgccatcctcacacctttgcaagtggcactcaataaatgtttctcaagtattgttcagactcagtgaggtcacatccccaggaggaaaaaggacgctgggaatgagtgatacgagatttgtcattaaccgttcctccacgtttagttgccaactttctcagcaacgagaacctggtttcttgacccccgtcaaatggttgatatcactaagttttcaggaaaaagtagttaccactgcctgacttcagctcttgctgataggagttcatgttggctgatctttttcggttacaccctggattcctttgtgaggaaagggaaagtagtgtgaattaatgactatcactaattatgacctgcttcctttgttgaggaacttatctttcattgctattcgtttgccttgagaaataaggaagtatgggttgcagatatgggcaatggactgagagtccttagaagtggattctactgaaccagtgttgtgcaacctgggacatgtcactgccttttcccgggtctcagtttccctatctgtacaataaaccttgatgatatgatctctgttgtccttccctattcaaagagttatgatttggggccccttttcctgaagtctgcgctcctctgaccttccttttccctctgtacccagacccccgatgtcagttactgacttcgatctctgatttgtgcttctaggttttcttcgtgtctgacctcttcaagactaagacgacgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgatttttaaaaaggaaaaaaaaaatgttttactatgtggccttccaaaataggtagtgtttgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgactttagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccaggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagtttccctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaagcctggagtgtttgagagatgtttgtctcaggtgtgtgggtaggagaaggaagcatcgcgggctggcctctttgagtgggcttgcctcatctcagcgcaccaactcctgatttttttcagtgggaaatgtggtggtcatagggtagataccgatgtctgccctgctctttcatctctgaaagcctgtttgcagaatgaggccctggctctaccctcatctcaggctcttctaaagagcttttgtattctaaagaggatttttccatcagagaggtaggagctgtaggaaccccgagggcagataagcagccctcactctagataaggtatgctgggggagcttactgagggaatcctgtacacagcccacatcaaaggaaggctgagaatggcctgtggctcctgcttcccttccttgtgtttctccaacctggaagaaaaggggaagctagaaattcacatttattgagcacctgtgtg

SEQ ID NO: 37207 - DNA, 6370 bp, Homo sapiens; identical to SEQ ID NO: 36875

SEQ ID NO: 37208 - DNA, 261543 bp, Homo sapiens
ggaaaggggaacagttaaatttgtaatttgggttgtgtgaaaacttctttgggcctcataaacaaccacagaaccacaagttgggtagcctggcagtgtcagaagtctgaacccagcatagtggtcagcaggcaggacgaatcacactgaatgcaaaccacagggtttcgcagcgtggtgagcatcaccaacccacagccaaggcggcgctggctttttttttttttttaatctttaacaatttgaatatttgtttttacaaaggtgcattttttaatagggcttggggagtcccagaggtatccagcagaggggagaagaaagagagatgtagggctagaggggtgaggctgaaacagtgacctgtcttggttttcgctccgaaggtaaaagaaatcattgagtcccccgccttcagaagagggtgcattttcaggaggaagcgatggcttcagacagcatatttgagtcatttccttcgtacccacagtgcttcatgagaggtgagtacatgctggtcttgtaatatctacttttgctcagctttgcctgtaatgaaatggcagcttgtttcacctcggtgcagagatgcctcggtgcctgccagttccctgtcttgtttgtgagaggaattcaaactgaggcatatgattacaagtctattggattacttactaatcagatggaagctcttcagaaatgttttaataaatacttagttatgctgttggagtgttcagtcggtgcgtgagaactttgtcaagtgcgagtaagttgtgctggtcttgtttaaaggcttagagattatgaagcttgcacgaagctccctgggttttattttgctgtcccttgcccggaatgcctgtgtctgagttatccttaactcggcatgctgtgtggcccagaatgcagcctgccctggggcttagcaggcacatgcacagagccagccaggagggctggtgccagtgtggggcaggaggcggaggctctcagatagccttgcaccagcctggggacttcagggccaaagtggcaaggcagctgtctctataaggcagagagtacaggagactgacagacttggttaggttaaaatcatcagcatggggctgtgctgtgtttttccttgtagcctcaatgcaaagagacaaccagcatctttcaagagagaaaggaagcaaattgtggcataccgaggtctctctggaaaagggcaatagagaagtttcccgagttaagcattctcgcagcttaagtcgttagattacaggcttatgaataggaacagccagggtggaaaacctgtctccatttttgaaaccagcctcttgaaatggacaaagctgtggttgagctgtgagtgtgtgagtatgtgtgtgcatgtgcgtcttgtgtatctttcgtggtaaaagagggctgtgcttaaacaaacaaaaataataacataaaatgtctcaaaggcattgccgtgtgcgtcggggcacgcactctgaccagtgcctgcaaagtgtatcttgatggtttggcaaagctgagatggagtgggctgggatgggagaataattaattttctggctacaaactctcttgagcacccaaattgtatctgtgactcattatttattcatacagctaagtgagcaggggaatgcagagggcttgccggccactttatcacagcaaatgctattgtgaatgcacggggctgtatgtttccgggtccctgaaattaaaaaacttgatgagagagagagagagagagagagagagagagagagagtgtgtgtgtgtgtgtgtgtgtgtgtgtgtgtgtgtgtgtgtgtgtgttggagatggcaagagagaagttaaagagaaagagaagaaaacaagtcattaaccaagctcaagtttcaaattaaagagttttcaagtgcttctttactggcagcagagggaattttagtgaagttgaatcatgcagacgtgcgttagtcactagtcttgcagcgtcgtttggttggtaacacagagacaccggccactggtgaaaagctgcaaacggctccctggctgcatttcctctgggctgctaacaagcagaggaagcaatatttgtatagaataacagaaaaaaaagatcttcctggctttactctgctttcagtaccccctcagaacgtgtattgtttcctattttatcaactcaggaaggcagattcaggaaatttttaagcattccattgagcaataggttgggtttcagtgtgcagtgctggcccctggggctctccttactggccaacggcaaagatggtgagggacacgctgagctatgcagacatcaggaaatagcaggagtctggctatctcccggacaagcccagggctcctgtgcccgatggacactcagctgacctgcgctaggttaggaacaagggtcggttagctttcacggaggcagtgtagggagggcctgagctcgcaccaagactcaaaagggatcatctggaaaggtttttccactccttcctttcagtgaaaggaactcagggttctttagaatctctaatttggtaatataatattgagatttgatgtcagagggccaagtgaaatcttggcaatttcctggttaatttcatccaagtgatccatcaacataaaggtttaaattgtccaggttaactgtccacatcattcacccaagccggagaggtagcaaaatatcatttcttttgataccgtttggtcatcatcttagagcttgatgctagaagaatcaccatccctgccaacaaatggctctcccccagagttctcagcctgttgccatagctgggccactcgcagtggtcaatgcggtcacttctggctgcctataatttacagcgtgtgttccctccccaacggcaactgtgagccgaaagggaagacagcatctttgttttcttcctgggatggtactttatcagtccatgcaattctcacagaaggaaacctgtaactcatttttagccagatacccatgtggaaattggggggaaagagaggagtgaagccaagcaaaccattgttcccttccttgagagaggcaagccggagtctgagagactggcacatgaaattgatgtggtctaccacagagaactcggggctttttctatcacaccacaccaggttcccaccgaatttgcttaggaaggaagacaagatgcgattgaaattccctggaattatcacacacggtgtgcaacgtacaattcttgccgaacccaaacttgggttcccttgaaaagtgcagtgtgtcggcagaaagagttgaggtaggtgtggggaggaaaagcctcggcacgtacatatttttgcaaaatggctcaggtagccttgttcttagaagtggcttagtggtctatgcaaagcctgaacactcacatgcctctgcgttcctagaaccacaggtaaaaatctcagcgagaccgactccctgcttgtcttctcagcggttcaagtttaccccactgaagcagtctttcaaagggaattgccaagtacaaagctgcatgtataaagtatgttcttctctaagcatcggcttgccgctcttttcagaagaatatttattaagacacttcttctggcttgactgaacacttaagatcttaagacttcaggcttaagccacagaaatttattttcacacagttctggagggagactggaggtgtgagatcaaggtgtcggcaaggctgatttctggtgaggcctctctccttggttttgcagacagctcccttctccctgtttcatcacatggttatccctctgtgtgtgtctgtatcctaatctcttcttataaggataccaattgcattgtattggggctagcctaatgacgtcattttaaaaccctatgtccaaatagtgtcaaattatgagcaccttggggttaggacttcaatgtattaattctagggagacatactgcagtccctaacagtgggtcttagcaaatctgacccaccctggcccacaaggaaactgtgggatggggcatcctggctgctctcttggatgttaaagaatcagactgtagttcctcctttgtgagatggagtttcacatctgaaactgcccacacattttgaaactataaaaaaaaaaggtgtgataaaactatctaaactcacaatcatgcctttgccatttagactttttgcacgctaagaaactgtagaaaatgacgagtaattttgaaatgtttaagtgttaaaagagcaaatggcagccgccccaaagaaacctcctcttggctctgctttcttggggaggattgtctttgtacttcagactgactttattagtggggtttagggggctgtaggaggccccacagctgctcacacaccgagtacaggggcatggagcaaccagtagcagaagcacctttggaaacagcaactgacccgattctgaatggcaagaagcctttctgagcttttgaaagcaaatgagtagctgagacgttcctacattctctcaaaatagatccgaaagatgtgctcagaaaatatgtagccctttactgagaaatcaagcctggtgagatgctgggacagaggacggctgcacagccgctgtgcacacacagactttaataaggagcccaaggcctagagagaagagtctggaggcataagagcacctgctattagagaaagcaatggcaggaggtctgtgcagggaatgtgctcagatgacacagtgatggccttttctttcttttcttttttctggctttcatcaaatagcatatagaacttctctcttgagccttagtttcctcatctgcagagtaaggattgcaatagtacctgttattaaggtagctgtgtggaccgaattaatctgtgtaaggtgctttgcccagccatataaagtaagcaataaatctgaatggtggctatcaatgttcagttatctaagaaggcagccagtcaaccgctgtctgctctagggagggagaggtcacaatgccctggaggacattacaggaggctccctggagagagggacacaggagttgggggaggggaagttgggaacaaaggaaagaaggaagagtggtctaggccgagagtacagcctgggcaaagttagagctgcaggatcccacatgggcatggacagcagtgggtaactcagtccaccctaagggcttttcaccagcaggtcagccttccttcccttgtggaaaaagaacgagagccctttatgaaattcaacttaacaagttttgattttaaatatggaggctagttggggcaggatgtcatgctaagtctttgatctgaacacacaaggacaacagagatgtctcttttcattgagactgctggtgtagctttattttctccaaggctcttcttaaggaaaaggccattttgcctgtatacctttgagcaggttctctgggcctctgagagactcccattttccctgctccttgggaacatttgtaatcatgtactttgtcaaagcccagacatgaaggtagctttgatggcttgtcttgttggaggcagcagaggaggcccacacaggaaactcaagcaaattttcagtttctcaggtaacttcctagtgacctagatgagtcaatagatgtctttgtgtctcatttgagttctgcaaaatgggctaataatattctagacaagcttgcatctaaattaccaagttcctgttggaagtctttacatgcatcagaaagaggtaccataaaacacatcacaaatcttcttagcttaataacacaaagccacttaaaaatattttattttctgtttagaaaatagttctcccatcatttcacaaatgcaagatattttccctcattttcgtaattgctttctccaactcccatttttcaagaaatcttcagaagctacactggtgcctgaacagatattaaaatgttcaaagcacttttcccacaactcttgtttctcggcctcccctgctcctccccatcagatgccaccagtccccttctttagcctttttgctgagcctccagccaaggcaaagaggtatgtctttcttgacctcttccctctcataaaatataataactaggatgtcctggagtggtaaaaagggagcatttcctttgagatctttgctgaccgtgaacacaatcagggagtactttacgagaacacaggctggctcttgaacacaaaacagggctcaaaacctcctgtcaccttcaacatgctgggaggataagctcagacacactgctctcacttgcgcaggcttcactctttgttggggagacacgtgttatactctcttggctctctgaatctctctctttctctccctccctcatcttgcaataacactgagtaatgatgccagaaaggagccaaggtggaggaataaacactaaatccgaaacatgacggaaattatgtattttattgcagtgacagaaagagtaaggcccttgctcaggtttacccatgaaaattatgtttggctgcacgtagagaaaagctgaccacagtggcttgagcagacgggcaggagttccagagtgagcagtccaggctgatacggtggggtgcaggacactcctatgttttggtcccaccatgctgaggccagggagagatggcctgcacctctgatctgtccaggcagaaaggacatgggaggcctcaaccccttcttgtgggtcctggtatttttattcaggaagggaagcccttctctgcaaactttcgctgacatattgcttaggccacaactaggtcacaggcctctggctggagggaactgaggacaatggagttgtcactttccagcctggagagtggagggaagcagagaggaaggtagctgggagcagatgtctcgtgaacccagagccacatctgccagacctggtgacaaagacaggctgtgtgccttcccagtcatatcttgtatcatttgttttctgtgccagctgggctttggaaacaaatgcagagaaactttatgttcttccttcattccctcttggaagttgcagatggatgccaagggtgaatatttattgttgacccattgaaagcaaactggacaggagaagggatgaggtgggggaaggggctaggttaaatggatccaagttcacacctattttcagtgtcaaagccccaaatcacacttgagcgtctcctcaagttagaatgagcaatagaaaaccagacagccctgtatctatgggaatgttgcttgcatcagagccaccacaccttgctgtgaggttgatcggtttctcgcagctggaaatagttgcttcccgccccccatcttcctcactcttttaaactctcaaaaatcccccagcctcccaaatttgttttaatttttaagagaattcttttctacaaaagagggaaaccttctttcaaatggcccttcataaatttccctaaagaggtttttatctctgatagaaatatgaaaaacagataaccagataattgccctctatctaggctttaaacacttattcatacattgaatttctgcaagttacagatgattgttgctgtgtgattactggccctgtctatttcctcagcatggatgcaaatctttctccctgagaaagtcattgcttcgttaaaaaaaaaaaaaaaaagaaagaaagaaaaagaagaaagaaaggatgaatgaaaagaaagttgttattcagtttttctcttgaaattagaaatttctttttgttttgctttcattttgtttttctgcaagatcggtgttcatttagagaattgttgattttgtatgcagcactgccctcccatgccatggtccatatgtgtccattttttgatggacttctttttaaacaatgagttccccaagacatttttggggcctcaaatgggaaaggtcatcacaaatagaaatctcagtttgctagttgggcttgctcaatcgctctgctgatctcaggactgatgctgctttgcataaatgcgaagttcatgttaaattgattctaaatcaaatactcaacgtattcagtcttgaaacatgtccattgggagagagaactatgcagctccaacattttgcaaagattctactttgctttctttgccaacatccaacttttacttctgggcgttagaataccctccgtagagactgtgacttctcaaaagaaactttgctagtctcgaatggagaatgaaataataagatttgagcaataaatcaaatatagcctgagagcaacaccacagagcagcctctgtcatctcctctccttgggaggtacgtgggtcttgatcagctctcatgtgcttctgaaaatgtgtaggttttcatatatatgtttttcattgttagtagatcctaaagaaagacccagaaaatcttgcagcagtcagcttgccagatgggggttatgttaaaaagagcaaacagaagtcagagctctgaacacaccgcagggtattccatagtcacattccattgtgggtgagtttttgttgttggtttttttttttttttttttttttggatggagtctactagctctgtcaccaggctggagtgcagtggccccatctcagctcactgcaatctccgcctcccacgttcagccattctcctgcctcagcctcctgagtagctgggattacaggtgtgtgccaccacgcccggctaatttttgtatttttagtagagacaggttttcaccatgttggccaggatggtttcgatctcccgacctcgtgatctgcccgcctcagcctcccaaaatgctgggattacaggtatgagccactgcacccggcccatcctaggtgagttttttaagggagacaaaaaatgtcagagtggcactcattgctcaagagagaagcacttccccttttactgtgcaaaattttataatatgtatagctatcaatgtttgtttcttattactgccccagaatgtgcaaaagagagtttaggtcaactaagatacattggtttgagtgccatttttttcaggagcagttttaacaccaaccacagtttgctgcactttcttacacagcttctgtttgcactttgaactctgtgcactgagcccctcattccacaccatctgcaggctgcatctgggcagcttcatccagctcggtaacagtcacagctgaacttgacattcacccactttgaaagtatagaattcataaaatctgaaaccacatatgtgtataaaacccatgcaagagtgggtaggaactaaaaggaggagaaaaagtagtcctccccttcaggagtgttctctcttatcccagcccctttcatgtaatgaatgggtgaatgggtgaaaatgaaattatttaggcattgactgacaggtaggaacagaaactcaggcttctagtttattattatttattattattgaatctactgtttctaaagatgagaatggcttttacttccaaagttctagaggagaggaacaacgttaagcaaccttaaacaaatattagcactgtgaaaggtgcagggtcatataaagaagtagaagtgccgacaatgaaaattctatccaactgtcaatcattccatatcattacttcatttttttaaataaaggctgtgtctcccatatgcttccctccaggttgtattcaaaacaaagaaataattgtattacagatgtgaataaatctgtttaaaaaataagtgaaccctgagacatatgaactatgagacattgttctatatgatgctttgtaagttttatgtgctgtgtcatagagttatatagagttatgtatatatatagttctgtatagtttcagttggcatctaaaaattatataactttattttttaaaatctataattataaatatttttaaactgctagaaaggaagagccgaatatttggctggagtgatttttagacatttctctaccttagggcaccagagaggttcacttgcccagggttccatagctggttggtgccagagtccgaacgagaaaccaggtcttctcagctcctgtcacccacagttttgcagacactgaatttatgaggtggattccattcaagcatgcacataactagcagacacttctcctaatcctcctcaattcccctttgcattgctcagataccacaatcctttgcaggttaaatcccttcaccttgtgaactcattaggcagggcaatgtatatgaatccctgagtccttaagaacgtccttaggctgtgttagaaatgcagttgccataggagtaaccggcccctgctgtcatttggatgttctctcttccccaaaatccagcaccaccttggttaagcacccaccatgtgcctgcccacctggctccttaggcaatgttacaattaaccaggttggttttgatgagggtctagggcaaaatttgaaccaccacaacagccaatgtgcacatccatgcagagggttcagagatggcctcggccaaggctgccaggcttcagctctggaaggagccctgggaagtgggagatctttgtataaaaattggaacccaaactataattcccattagggatatatatgctcacatcactcctgattcaaagctcagaagtggcctctcaggagaaataaaggtctctctctctctctctctctatctcacacacacacacacacacacacacacacacacagagagagagagagagagagagagagagagagagagagagaggccagcattcaaaattcccatgcttagggaatccattgggacttctccccaggatgtactgaattcaaggaagctttctctaggtgtagcagaaactgctgctgtcatgtctctgctcaccaggacgtagcttctctctacagacctttatttctttccctggaggcttcagtccatgttgaagtgtaaactccactcagctccaggaggaatcgtgttttctttatcaccaggggcttcttctacgagttgcctttgatagggaggccaggaggaagataggcccaagctcaggggtgggatcggggagcaggaagcctgtgggctttagaatcgaggtattggtttctccctgtcaccatcatccaccacctgtgtgaacttgagccatttatcgaacctcacggagccccaagtttctcatctgtaaacaaggggaatgagccctactttgtatggttgtcaagaggatttgagacaatatgtataaagcaatggacacgcagaggaagtcaataagtacaaggtaactctgaaaatgccaccaaagggaggctagggacaggaaagccatctccgccaacctcaagaacgtggccccgaagctgttccaggaactgggcatgtatgaagataaaaaaaaaaaaagaaatgtctgcctctctcatcatgtagcagtgcagaagtgatcttggtgctctttggcagaaggctgagtttatgaactttaaaaccgatagtaataacagctagcatttattgagcatatgctatgcgcaaggcacttgcaccgttccaagcattttcttgccttactgtattaaaattttggcacaaccctgtgagtaggtgctctcattattaatcccactgagtgaaggggaagcatggcctgccaaggttacgtgacctgcttgtggttaggctgctgggaaaggtggaggtgcggtccaaacagaggcagttcctgcagcagagcccactgtctgtctgcccgtggaggggacaggtcggtgttgagaatatctgtttggcacatgagggagtttagccttacagagcgaaaggcttgccaaggccccatggacaggaggcgacgctgtggggtggcaccaagctggggcactggccaccatcctggactgcttttctgactctggatgcatttggtggctttatggccccaccactggtatccagacctctcctgcccacgtgtttctcccatcagaactgagagagatgttcaggcagttcccagacagcccacaagaaacacgcctttaagccaggggtgctcaaacttgttcccaagacgatggtgacatgctggggtggggagaaaccactgctatgccttcttcctgaccgaccagttgttttcatttatcaatctgagaatccatcgaaggtgatatcagggtgacataaatgaggcacttcctgtgacaaacttaaggcgacacttgctcccattgttgtacaaggctgaccttgcatttacatgggcttgagagcgcaccaccttgaattttgtgtcccaggtatatctcttgccctgtcccagtccaggccatggaacacatgtacagaagaaaccacagagtgatgtacccagcaatcaggggcctgccacctgagtccctccttcaggggtggaccaccccaaccctgactgaccctagccagggttttccgtgaagcttgccccaaacacttctcatccacttattcctgaggctaaaataaaaatcgtagccagaagcagttgtttcagctgtgatagcaagcagtggcctcagtcactcatgtaaacaggacctcataccactaagtgtcagtggcataacaagagttgagatgcacacgcctactggttggcctttgagaatggcctttctgcagaggcatttgtcatttcacaaagtccatgtcaccagtcctctgacatcatgataattccttttgtcaagaagttggggtttttttccccttcttttcccccttcacctttattgtataaaaggcatttctcctctggttattctacaacagactacttcagagtcacagaaagttccttccctttctggaggggttcggcatgctgaaggatgcaatcataaatgactttctccccgcaaagcctgctcacagccagccatgtgagtgccctgatcaatggaaatgcagggggctggccagcctctcacggctgctctgcaaacatcttaatgggacaaattaaaagatgtgcaagctaattattctccacaataaacaataataatataataaaatcataaagctccttaggaaaggaacctgcttttcttatacagaatgtacaattaacaggaaagtaaaaatttcatgctataaactagagattatattctgggcatccttgtgatttgctgtgcttcttccggcttatttagcactttctgcacacacgccagggctcggtggcccacctgctccctgctccctcttctgtcttccctcagggataatggcctccactgtcaccttcagacccaacttgggttcttcctgaggagtcctggcccccagacccacagcagcctctggggaggcccagagttccaacccttaaccctctcagtttaggatcaaacacatcatttacatggaagcagttggagttgttttaaacagccacatcacatctctctattcctcttttcaatcacaaccacgtgacctgaaggagcagaaagcagagagagacctgcagtgagcctggacagcccccacctgtgccccacatgggttctgaatctggagtccgcgtcaaacgagagggagagggaggaacccttagtgctgtcccgtgtcctccgcactgttgtcgtgaacaattctggctgacccactaaagttatgagatgatgccgtttcattgtggcttatgaataatgagaacaaataacattcacttgcaatggtgtgaggcacactgcctccattgtctcttttaatcaaaacctcacgatataggcacagctactaattcccactggctaaaaataaaaaataaaatgaagcaaaaaccaggttacaaaagcagcccaggccacacggcttctaggaggcagaactcggttggagtccagattctcttcggctttcccactcccatctggcctctctgtgatgtgacagggtgtggggaggagagttttacaggtgcagcctgtggggtctgagagcctgtgttcaaatgccagctctgtcctttcccgctgagtcaccttgaacaggctactcaccctttctgtttctcccttttcctcatctgtacagtgtgacgatgatgattacccatgcagctgttgcgagcactgaatcagaaatacatagaatatgctgcccgatacatggtcgctatcatcatggacttttcctttccaccctgatttgattttaaattggacactatttgactggactttcccattttcttccttacacactacccaaaccaaatctaacaagtgaaccccaagtgggttatcccagtgagtgcgcgtggtcactaatgcatccttgtacactggatctgttcactcctggcagcaaacggctgatgcttgggatgaggtggggagtataacaggaacagactcaggctgagtaggggtctcagccctggctgatgtgccattgtaccctgatcttcctcctgtacatctctcgggtaaaatgagagagctagtggctgggattactcagctcccatggtcaaggtgaaaggcatcatggaggctgaggatctgccctctgctcacaccagacagggtttcccgacctcgccacagttgacatttgcaaccgaatcattctctgttgaggggactgccctctgtgctgtatgtaggctgctaagcagcatccctggcccacacccactagacactagtgacaacccttccctcctcatgttgccacaaccaaatgtatctccagacattgccagatgacccctgaggggtaaaatctggaatgttttttggagaaccacagctccagaaagaccttaggaaccgaggtactgttgctgcttcccacaaagaaataaaatgatgtggcgggtttgaccctctttagcatgtttgcctcccacacacctaatttgacctctaccccaccccagcctactaatgctggctacagatgtccacaaaaactgacagtcagtgtgcaagggcatgaaattaagaccatcagccatgtccccgacgtgaagagcagagaagaaaaggcagccatgactctggcctgctggcgcaacaaaggcttgccatctctgttatctacacagtggagacaattactctccctaattttacagattgatgactgggctatagagtggccaaatatttcatccaaggtcacacagctgggaaatggcagggctgcactcaatcctagtctggttttgaagtctgggtgcctgacgaataagctgtgcatttttcaagagaaggccttctagagagggtgtgactttggtactcttgtcctgtgaaataaacttaaaataagttatcttcgtgtctagttatagatgacataggaagtaggataatgatttggtaatcaaagagcccttaactcttttaaaattattggaagtaataataatgctgtaattctgagtcctcccagtgcctgattttgaataactcattttccttctcttttcctagtggggatcatcagtatttctttgaagactttaaaaatctaggaggaaagtaacctaaaagacaagataatgatagatttcaaggacctatagataatacatttagtcaaaagtttcagaaatcccaatgcatatttagtttcatttttctatgtgttattttcaaatcctctctgggaggtcacttctccatgcttatttgaacaacttgaatttctcccgaaatttctggtagtagtcattaaaggcacctgacagggctgttgttcagcaagagaagtcattgcacaggttatgagagttgggacatgtgtctgcatgaggtgttagagggacagagaacaggaatcccacatccccatcacagacatggatggacacactccatctgcgtttgctccctgaagcagtaatacttccaggctgacactctgatgaccatgtcttctaggatgctcattggtagctcgtgcaaaggatcacattcttcttcttgctctggtttatttgctcttaccaaaacataattccagcttttctgtttatgagtgtgttctttcagagactctgagcaatttgagagatggctcatatgtcacttacctctccaaaaacagaaactggcagaatttgggcactcaagaaatgttggatggatagatgaataggcaaatgcatggatggacagatagttgaatgaatgaatgaatgagccagcagatggacagatggacaaattgatggatagatagaaggatgaatggaaatgaatggatggataggcaggtagatggatagatagttgaatgaatggatagatggatggatgaatgatagagggatggatggatagatggatggatagacagatagatggaccaatggatggagggagcttcaccagtcctgtgcttatggcttaagtgtaaaaacatcagtggatgtaagcagaagaggccacactgatctcctctcacatacaaccacagcaggaagtaagtaactgggatttccacccaaacttggttccccttaattcctgtgatcagctaagggtaagaagctgtatgtgggaatattagagcagagaggagcaggcaacatggaggtggttccaattctgtccagaggtgccaggctggaagtcatgtaggtgtcccttgtgggaagctggacaagtgtgcaaggagaagcatgtgagaaacaccacagtcaagggacatcttactgcccatgagctgattggctcaggctttaaattgaatacctgtgtagaaaacaaatgtctatgaccaagaggattcatagtcacgggactgatcataaagtctggtccgtttcccattgggttatttacaggacatcaatcaaagaacagaaaggatgccctcttttccactttatcagcttaaatagactttcttaatggaaaaactcaactcttatttttcctcttcaaaaaaggtaactagtgggataacagaagaggtttgctaaataacttagagtagattccattcagttctaagtccacctatttcagcgacacttcaggaaggtcagtaagggcaaggattgtcccacttatccagcccattattctcagtactctttctccatatctttctatttaggggaaaatctccttcagtgaaatgttgagaggtgatatgacatatgtgtgttccttttccatttcaaggcttgtggcatgtgtcaaacaatctgtaggagctggtgctcctgatcacccctgatcattccccaaaagcccctctgtacccaaatgcttctcagccaggcttggcctgcagtcacttagaagcacccatctgtgcccatagccacatccacatctaagacagattccatctgtgttgaggttcattctttgttccattcaggaatgttccttagtggatcctccaccaaaataaataacttctttttaaaaaatatttccatagacagataacaatggtaggtacctttaatgtacagtctttttagatttaactttttaggattccacatatacataagatgatgcagtgtttgttcttctatgcctgccttattttatttagtgtaatgtactccaagttcatccatgttgctgcaaatgacagggtttctatcttttttaaggcttaatagtactccattgtgtatatattcatcacagtttctttattcattcatctgtcgatggacacttaggctgattctttatcttggttattatgaatagtaccactatgaacatgacagtgcagatatctcttcgacatactgacttcatttcctttggatatataccaaaaaatcaagaaataagatttctggatcatagggtagtctatttttaattttggggggaacctccatacagttttccataatggcttcccaccaagagtgtgcaagagctccctttctccacaacctcaccaatacttgttatctcttgatttttctatttttttgagacggagtttcgttcttgttgcccaggctggagtgcagtggcacgatctcggctcaccgcaacgtctgcctcttaggttcaagcaattctcttgcctcagcctcccgagtagctgggattacaggtgtgcgccaccatgcccagctaattttgtatttttagtagagacagggtctctccatgttggtcaggctggtctcgaactcctgacctcaggtgatctgcctgccatggccacccaaagtgctgggattacaggcgtgagccaccgcacccggccatctcttaactttttgataaaagctttcctaccaggtgtgaggtgatagctcactgtggttttaatttgcatgatgaggagtgatgttgagtattttttatacttactggacatgtgtgtacctttttctgagaaatgtttttttcaggtcctttgcccagtttttaaatcacattatttatttccttgctattgagttgtttgagttctttatgtagtttggaaattaataccttatcaaatgctatgatttgccagtattctttccctttctgtaggttttgtctttattctgttgaatgtttccttttctgtgcaaaagctttttattttgaagccatcctagttgtctactgttgcttttgttgcgtatgctttgagatcatattcaaaaaaatctttgcccagaccaatggcaagaagcctctcccctgtgttttcttccagtagttttatagtttcaggttttaggtttaagtctttaatccattttgagccgatctaatgccctcttatctttgcaatttttatacttttctttaacattttatctcctggtttcatttcccatgggtctatttagtcaatctcctttttcatttatttagaccatatttattgatcttgccagtttagtttttcctcattacttttctcttcttctccatgcttgtcaccttaaaatatcttacaccagtggtttttttattttttatttttttttgagacagagtctcactctgtcactcaggctggagtgcagtggcacgatctcgactcactgcaagctctgcctcccaggttcacgccatcctcctgcctcagcctcctgagtggctgggattacaggtgcacaccgccatgcccggctaattttttgtatttttagtagagacatggtttcaccgtgttagccaggatagtctcgatctcctaacctcgtgatccacccgccttggcctcccaaagtgcttggattacaggcgtgagccaccgcacccggcctcaccagtggtttttacctggaagaaggaggcagtgtgaggaggaagggggtcatttggcactgtctggagacatttctagttgtcacaactcaagggatagaggggactgtactaacatccagtaggcagatgccaaagatgctaccaaacagcccacaatgcgcagaacagaaatgtgatcgtgacaaggttgacaaatccaacctcgtactattaccaggatcgtggttgtaggacttgccagagtcctagaagcagagttgggggcaccactgaagtggtgaggagggtgccaggtgaccaatagaaccatgccagaagcccaagacggaagaaattcctacagaggtcaaaagatccccttaagagagaagctaagcactaggaccagcaagctggaccaggaagagcagtaggcctgtgattgggatggtagtgaaggtgcctgaggcaaggaatggctaggaacactaggaagcatttctccagaaagatacctcgccaagggctggggccctgtaggttgccagcaccaaccgtgttccaggctctctcaggtggtctccataactaccccactcacctgcccaatgccttagaagccaacattgttatgctggctctgttaatgaaaacactgaggctcagagtttagataacaaaaattttgaagctcagaaaggctaaagaagaaaaccaaggtgacacggccaatgatgctagctgtgttaggatcagaactgaggtgtattggctgctttccactaaaccatgttaagctaacttactagtatactactgttctttcagtctgcttcattatatgtaatacacttgaaatttcctttaacttgagcttggagttgggcatttgagttgacaacccatcaggcagaaaggaagaagggaagccagccagagtggaagagatggtggagcagagatggtggagagaggccaccaagagctccatcactaggcagtgagtgtgaagggcaagcatccatcgtttggctcataggtttggtgaccttgatttcaagtggaaaattaactatattaaacaaaaaggaacccctctccaattcacactgcagacagatgagctaggggtctacactccctttttcccacttcctctgtgtctttgatgactgtataaccagattctcatgacactctcaccactaccccatttctcttcccagcttcttctgatcctagacccatagagagtgtccctgcttaataacactctgtaaaacatgttggtgatagataagccatcggtaaatttactgaatgatccatgtggacatgacactgcgttagaaagtagtcttgaacataaagattatatagcatgaaatggcttcagagaacttactgtctggtcagggaggcaaagcctaagcatgagaaatattcagtcaacaaaatgagaatcgagtggcctatcattaataccacagcagtggcagaccaggaaagtaactgcttgctgagtgggaagccatgatctgaagagagttcggagaggaagatggaagtcattttattccagggctggggaaagacagaggagaagaaatgaatgaggcagccaggtggctccaggagtgctcagagggcagtgaggaagtcactgaggctcgcctgtgaacagcaaaattgaagccaggtctttgaatgctgcagtgagaaggttgaacttaaacctgcagaccagggactcctaaacttggcagtacataagaatcctcaaagcgtttgttaaaatgcaggttcccggcacccaccctgagaaaccatgatgagtgaggcagagaggcccaagaatctgcatcttaatagccctgtagtcccagccatactttaagaacctttctgtaacaggaagtctttgactggttttgatgaagtctaaatgaaatcttcaggaaacttcaggcctaagcaaaactgagcagaacctatttttacagctgacaactggcactgcctctggagggacctctatgttctagctgctgtctggagattttattcatataccatggatttcttagtctagtctctcagttctcagatactactactaattaaacatgactcagaaacatgcatttttaaatgtaggccacaagatcctaaagccagtctgagataacattggatctagaatattcaaatatgggctccaaattctgtaccattacacaaaaccattcaacttctgaaaaatgtggacacgtgtgagttctacctgcaagatgcaaatgtttcattgataggaaagaacctgtggttgggctggggtttgtgtgtgtgtgtttatatttatttgccacatcccacccttcctcccccatctcttggctcagaacctaacttcaactctcccgaatccccaaggccactcccaactaggattttttaaataccttaaccatttcaaactttccttccctttggaacctaaaggaatttcattttccattttccattagcaaggtggctccagttaaaccagggcctcaggaataaatacagcttggtttaaatatttgcacatctattaggttttactctaaagcagactgtcccgacgacgccttgctattcacagtgtggtctttggactggcagcatcactaccacctgggaacttgttagaagtgcagaatctgaggcctcagcccagacctgctgaatcatcgtccccatttgctcaagagccccgtgattggcctgattttcatgcacataaaagtttaaggagccctgcctaaatctcccgcctccaagctgtccccgaaatgttggcctctctgcctctggacgcttgcagagatggggtagtggaatcagtttcatgtgggggtagggtgcgggcttcaccccctcccttcgccccctgcccctccaccctgcccttcttgatgctctcccagcggctgcacctgcagagttttcacttctctgggaagcctcttgacacagaccccgtccttgcctctagggtggggccgctctacttcttttctttcaaagagcctgggatgctgacagcctcagatggaggcatcctgtttgtcgaaaaataaaccggcagttaaagcagggttgcgagagcgagaaaaccacaggcctgcgcgccgctgataacgcgcgggcaggcagcttttgcagaagttccgtcgctgcggcgcgctgcgcaccagagctgcgccaccgcctcccttcctgtctgggccgctcgcgtccccgccgtttctggctgttgctttctgcgtcgctctttcagttacttcgcccattgctttttctaaaggatccccttgctgctccgccatgagggatggatccaccaacaagtccccgggcggatgcgcgcagatcctggacccataggaggccaaaatttacgagctgtcatgaaaatgacaccgtttaagagaagctgaagttgctttctcttctgcagtatgtaatgctttgacctggttaaaataaataaataaataacaatttaaaaagaaagaaagaaatacagaaagactacatcctcatgaggcctgtaatgccaaaatgaaaagggaccccaaagtgcaatatccagattgcttttcttcttggagagagttgacctggcctgattctatgcggtgaataactaattatcaatcttccccttttgaggggtattaaagcctctttccccatttgcctgttatcagataagctaggcagatgagaagtcagtgggtaaccacaggtataaccacgatattcactggaaaccaaaagatttgaccccccgaggtaaagaatgtacttgaaaataaacctgaaaatagttttacaggagctgaaaaactcagtgttcccgaatcagtaatacgaacttctctgagcattaaaaagtacaagcactcctaaaaaggacatcttgagtcacagaagatgatgcctgttggggttgattgagtccctttggaagagacccctgtgccacggtgcaccagaaagtctccatcattgttggggcctctgcagttgttccagctacccagtgcttttttattattcttcttgtccgaaaacatagagtagaaacagtccatactcattccttaatcttcctgtgttcataacgagcaagcaccctagatgagtaagaatctaccttatttttaagaattagcagagaaccatatgagtttcccttttcctcccctagaaacgtcctcaggttggctaactttcctattgagcaattcctcacagcaatcactccgcacacctctcatctgagaggctgtcttcccattcctatgagcttttcttcctctgtctcatggcctcactcctaattattcatgttctcctgctgaaggccccttgacctaaatatagagacccgtatattttggctactcatgtatagaccctaataatgaataactcaactttatggtgacataaaggaggaaaactcaggccaaagaatgtttaattcttagggaagaaggagagagctggccagggatagcgtgtgctgggtgttaatagccacgtgcatagcctgttggggaacttggctctctcttgaatctggtgcagggcatcggaacgtctgggggaggagcagataggatgctgctcaggttgaacagggctggaccatgagagctttgaatgcactcaagaaggaactttcttcagtgggccggggccaggccagattgatgaatgatcgattcctattatttaccttgaggtcctcatggagatattttaaatggacttctttctcatttataaactgtcataaacaaatgactaaaagatgtctaagtggtgactagaaaataataaacctcattttagccatatatttcagaatttacacatctgttattgtagtgtccttcaaagtcatcccctgggagggagagggagcaccattctaacagcaccattattactttaaacatcttcggatctgcttttttgaaatgactttcagagttagtttattggctaaacaagtaaatcctccttacttttaaatcacacctcatttttgaacaagacaggtattgtcaagcttccttggtcaccttatttgtcaccagtcttgatcttaaatgccttctggctgtttctaaaaatcagacccatcacttatattccagacattgaggctattctaaagcatatgcaccattgtatgaattctaactggatgctgagaatttcatcatcactagaaaagaatgtcaagttgcaaagtgactaggatggaagaggcagtattagctacaacatcttaggtgtatgtttaaaaagtaatctccaaattagtcacacctagttaaaaagaaaataaaagcctggtgctgtcatactgtagtactttcagggcaggaacctaactatataactgatcctcactttctgagaagttaaaaggatgggatgcagaaagtgagttaaaagtcagttctaagtcttttgaagaatgcccagaggtctacttttaccacagacatgctctgattactaatagcacacacataaagacattgtgttgtattagggtattggttaggttgctatgagagagagattccaaattatcagggcttaaacaagatagaagtgtgtttctctctcttgtagaagtctcagtagattggcatggcatcttcacaatcacaaagaaccaggtttctgctaccctgatgggctgccttctgcaatgcctggcatttacctcatggctcaaaatgggtgctccagcccccaacatcacatccacattccagccagcagcaagagagaatatggaaggggaagatctactctttcccttgaagagcaggatctgaaatttgcccagacactcctgctgacaaatcattgaccagaacgtaaacaaacatatggaggcacctagctgtaaagtaggctgggaaatacagtcttttgctgtgcagatatgtgccaggctaaatatttatttgtttattgatttgtatttatttaatatgttgatatatatttataattagtatatagtatatatgtaaactatataaatatagtaaaatatataataatttaatacacacatatataataaaatatatttcacctaatatttaatttatgtgtttattatttttacaaaagaagtctgtgacaccataaaactggtacccacagatgctctccttattctcacttccacccatcctcaattgtgtacccacttgtgagccgtcactcctgtaaatcaggcaatgttgactggattcctgtgcccccctttcatttcccaccctcaggctccagtcctgtctttatccagatgcattcacagctggagactagccaggagagaaagcaaaccattggcctcaatgaggcagggctggagaccaaagtgcagggaagccctactctgccctgctagccccgcaggtcaacttgaaccacctgagtgcctctggcctcccggctagggaggagacagtcatccacagtccagccccctgccatgagctgcagcctcagtctgatccacccacccacctgggacagggagagagtgacagaggagaagggaaatgcttgcaggtgaaaatctgcctgcttttcctacagcaatgacatatgggcttcgagtagtttctgtttgcatcatctcacaagacttgattgttaattttccggagttttgcaggctggcagttaaacaaagacatcatgcaaaattaaattatgcaaacttaagagttaaacaaaggccaggtgtggtggctcacacctgtaatcccagcactttgggaggccaaggtgggctggtcacttgagcccaggagtttgagaccagactgggcaacatggcaaaaccctgtctctacaaaaaagtacaaaaattttccaggaatggtggcatacacctgtagtcctagctactgaagaggctgaggctgaaagatcactggccctggagactgaggctgcagtgagccgtaatcatgctactgtactccaacctgggcaacagagcaagaccttgtctcaaaaaaaaaaaggtcaaaatcactaaaaaataatctccgccttattattattattattattattattcaaacagagtatcattcatgttgcccagactggagtgcactggcgcgatctcggctcactgcaacctccacctcctgggttcaagcaattctcctgcctcagcttcctgagtagccgggattacgggcacccgccaccacaccccactagcttttgtacttttagtagagatgggatctcaccatgttggctgggctggtctcgaattcctgacctcagatgatccgcccgcctcagcctcccaaagtgctgggattacaggcctgagctacagcgcccagcctctgccttattattttattgcagtttacaaagatctatatgcacttgtttcttatctctaaatggtggaaatgctctaacatagagtgttgctgtgagaggaactatagtgatcagcagtgattgctgaaatctgcacatgttataagtcaaagctgtttatcctgaagagctggttgttaaatgttccccagctcctgctggtttagggataggagattactgataccagacacccttcaggcactcctgcggggcgcaggctagaaaaccagcggactccatcaagagtaagaccgagaaggaacctctctttaccacccagcctatctctcaacatgcccttgcctgcacacacctggtgcagacgcttccaccctctttcgtctgttcaaaggtaagccacattcctttgcccggtgctgctggtaaaccacggaaccgccaatcagctccttcaagactattgtctacacccgctctcagctacatgttagcccgtgttcagtctggaggggacaatgatccccagcaaactgcttctgaagctggagttgactgtttcacaatataaacacatgtatttcacattgatatgtgtcttggggatcattctcgcctgctcctggagttcttgccagcctcttaaatgggaactcctacccttttggaagcattgagagaagagctctgagcttctatctgcctctgccttcttccgccttatgagaggagaggcacatccaatgggagagattgagagaggccttctggggacagcctgcctgatatggtgcattctcctctgcctctgtctccctggatgaggcctgaggcagggcccgctcccaccccagctatgtcctgatctcagggctcagcagagatgaggtcagcgcaggcccctgtggctggctgggtaggtccctgcaggtacttctcatgctctggaagaaaccccagatgggctctttctccaactcaactctacaagcaaaatgctggtatttacttcttcatttgatttcaggggtttatttctcagttgcttcagagcttgacatggggaagatagtaatgtttagctcagtgtatttatatattatgtgtatgtgcacacgcatagtgctcatagtgtatttaagtgactatgtttggagcttctatcattattgcttattccacaaatagcacacagaaacattttccctgatagagaaaaaaatcagcacctagaaagttaagaccatttatttagttagttcataaacacttagacagtgctcgctcgctatgtgccaggaattgttctaggtgctttgcagataataactcatgtaatcctcagaacaatctttacatagtagatacagctattcaccccattttgcggatgggaaactgagaaacagattggtgtgcagggttacagggcctgactcagactgactcagactttctggctccatggttcaattttactttgccagtcatggggaatgagcatactccaaaacctagggacagagtatccctggtggacactgccaagatggaattttctcttgagaaaagactaaagctaaacatgttattgtctccccaaagtcattacccaagtgcctcagccagccagcctgaaggtaagtggagatgatgggaagccccagattctttgtggggacctcattccccttctcaaagctactgacaaggacttaggtcagaacgttccataagtccccatagaagcaaagtgtacttttaaaggttgtaaatacattttataaatgagacactatttaaaggcattaaacaagcaacagacttcatttatttagttatttgggggttttctaatcaagattctcacttgcacatcagcctagaccacagagaatcagtcctggcttaaatctaaaactgagatggatgatggggcaagaggaggaagtcgatgcagcagccaggtgacgttggcagcttcctcttccccatcctcgaggggacagtgactaagagagtacctggaccaatgtttgtgggtgctcatggaaattcctttgcataagccaaactctttcgggtctcattgccttctactttatcctcccagatctcacctctgcttgctttgccttctcaataaaaagccttaggaacatccccaaaggcctcagacattagaactaattacatctgtcttcaggagccactttctccatgagggtgatcaaacccaaacacagaagcactgtgttttctacccgtgggtcacagcagcccaggattcatctctgctccattaaaagcatgatgctatgatgaaaaatgctcaagggatcattcttttgtttattaccaggtcctctggaaagtaaggtcggggaggaactaatgaaaactttctatagagaaggggaacagttgtgctattttggttaaaaaaaaaatctaattgcaactcttaaagatttagaaaataatactttttcagtttttttattgctatatatacagtattaaatcattttgacttgttttgctgttttccatatttgaaatatctggaattgggaaaccctaagacccaagatgaatcctggtccgcctaagactatgtaaacagcccattatctgcttccccgataccaagtttgtcatgaaattgacagcttcctgataagggctttctatttctataaccaagcagcccttcgctagaatcttctggggtcaggagaaagttgaagccgcgtgcactgatcagtgcacgattttcccagtgagtagctgtgtgcaaagggcaatgctaattgtccccttgttctggcgatggacttggcttcggcaggtttgggtttatgattaactaggcagaaggctgattgtggttgtcgatcccttccctggaaggttgtttgcataggtcttattcagctttctggggggtgtgggtgtgatcctgtgtgaggtgcagaggctcaagggctcaaggaggtttgccacattttcttgctgtgattccagaatgctttgtccgaatatagataatcattgaattattttaattttttcagcattagcattttctatgaggttgttgctaacttgctcagtgcactggcagtattatgccaggcctcttacagacataaaagaaagctatgtatctttgtctcccagcagtttgaggacagaagacatatacctgtggaataggtggggagaatcttaaactgcacaggactaagcagggcatgcagtaataccatagccattcagacgactggaaggctagaaggtgtctcgagccattacagaggactcaggtcaacttaggattttgctgttaaaggagaacagggaaaggtatccaggagaagaaagcagcacctgcaaggcaggaagtgccaggtgtggttgaggacgatgagtggatcacttcaaatgaaggggatgcagtgttagaaggtaatgatgggatggttgaccagttcaggttagcccaggccaatctaagccagatggtaagacttcctcctgaaggcagtagagacctatggagacttttgagctgaaagtgtggtgaaattattccctgtttcccttcaacccccaaagaaaaccaagctgcctttgttcgaacaactaacgttggctgagggtgcttggagagtcagccccaagctaagtcttaggcctccaaaaagattaagataatccctattcctgaggggttcctgatctcatgcaggttcactgcagatcgttgggcaggttggacactgtacaaaggcaccccactgagggggactgtgggaggtgaaatccagccttggctctgcttgccaaatcaagggtcccagggtgaggtgtgactgcgtagaggaaggggcacctttttcaaacaaaaggatcatccactcaccaagctgtgttcctgaggggctgcgtatgtccagagtgccttatttaattcccccaagttaagtgataattcaaacgatatcagatcacactaagaaatcaaattacttgggcctacagaggaaagatttcttatgaaaggtttgtaagatatatgcattcgtccgctcaggctgcaaagtaccaccgactggaggactcaagcaacagaaatttattttctcccaattctggagactggaagtctgggatcaaagtgttggcagggttggttccttctgacagccatgagggaaggatctgttccaggttcaccttttgagatactaggggctgggccttggaaatatgaatttggggccaggcgcagtgacttatgcctataatcccagcactttgggaggccgagacaggcagatcacttgaggtgaggagtttgagaccagtctggccaacatgatgaaaccctaaaaatactaaaaatgcaaaaattatctggacatggtggcatgtgcctgtagtcccagctactccagaggctgaggcaggagaatggcgtgaaccagggaggtggaggttgacgtgagccaagattgcaccagtgcactccagcctgggtaacagagtgagactccatctcaaaaaacaaacaaacaaacaaaaacaggaaatataaattttggggtatgggcacaattcagccagtaacaatatactatactctccatattattcattgatttaatatctggggtgcccttgctggacccaaagctaccagcccttccaattcaagtggacagttccaccgttaaatctttgttctttagctaaagactttacttctttctctggaaggactgctggtcctttgcacccgggtgaatgccctgcagctcctttcctgaagacggctatgataaaagcccactggagaacacagaactatgagaagaaagatggctaacacagactccccagtgctcagtcccccaaaacatagacccagagtgattcatagcagggcaaacttagagttcccacgttccctgctcatttgatagatcagcaccttctggcccacggaggtgaaataacttatccaaagtcacaccagatagcctgaaaagtagacctcaggtgtcctcatttcagtctccttggcccctatcacaactggccccaatactctctcatgttttccagttgcttaggcgtgtgtaaaatgagcctgatccctaaccaaaatgtgacattctgacatctgcaaattgatgatgcaattgtccccccactctcctttcggcaccctttgttcactcggagctcccctagcacaataagctttagattcttcattcctgacaagccacataggttgtgagaattatttaaatataaaaagcacgtgtgctgatctgtcagcataccccaagactttgcatattgaagtctctgatctcaaactctggaaagaaaggctttacccctatcaaaggcatttcttaccctaagaaagtggaggaggtctgggtgcagggaacagaaggtagacaaagactgattccccacttcatacctcctaaatcacaagtgagcccagcttgattctgagggaggccagctccacccactccttcccaccccctcccatttttgcctcttttccatttaaaccctcacccccttcccattactgctctttgggcccttactctgcactttatgagcttctctgcctgccacccacccctaggccttggctactctgtatcagctacacacacacacacacacacacaatgtgcacacactgcaagtcccagagattctacggattctgatacaacaggctcttcagtaggctaatgtagagcctcttggatgggaaggacatgaaacagccctggatggaagggggcctggggcaagtgctaagaggtccccagcattcctgtcttggtccctttatacctggacccttcaggccccagaaatggggtatcaaatgactacactagcccctggaccatgggtcaggacagattaaggctgttctgtcccctcaggcagaagaaggagcaggatgagggaattgaactgtacctattttataatttgcctgagtttaagaaagggagaggatgctgcttcttcctcctccaatatgcagtccctcatcttaggacccagatctccaattacttctgcagctggcgtatggtgggcaaaacaaactccaatgggcctgggctattccataagccttattcccactgtaactttattttaatagaaagctttactcaagccccaaacaactgactcaccagtgctctttaggagagaagctgtctacaagaagctgtgtatgtcctgcaacctttgttctagatcagccacttcaccttgcagtcacaccccacgcgcaagggaagcagagagcactgaagacaatggcatgttgggttgcagagaaacagcagtggaaatatagctaaccatatccaaggcctgtcttaggcaaaactgcaaaacaagcattgtttccattatgcccagcatccccatttggtctctttcccattgatggactcttcagcgttttccaaagctgttattaggtgaccaggctacttgagtagttctgaagcctaaaataacatgtatcaagtatactatcataatgaaatgaaactcacaacaaaggtcacccaatacacatttgataatttctgtaattgctactgggctgcagagtgtggtgcaggacaacttgtacactggagtcataaagactgaggcttaactctctgccctgtcattaactagctcttgaccttgagtgacctgtccacctctctgaatctcagttttgttgtctgtaaaacagggacaacgcttactccatagagttcttgtgaagttagtgggagatgatgcaagtcaagttctcttctagtccagggcctggaacacagtaagcactcaacagatgctcctttgcttcctccttcctatgtgatcactaagtatgcctagtaggccattgactttcgcatgatcaaagcctgagatgagttttctagtacttgttatgagtggctgtgtttgatgttcgcacctcagccaccacctcttccaccactggcatcattgtatctcattattggcgagtaggacgagtttcttttaccataaagcaccttctgtgataaagcagccttcatccttccaaacccattatcccatggtaaacattctcttgtctcctaaatatgctcaagagcttctcataccaaaaacaaggggaagaaagctaacacctaaatatcctgccttggcttcccctagcaacaacaagaagaagaattattaattattatgtggtgtctattctaagcacttcccatatattaccaagtttaaccctcacagcaaccctctgagttaggtaggattatgatccccacgtcacaggtgtggaagttgaaatgcaaagggatttaggaacgtgcccaggatctcacagccaggaaaaggcagagctggtgaatgaacctgggcagtttgacttcagcatctccgcgcttattcactccacgttgctgcctcttctccatcagctgttttctctccctcttctccaaatctgtcaagagttgagtgcactcccttccttgtttcctcagttcctaccaggacagctgtgtgggctgtgcagcatatgctctgctatccagaccttgtgggaaacccagggagggaagaccaggctctgatcagagcatcaccatgtgctgccaagggagacgaacagagaagtcgcaatagtgcagcagtgagtgctgtgatggatgtttacagggagctgagggctccatggcacacaagagtaaacggctgcctcggcagagagggctcagccccgtctgtggctggaaagcagagctctgaggacgccctggcagtgcccatggaggaagctccgatttgctaacatgggttgctgttaccaaaagcacacattgtaaaaactatggggcagtggtttctactggctcccctggcttaacatgttatggttctgggttttcagaaccactgataaggagaaagccatatcatgcttgaccttcccaggaactctttggagataagctgagcccggatgtttatctcctttccgtatatgtggaaactgagactcatgcgttatgaaatgtgcccaaggctagagatgactaagtatcgatcctggactagaaggaaagtcaccagattcctaatcaagtgtgtctatgccactactcctcacctgaacaactatacacctaggcaggatgtttcattgtttaattcagttgctgcaggagattgaaatattagactgattatgtatggcacgcaacatgaaaactggacccttagataccagctgaaattgtccatttccttaaaaaatccaattaattaaagtacagctgattctggttaactaagataactaagatattaatttttaaaattatgtgtacttttgtcttatttcaaaagttcattggagcaaccttaaaacatcagacatgtttaaagaagttaacatgacccataatcctagtaattattccaggtctcctgttatcatttgatgtccttttttccataatgttaaaatgtatttttatttggcatcatactcaaagtgctgctttgtaaactacttttgtctcttttaaaatgttatgaatgaatatattttattcattaaaaattcttctaaaatatcaccttaatttttgcatgaatttctataacacagtagtttacttaaatggccttaaattgttgataatttagattgtttctaatgtttcagtataataatgttgcaatgaacatctctgaacataatctttgggtgcatttctgattactgccttaggataagttcctagaaatagacatctgtttcaaaggctacaaggatttttaagagttttggtacggacacattgccctttctggaaaggctgtgccaacttatattccaccccacagtgcatgacggtggctattttgcctccactcttatcatcactggacattatctccactttgttttattattttttttcattgtaacttctctccaatttggggatgagggtctttaataaactcaactttgcaataaccttcacctctcgtaataacttctcagagttgctgttattctggtagccatttcttcctgtctgcagagctgtgaaaagcaaataatgaataaactcagttgatattcagttataaactagatttatatgtataaaggtgcttatgtgttggtctcatttagattagattttataatatgcaagggccaactgtcaaatgtgttgcctcagactttttttctttgctgcaaggcaagggtgaaaattcaactaaatctatagacccccaatataatgttatttacttacaggtaccaatggcttacaaaaggcaggacatttttaaagaaggtaaatgatgtagatgtgtgtattcatattgggatagtatgtttgtatacatgcgataacatggacgttcacgttgttcagtcatcgcaagaactagtgtttaaatcagggctcagcaaactgaagtccgtgggccaaatctggcctgagcctgattttgtaaataatgccttattggaatacagtcatgcccgttcatttatgtattatcgatggctgctttcttgctgtgacagagttgagtagttttgataaaaaccttatgcacaaagcctaaaatatttattgtctgacattttaccataaaagttttctgacgcctgatttctactctactttagagtatctaaagggttttcaccgagaacactttcctttctctttaccatgctgtgacagcaagtgtaatcattcatctcaatgtatagatgtgtaaatgaatctcttcaaggttaaattattgtccaaagtcatgctcagagattttgtcatatgtccatatagatgtggacatatgtcctatgtcatatgtccatatagatgtcaaacctgtgggtcactaatttttattaatccaagtattttgttcattaagagagagtcgccacctctaaaagtggataccattcaagtcgatcttgccttaatgattcagaaacctgaagcatcttcagaaatatctgagagttatacaaaaatctattaatttatcatggctcagaattatagatgtgagaaatagtctggaatcccctacaaactttgtaaaagtgactttaacaaaagaataatttcccactgtaatttattaatattctacttgtttttctctcataatcctagaaaaggaggtcatgtgggtatttgggcttttggactgctgggcctgataaacaggaaggtcttggaaatttcatcacggacaactaacctgtactcttggagcaaggcatccagacacatacacaaataatagatgcacatgccagccgatttttaaacttgcctattaaatttgaatctcacgttagatatggaggattaagctaacgatcatatttactttagtcaactattttttaaaaaatccccctaattcaaagtttgtttctgaccagctaccttcttaatcctgtagcacctgccagaagacatccaataacccactctttaggtcagagaaaaacatacaaaagagaaagctttggctggaatgactcatgttacaagccagctgctttccagaatccgttaagctttagggtccagatctctttttgtggctttctacagactttatttgaacagagaaattataacaacactgcccacataaaagtcaaggaaagaagctagttggggtagcgagggtgccctaaatcttactatactttaaaacaaaatggtaattagcaagaattcttgtctgtttcatgatgataaatgctcttctgcttccactcgctgttgaagtgatgaaacatggatgggatcaattccacttgacagtcagcagagctcttgtccacaggcagtggccatggagggcgctgaaacccctcctggcatttttttattaatgtagatttattgcttaccctcctcggtttcctatggataatgccaagttgttttaagttcttttctgtttcaacccacggagggatccacctgatccccagacattaacatatgagttgacagcaaagagccatgtctattccagggatggaacctttactttatcccaagtgacaactcttatgaattagtagtggctgtctcactgccccggagctggggcttgagaaggagtctcggtaggaaagttgcctggatcaattgtcatgtgtgtcatgggcttgggatcaggaaaaggcctgagaaggtgaagcatcttcactattcctgaactacttaaccctttccctgtttgtcccaagaatactcaccagcagtgcttgcaggtgcaccatttatccccagttaactttgccatgaaatatctcactttcattgttattcacatcacttttaatggcaaaaaccggaattatttctgcaccaacctactagcaaatcgactctggaaacaaaagatatcattctatttatagcattttgattttggtagtggtatcttcacttacaaaatatagtaattctcagtcactgaaaatgtgaattctagaaaacatagcattcctacctgtgatgttcacatcattctcgaacagttgttggctaaagatgcatttgatgaatccgatttttccagaatagatgattctgatgtttcagatgattctaatgatagttctgtttggaaataactccaaaaacagtttttagattttattttcacattgaaaatcagagagattttcttcagcctcaacgagtgtgtttatgtaaaattacatgagtgctggcagcgagttgcacatttttttctaaatgggaatggcctggggtagtttcctgtgtaggactttgtgaatgagtgtgtgtgtgtgtgtgtgtgtgtgtgcgtgtgtgtgtactcacggtagtgtgactgaccatattttatgtttacctgttgattcatttaacaaactattattaaacatcactctctaccaagtagcatcacagaagctaggaagagagagagaaatgcaacagacagccaggcaaaaacattctcgtcaacaaaggacatgtcttaatgtgaagtgtctggtaagaaggcacagagcacctaattgtcaggtgctttgaacctctgcatatttaaacattaaggcagaagaccagatttttttttaaaaaaaggagtgtaattgatggattaaattcctagcagttgttgttactaccccaaatctatattggatatgtttttaaaaataatgtttttggagcttatggagtaataatgccttgctattggtataaatttagggaggaaaaaaaaacaccttgaaaccaaaatatgcaatatggttttgtatgccttatagccagagatgaaacagaacccaacttaatattgccacacaatattcagctgtcacagacgtcgtgctttctctgaacagttctaacctaggccctcattaccaatatcaactttctatgcagttctgtgtgaacactcaggatagactttcatccagcctagttataccagcgtgtgatttgtctaacacagcttcagcatcaactgataggaccttaatgcttgcaagtggcatatggtcatctgctcatcttttacatataagaaaactaaagcacaaaaatgttgaagtattaggcccaagctccatgtttggttagtcaaaattttaaaccctcctgaaaaaaaattagagtcaccctttaagtatttagtttccatattttttactcagtcaccttcattccatctaaatcagaagcatggtgtgtccctgttgtcccttaagggctggcaagaggaatgagcagggccaactctgaccagtccaggtcacagtgcataaatgggagaagtgcccattgtcctctagcaggcctggctccatgaagcctttgaaccaccttgatctccgtttttcagtgatgcatgcttaggtggctgagatgctcatataagtgtgtcttatcccaggaatataataatgtgtaattaacactaaaattgcattgaccggagtgtaattattctttggagaatccgcccaaacttcatgggcttgtagtgcctcaagattatattggtgaacaacactcactcggtggggtttgtgcagaagtgttggttccttccttgtggataaactgctagaaagcagagaagacatcgggcaggatttatttcagtctttaaaatcatataacattttcacaatcccaatttgggcccctaaaagaacacgtgatctagcagagagttttatcctcgcatcaaatgctaacagttgttttaccaacaacatttgtgagattttaagaataggatacatcatggaaagtttcaagtgcagtggagttggcacagggttaaaagatgcagcaggacctccctcctgatagaccagatttccttttgacgcagttctaaattcttcagggccaacagggagaccactgataattgcctgtaattcaacacacacacgacctgctctcctaaagccaagcatcaacctctccattacagtcggtgggctccgttttttgttgttgctgtttttcttttcttttcttctctttacctttcttccctttggatcaatggctcttttcatgcaaggtcctacttgacgttctaatagaagtgtaattttatcttcttccagaagcctaccttattcaaagtctgtaatgatcattccataatcagtatggttagaagcaccgagtccaccactaggtatctgccatatcggtgatgaaggagaagagggtgaaagtggcagaattaaccatgcttgagcatgttctgggctcactgctatagaactttgatctttaaatattcttgcagtgcacattcagcaaatatactgaagtaacaaaattagaaagtctgcctatgcagatgtgcacaacctaacttttccctttttctctttaaatgctactgtggtctgccccatcctcatcagtcctcaaggaattctcccagcccaaagctgagacaagcctgagcatcgatccttccaaagacgtgttaggttgacccttgtctttgcctcaagtcaccctcacgtattgaacaccttccaaatggtggctggaagttgatgctagttgctatggaggagggaggatcagaatgtgaagaaataaccaccaaatactaaagaagtcctcctctagatgagaatggaaatgctcacatacattcccctaatatgaggccaactcgaatgtgtacatggcaccaccatgaaattgccattggttgtaggaagatgaaccaattctgttggggggaggggcagggaaagtttttggagaatgcaggttttaactgagccctcaggttagatggaactccccaaagcagatgagggagtgaagaggacattggtgccaaggagcaccatggatcagacactgagagctaaaaaggtacagcatgtgtttgtgaaaaatagcatggcccaggggtggtggccgtggggtagatgggaggaggcaatggaaataacagggaataaacctggatccataaaatggggctgagttctaaagggctgtgaatgccaggctgaagagcttgggtaccagggaggatcagggacatattttaaagctggaacatgaaatagttctggattataaaaggatctcatcggcgtttgggggtaataggaagataagtaagctgatcagcttggaggatgttgaaacagtaaatatcacaaaataaagggcctgaacgagggtggtggcagtgagagtggagaagaggtaggagagaggccaccaagggggttggcagatgacttgcttctgaagagcaaggagtagaggccagcaagaggtgacatgaaggtctggactctggtacccaaaagggctgctatcctggaggagaaacactgcagggagacaaagggtggagccagggaaggggaagtggtggcacatgtctgaatatattgaatgtggtggctttagcacatccaaaggacggcgggtcacctagagagcagggctaactgcagggatgcagggatggagacccaaccgggccagggcattaaggcacagttctggggtggggctgggggagagcatttcccccaaagcctgagagaaaatgtggtggcagccacagcgtctgtccagagcacagctacatgtccactgcccatggggctcaacctccaggacagccctgccccgcagaatagaacacaagcccgcagatgaacgttctgtagccacaatcaagtaagtgaaaagaaacacgtgagattaatttactaatatttttaacccactatagccaaatgttacatttcaatatgcattctatataaaaattattaatgccatagcttacactctttctctttcccgagtctttgagatctggtgtgcaggttacactttcgagctgtctcagccacatgcttcttgcccacatggggctggtggcaccaataccaagcagtgcagctgtagaagccacctaaggtacctcctagagagggtgacagtgtcatttgtcctccttaactgggtacttcccagagtggaaaaggaggtggcaagtacagtaaatggggactgtcctgggtgaatcaggagctcctctcttctatctttccagcacgttttgcctggtagagaaaggctctgggcaggccttgattcaggctcagccttcacccactctaaagcaccactgagccccaggatcaaaagatgtggtgacaccacttctccatgctcctcattcaccactcagacaaaggaaatattaataacgataatattgaccagcatgtactgagcaccccttatgtgcgcggtgctgtgcccagcacttcctatgtaacaaccaggatactggtattattgctctcctcttctgatccagagaggttgcctaactttcccaaagtcaaccagcagaatggaactcctatccatgtctgcctgaggctcgttcccaggcccttaacctctgagccatgtgggtagttttcttctatgtctgctagaggaagggtgctctggaaggcttgaaagagagagagggggagagagagtagtgtggctttattgtgttaaccagatgatgtccttctcattgtgtttcctgaaaagtacatttagttcagtttgcctccttgaggcttttatggaggcaaagcagattttcaagaaaaacattgaggctgtttcatgtttaaatctccaatcttccacgtgtgggtgcctccatctccttcactgtagcctttctctcaaagacaatgcatacaacaactccacaatccagcacctggatgcaacgctttagtttagctcctcagcactcaaaggcctggtgaccttaatagatgagactttttgtctgccttgtcttagagaatgacttaaaattgggatgagcctgccaacaatgatgtgagcaacttactcactgtcagagaccctggagagatgcttcccagctgtgaagacgtcatccataaaaacacaatcccaggcattccagctggagtggacgtactggtcgccacacatcccagttgaaagaaagtgacattaaatgtgtcaaggccatgaggcacacctgcaaatgtggcaggaaaatcacataatagtgccaccccatactcacctgacactggcatgaaattcaaagggtacttaaaagataagagatggaggggaggagacttccagctgcagccaaaagccatgttcttcctccatgtacagcatttatagcatgagggaaggcaactagctggcgagtgctgagcaggtatatcagggtcggtccagcagagtctgagctgtaagaaggaagctaagggatagctaggatcatgaatgtcctttatgattaggtgccagggatgaggatggaactgtggagcctgtcttttaagtcatatagtatgtctggaaaactgatagttcctaggcttaaaaatagagaagctgtaatatgaaggttcttagtatagattaactaaattattaattaaattattcgtggggtatggggtggggccattggtctgatctgactccaatttgactcaagtgtggaatttaattgtggtgctttagaggacagaagaggctatttccttgcatatacaatgagtcatacagaatcctaatggtgtttataggactgtagacaaattgtggggtcagtgggggtctttactgagtaaaatgcagcctctctcatctctgtctgtatctctgtcttcatctctcccgtttcctcatcactccatcacattgggtaagcatattggtatgaagaagaaattcaactctaataaaaaaaaaaacatgatttctggagatctctgaatacatcaataaaatctacctatgccttctctttcaacaattcagtggtgacagcagtttttgtggtttatgctgtggatagagaaaagcagaggtggttagtcttaaaactgtggcacagaaattgaagctgataataagaattttaaccatgtcttaggaaaagccaaatcaaagtcccctgctgataagagagtgagatgaatttgaaacatgggcaccacatccatgttcttgtaggcctggtttgtggtccagggccaattgtaagctgggatcacaagacagacacttctccagcaagcagacaacaagggaaggtctgaacttaaagctgcctctcttgtgagcccgaaagttgaatgtctctgtttccccaaatacatgatcccttgtcatttaataaaatcttcaggtacagaagcattagaagtggggtagaatcaggtaaggtcctgcttcaaacagtccatggaccatttgggaaaattaaatgattacttcaacaatggacggggtgataaaaacaggatcaaagttcccaggttctagtgtaagctttatctgtgactttactcaagacacgccctcagctaggtcctgaaattgtcgtgctgttctatggaacacagatggggagctgatttttcatagtcccttgagatgtgccataatgctaaggtctacaactcagaagccatgatgggagccactatggccaagcaattgaggtcttgttaattcatacaaaagtggtgtcttggttctagcttctgggcctcttgttttctagaattatttgatacaagaaagttctggcacaaccacaggcactttgtcatcccatggaatgtcaccatcatggatgtgactggtatcaaaccagtctcttggtccaagtgtacacaagtagtcaatggctggcagagtcacgatgaataaccacagttctgtatttccaagttctcccttctttgactggaccatgtctagaacacagctaatgctttctcatccctttattttctcaacagtaaatggtggtggaaaaggtttaccactttaaagaaatcttatatgggtgggattatagaatgtgtgtggattattttgaaaatatgtaaatatgttggatcaatagataagtagaattggaaggtaaatgcctgtgctctagctaaagagtgtatttgaacgaaataaatctaaagaatatggttttcttttttatttttttctttgtgagtgtgttaaagatacagtttctccaggttggatcacagtgctcattttaggcactgcagccctttcagtctcagggtaagaagcatcagtttctcctctcagagagacagtgggcttctcttcctaagggaagcatctgcccctgagaatggaaatacaggaactaagccttgaagaggtgccattacaaagtgttgagcttggagataaagctgtggctttgtggtgttctgtgggagatttcatggcttcatgaggtcagtgatgtaattcaggcaaatgttcccaatatctatttaatataagacatggttgagtcatctttttttttaaaaaaaaaaagacagcttttctccttcttgttcactcattatcatcaaagtaaaaatcataagttaagtatgtgcaattgtacatttgtttggcatgtagtcatgtctacatgtactgtttcccacttgtgggagtctcccattaccgttcgtccttgttactcacatgcaggcgaacccatgattttcctaccagctgtctacttgctcccttgctattgagacttgctctcacccagccaaagtcaagttcttggcatcccacacttagccataactgcatctccactcacatggggtcctttgccattacagattaagatggattaagatacactgatgactttttcagactgggaaatgatttcaaatgtattctgattcaaggagcagtacattggaaggagagttgatgatgtgaaaacagcccaaaatgaatttgcttttcgagtgggaggaaatagatgaactcaccacttctttgggtgtgtaatgaagttgtattgttcttgcaccaccatgttttgccacaattttaaattctgttaaggaaaatgtgaggcgaaaatcccattagtaatcacttgttggtcttgtctcattacaaaaataataaatgtggatgtattggtttttctcatacattttacactcatgcttgcatttgataaatatttatcttgaatgcctgctatgtgcctgacatgttttagatgctggaaatacagcagtgaacaaacataaaacttcctgacctcgtgaaatttgtatttaaaggggaaattataaaaataaataagtaggccgggcacagtggctcacgcctgtaatcccagcagtttgggagggcaaggcagatggatcacctgagattaggagttcaagaccagcctggccaatatggtgaaaccccgtctctactaaaaatacaaaaattagctgggcatggtggcgtgtgcctgtagtcccagctactcgggaggctgaggcaggagcattgcttgagcctgggaggtggaggttgcagtgagccaagatcacgccaatgcactccagcctgggtgacagagcgagataccatctctaaataaataaataaataataaataaataaataaataaataaataaataaataaataaataaaatgtgctgtgtgggaaaatgatactaagggcaatggaaaagcataagacaaataaggggcagctgggggtgcaaagctggtgaaggaggggcacgctgagaaggtgatgagtgtcatgtggcatactcacctgaaggaggtgacactgggagccatgctaatgtctgactcaggagcacaccaggaaggagaaacagcaagtgcaaaaagccagttagcatttcaggatgggtcttattatttctgtaaaaatagtaataataataataataatattgggattttgatgggggattacactgaatctttagtttgctttgggtagtatagttatcttaacagcaggtcttccaatccatgaacatgaggtgccttttcatttattttgttctttaatttctttgagtaatattttgtggttttcagtatatgagtcttttgcctccttgtttaaaatttacttgtacatattttgttcttttcaatgttattttgaatgaaattgttttcagttacctttttgaattggtcattgcaagtatgtagaaacacaactgctctttgtgtttctatatattctacaagcttgcagaattcacttattatatcgaacagatttttatttcaggattctttagagttttctacatataatatcatggcatctgtaaagagataatttgactccttactttccaatttgggtgtcttttatatgttgttttcttaattgctccggctagaatttccagtactgtgttgaatagaagtggcaagagtgaacatccttgtcttgttcctgatcttaggggaaaagctttcagtagtttatcattcggtattatgttagttgtgggtttctatatatgagctttatcgtgttgaagttttcttctactcctaatgcatatttagtctttatttgggcaattaaaaagttttgggaaaaatgaatagtaattattattgccaacattgtgaatgtaattagtgccatagaactatagttaaaaattcttaaaatgtcaaactgtatgttatatatgcgtatatatatatatatatatatatataaaaccataactcaaaaaaaataataggccaaaaacttattgaattgtacatttgaaataggtgaactatatgatatgtgaattatatctcaataaggctattaaaaaaacttttaaaaaatacaaataagaaactattgcaaatggaagtaaaaaaaattatagagacggtaaagagagtgactgttttggaggtaaaaccagcattagtcgatgactggtagatggagggaacgagcaaaagaaaacaggcatggaagtatcacatgttcttcagcgtaagaaatctggaaactgcaattgccatagaggactatgggaggaagacatttggagggaaagaccaaaagtctggatctagagacattcgaggttgccttttgctttctgctgccttatccttagctcagcctggcaccagaagaagtggctcagggacaaactagtaaccaggtgttccctgcgtgtgcagggctgtcattgagagtgacttccattcccattttccctggaacagaactcagattaggaggccataccaaaaggcaatgatgtgagagacggttgagagagataacaaagaatttcccagtattaagagtagttaatgttacttatacaagtccaaagaacatgaagcactcaactatgggaacatgaataaaatagctatctgcctgcccttccggaactttgcatacagtcgtgtatggtaaacatttgtttgccagttgattgttaagctttagtgcctgatgaaaattatatgaggctgggtgcggtggctcacgcctgtaatcccagcactttgggaggccgaggtgggcagatcacgaggtcaggaaatcgagaccatcctggctaacacggtgaaaccccgtgtttactaaaaatacaaaaaattagtcaggtgtggtggtgggtgcctgtagtcccagctactcaggaggctgaggcaggagaatggcgtgaacccgggaggcggagtttgcagtgagccgagattgcgccactgcattccagcctgggtgacagagcaagactctgtctcaaaaaaaaaaaaaaaaaaaaaagaaagaaagaaaattatatgatcgtcttccctctagatttaaaaaaatcagtagacacagtttcctttttgggaattataacacctcttccttgagacaaaaattccttagatacctttcagccttgagttttaagatgtttcagtgccttgtatccatagttctaactttggacatcatttgcttttgtttggattgcaatcaaataactgtttgtgtaaaagtcaaatattataagcgtggctccaacatcttgggtgaaagctcatctcgttcagcccgataaagatgaagcttaaccactaggtagagccagctgaaatcatttggaaaatttcacttagctttaatctagcaggttcctttctgttgaatgataccagtggcgagttccttagaaagcttagtctgacgcaatagtcacacttttaaaaggaggaagaccaggatttacaccgtcttgtgcctaacgggagagaagagagggagccaggtcttccactcattttccatgtgctttccgtgggctgaaggcctaaccacgtgtggtcacaaaacccagcactgaaacagctgtcccctttcatctcggtccccacatgtcgaacactagattgtgtgtgtgttttcaatactctcttccagggagttcagaacacacgtgttccttttaactcctaccagaccctgagatctgcaggccaaaaggaccattctggaaggagtttggaaagatcaggggtcagctgttgagcaacagcctgagaatcaggaagcgcaggtctcccaggtcagcccctaactcactcaccctcagctgtgggggctccatgaccttgatgtatcttggttttgtcacctataaaacacagatagcaacacttccaaaacagacactaaatggaatgcattttgtgatctttggagaaaaggcagcctgttaacatatgctaacaacgtgttatgctggggcaggcctggagccacggcctcccatcaccaccagagtcatttcatttcaggaacctctgccaagaacagcctgatcaccccagcctccaagctccggctctgggtccagctggcatgagataaagggccactctgcccagttgtgtgtgctgccctgctcacccaaaggcctgaattcagggcttccagtgctgatggccagcacaactcacctatttcacctaagaacagacctccttattgccatgtgcctgtctcccatcaagtctattaactctctcattggtgggatagagcagtctaggctggctccttcaaagagaatggttttgctttggagcacagatttcccaactgtacttcatgggtggatatttagtagggtgagagcgtttgtggtttgttttggtcttaagaaaaaagaggccgggcacggtggctcacgcctgtaatcccagcactttgggagggcaaggcgggcggatcacgaggtcaggagactgagaccatcctggctaactcggtgaaaccccatctctactaaaaatacaaaaaattagccaggcatggtggcgggtgcctgtagtcccagctactcgggaggctgaggcaggagaatggcgtgaacctgggaggcggagcttgcagtgagccgagactgggccactacactacagcctgggtgacagagcaagactccatctcaaaaaaaaggaaaaagaaaaaaagaaaaaagaagctgaccagatgagatgaggactgggctctctgactccctctgcactctgtggagttgactttcatgttgcccaaagccaaataaaattctctgaggaggaggatgaaggatggaggtgggggagggagcaaatgttgccaggaactgtcgctgttatctctgaaagtcacacggtggtctctggacgttgtgtggtccctctgaggaagccacagggacgttctcaggaaaatggggctgatctctgtggcccctgctcaggtccccttttcctaagccccctgcttttcctcttcatcccctctcccagcccttcttgcttccctaaatattttcttgagaggaaacgagggcagcaaagatattaatattgacaggctcaaccctttcctgatggtctcaaagtttaaaagagaaacatagaagatgcaatgcttacccaagtcatacatttgagtggtagatgtctagataatgtcaccagggcaaggcagaggcaagggagatgggggaggagagtagagatggccctggatgtgccaggtgaccatacgctcagcccaagtgagagcccagtcctggtccttccaccccatcttgcagaaccttctttccacatgcaccccaaatgcacagaaaaggccaaaatgaagcgcccagattgggggtgttggggagagaaggatgatggtcttgagttatgaaaatcatcttgggaagtttgcaggaaaagaatagtgcctggcaaggccccttctgcactaagctccaaagcaagaggaagtggggttgaatatcagcatgaagaatttaagatagacctaggaaagcatctccacacagaaagagctcttcagcctggtaagacgttcctgcctggggtgtaagcccctctctttgaaagtctccaaataagcaacagttctatcatctattgaagctgatcgtcagcaagacgacttccagtgccaagactactttaccatctaattttagcaatccctcttggcaaaggaagagtttcccctttcctccggctatctggtgttccacacaccatctcctactgcttcctttgatgttgggggattctgtggactcaaggccagatacaacacaggaagagacacactcataggcattacactgccctatctcactgcagcaataagaggcctatttttttttattgtgaatttgaggcactcagtttgaaaaatatgggctgtcaggtttgggattaaaactcagtattgatcattatgtctacagccatgcaaaagtttcttttacttttaagtgctaggatgtttaaatcatgattttatttcagttgttcatttaaagatttcattcatgcttttaattcactgtcagtgaatgcaatttaagcccatcacataatgatagaaagtggctgaaagccatgagaatatgtttctcattgtggaaactacaagttaagtcattttcttctcccgagtaaatttcttcagtttggctaagggaatttttttaaaaggaatcataagttctgaattagtttttcatctcagatgttaaccctatggaaaatgtggcaatgtttctgagatttgcaaaatattgtgatagtatctatgtcttattgctcaagatctaaactcttatgtttgggagtaggggtttgctgtgtatgtgtgtatttttttttaacatcttggcctcacagtgtaaagtgataagctcaggaggaatgttgtgctgcagaacgcctacattactagattacttacggcaacactttctttaatgaggatctctgtgaaaccatctttttttccacttacagtttcaataagaggagatcagttatgaaattaagtaggagagaacaatagagagagagagagttcagcattcctcttcaagctagctaatatttttaaaatgtcgacactgttccaggaactctgctttttaggccaaagattctgccctggtcttcgtcctctccacacccccagcatctcgtgggctgacacatcaacagggtttgagaaagagacacaaaaggtcagacgcatgacacagcaggaacccaggaggacgtccctgcagcctgctctcttctgatagatctcccccagcccccagttcccagcctctgaccccagtcccacccttataatgtccctttctctctattttctctcctgtaccacttttccctccatttagccctcctcctcatcccctcttaggcagagttatcacacctgagctctacaactgagctgagcaatatatacaaaactcaagcctggtttaggcaggcctgacccctgggataggtcagggcggtggttccttgggagaattcctgcttgatgagatggaaggtccaagtcaatagcctcatggtcctcccaagtctgacagtctgctattctacacacctgtccacaggctgcagacatataaaggtaaatgttcaggtattagaaaatattcaaagaattctcaatgttcaaaattctgaaaagcaaatctatgctgaatgtgtggtgggggcattctaaaagataaaaaatgatggctacaaaaagccaagtataaaaagaaacacgtacatatacacacacatacacctacacatgtacattcgaagaggcagaggagagacagagaaaataattaagacagcattagttcctaaatagccttttctataaactccatgacaacaaaggacaatgagtaaactgcagtatctaaagatttaaatctcagaatacctgccagatgccaggcatggtggttcacgcctataatcccagcactttgggaggccaaggcgggtgaatggcttgagttcaggagttcgagaacagcttgggcaacatggcgaaaccctgtctctacaaaaaatacaaaaattagctgagcatggtagcgcacacctgtagtcacagctacttgagaggctgaggcaggagggtcacctatgcccaggaagtcaaggctgcagtgagctgtgatcacaccactgcactccagcctgggtgacagagcaagaccttgtctcaaaaaaaaaaaaaaaaaaaaaaagctcccagaaagtaacagcctttatttcaaagaggtcaagtctcaacagagttgtcatacttttttttttcagttaggaaaaatgatgactttaatggattactcattttatcgcttttaatttaccaaaaccagtgagaaattgggttcccagctcattaagttccaccctttgtggtcagagctgaaagggtcagagagtctgctgggaagggtggagtctgatgtgtagggccaaaggggacatagtggcctcacaaggtggggcctccgtggccaccagccatgctcaggagccggtccccacccctcagtcccccaacatggcacagcctgcttggcatccattgctgacttcggctaccagtcaagtttcctttcgggcttaaatgccacgggtgtccatgcggggctgattcatgttctcctagacttcttgccaccctgttcacgggcctgtctggagctccaagacacttgcctgcaatggcgttgcggttccagccaggaaagccaattaactgcttcagaagttggctgaagtctctgagggtgtacgggaacagaagtgcccagtcagtattaggctggaagttaattcctcttttcttaggtcagtctatatctattgaccaatttaactacaaccacaaaagtctgcatatatgtgtatgagtctaacataccaaacccttcattatgtcctcatcagtagaagaagataatagatcatttcgtttatttatttttctttttaattttcaatttttacgggtacgtagtacccgtaaatgtaggtacctaggcatttaggtgcatagtaggtgtatacgcatagcaggtgcacagctgtggagctgtgatcacaccactgcactcctatgcacacattgtacctatacacatctcatgtatggggtacatgagatgttttgatataggcatgcaatatacaataatcacgtcatggaaaatggggtatccatcctctcagcatttattctttgtgttataaacaatccaattatacttttagttattttaaaatgtacaattaaattattattgactatggtcaccctgttatgctgtcaaataccaggtcttacacattattgcattttacatagtttacaccatgggtaaatattttatcctccttcccagtttagaaaatgtcttggaagttttttttttaattttcttaaaaaatatatgaatagcaatggtaaaaaaaaatgtggttccgtctagatgttctggtactgttaaatgatccaatggttgtcaaaacttgctctatgtttatcatcacaacctttactttctccttctccattcactaagagggggctgacctttcctctgttgctaacggggcttttgagacaattccgtatgttgccagccggcccggagggaacaaccctttccccaaaaccacttgcttgacttcaaaggatatgaaaaaatctgcttttaggaaaattagtgagtggagaatctcagtgaatgatgtggaataaattagaacattgcatttatgccaggtcattcatgtcacattcctcagtcacatacccgtgtgtgtgtgtgtctgtgtgtgtgtctgtgtatgtgtgtgtgtgtgtctgtgtgtgtgtctgtgtgtgtgtgtctgtgtgtgtgcgcctgtgtgtgtctgtgtgtgtgtctctgtgtgtctgtgtgtgtgtgcctgtgtgtgtctgtgtgtgtgtgcgcctgtgtgtgtgtctgtgtgtgtgtctctgtgtgtctgtgtgtgtgtgcctgtgtgtgtctgtgtgtgtgtctgtgtgtgtgcctgtgtgtgcctgtgtgtgtgtgtctgtgtgtgtgcctgtgtgtgtctgtgcctgtgtgtgtgtctgtgtgtgcctgtatgtatgtgtgtgtgtgtgtgtgtgtgtgtgtgtagggacaaacaaacagacattgtcctctgactctattctggctcctattaatggtgttttacctgaaaaggcaaatcaaatggaaagtccctgaggttcctaggagcccctctggtacagttttgtttgcccctagaactgcttttttctctgaagttgctctttttttaagataatggtttctaccctacatcttaccttaccccatcctatagctacatcagtatgcttgcatttaaaattatccctgtccaggagtgacatcgctaaggcatatagattagattgggaaacttggccttctgctctgggaagtttaaaaagcttctgaaattgccacgtcttcctcaaagcagtcaccctagaagtagagcagaggtgatggcgtccgccagatacgaggtgaagcacccagcaccttccacgagtgcttcccaaaggccccagatgcccttcctggcagggcaagagagtggtcctttcagggaaccgtccaccctgctggcagctctgcctagagaaccacccggagggagtctccgctcccctccctgctgaggcctgggcgggctgcctgcacagtcatcctcctcattgctagccctgacatggagaaactggacttggatgggcccctctggccacaaggtagctgcattgcaaagccctgccaggccagctcgaggactggctgagtctgagcttgctgggcactgcctgggctgccacgaaggcgtttgtgtggatatgcagcagtgaacatggccaaagggcatcgccatcccatttcttgggttgtttttttttttcttttttttttttttatatttgtaatgtttaatcttgtgaaagaaacgtcataatcttttgagaggggagtttttctttatacctcttatcactctctgaaatcaccacttgtttaatgattgggagattcatggctggtcacccctaggatgttaattccatggagacagagactgggaccaatctcactgcctaatccatcctcagtgcccagaacagtacctgactcatgttcacttcagggattcattttctaaaaagggagattgaagccccaggtggctgcctcctgctttccaaagtctggctgccgggaatgtgccccaggctcctggctcgtgctccagcactgtgtacctcccaaaatgccatcttgggagaggaacatgctggcctgcctgtgcaatgtgtgcgccatctgggagtcccccactacatccaccaccgggcagaacttccagggaagcaggcctgctggctctgtaccctgtcctgggaaggggcagaaatgtccaggcccctggagacaccgcccgcttcactctcctgagagggggtgcgttactttcccatgcttgccataacacattactacaaactgggtggctgaaaacaacagaaattattttcacagctttggacgccagaagtccaaaatcaaggtgttggcaggcccttgctccctgtgcaggctctagggggaaatccttccttgcctctttctaccttacagcagttgccagcactccttagcttctgggctacatcagcccagtctctgcctccagcatcatatgaggtcttccctctgtctgtccgttttttcttcttataaggacatcagtcattagattcagagcccaccctaatccaggatgacctcgtcttaaccagttacttcttcaaaaacgctatatccaaataaggtcacattctgaggttctatgtggacatgaactttggggaacactacacaacccagttcagaccatacagacgtgggagccgttcccctatctaccactttgtagccgtgtgacttcaggcaagtcacatcaccgctttgtgcctctgcttttccacctgtaaaacagaaataacagtcatcatcaccatcatcatcatcatcatcatcatcatcatcgtaatccctgctaggaatgctgccgggcacatagtgatagctatgcagtttggtcagataaagtcagccaagtgcccgtagctgctatgtagaggtaaactgcatggacagccatgtcatcaagggccccactgggggtgacacagaagggaacagactcatagggccaaccagaatgcacagggcagggcgcctacccaggctgagggagccatggcagatgtgaatattctctttaacaaggggtatctagccaagggaagagaggaccgagggaatttcgggaggaggtaaaggcatgtccagggatctaggggcaggtaggggcctggcatgttcagaaaacctgaagcagctgggatatagcaagagaggcaggcaaggtggaaccacagaggctgggccccggtcttcgccagcgcagcagtggagacaggcttccagcattgctcctggctttagtgatcagtgattctctaaccccctggttggacagaatgacacagcgttcccttgaactgtacggctctttgtgcaaataagtgagtgacctgtggcattctcctcatgaacagagttacagatgtttctatgaaaaagttactgagcatttgtctgcttttatgcaaaatgtatagcaaaaatttattccccagccgggcacggtggctcactcctataatcccagcactttggaaggccgaggcgggtggatcacctgaggccaggagttcaagaccagcctggccaacatggtaaaccctgtctctactaaaaatacaaaaattagccaggcgtggtggtgggtgcctgtaatcccagctactcgggaggctgaggcaggagaatcacttgaacccaggaggcagagtgaaactccgtctcaaaaaaaaaaaattattcctcatatcccaacattatatccgttaatggaagagccccagtggtatgggtgcacgtctctgtggttcatcatataacagcagcaggataatgaagctcaacctctcaaaagctttcaactaaaaccctccctctgatccaccttttatgactaggcctattgcactggctcatttttccccactatggcaaagatccatcactgtttctttttagcaccaggaatgtcacacagcggcacacgtgcagctctgccattctgggggttcctgctcttccctggggaagcttccagaagaaactgccttgtctgcaagtcttccgtggtttgtaggatccagaccctacttgcatcacaaacaaactcattttagagattctggttttaaaaagaatcttcctattttgtcggatctgatgcctcacccagctgcatgaaatatctgatgattactggtggtcaggggtctctgaatgaaactgacaggcagagacattcaggagggagcagctcagtgcagcagcacagagatagaaccttagagccttgagtcagtccctgtgcagaaaaatgaacgatagagtcatagaagctcagagtgggaggtgagacttgtaattgtgaaaacagctcacatttactgtgcatccgtttcatcctccttccaccctgtgagcatgctcccgtccccaacccatgaggagtgaggttaaatgacttgctacttggagcgtaagaggtaatccaccttctccccagtgtacagatgtggcaggcaaagcccagggagtctctagggcctgcagaagggaatgaagcattgtaagagctggatccctgtggtttacccttcgtgccaatgcttatagtgagctgaaaggctttggtcagaaatcttactagacatttcagcttttgcagcacaaagacatttaaattctaccagaacaaacactcctgtggccagtttttcatagttttttcagaagctgctttgggtggatttgatgtatcaaaagagaaagaatcatcctcagagcttcccaagtagactaggaggagagaaactgctttaatcagggacacatcatgccaggcagttgcccaaggggatgatttcagaagcctgggaaagaccctggcttccaaaagtaacttcctcccccacacctcctagcacagcctcatgcctttgacttcaagcttaggtaacctctgagaagtcagctctcctagaaaggtaaaactatcagtcatttaagctgtagtacgaactaagaagctaccccaagcagagtagagaatggcaaagatcagtataaagagatctggggccgggcgccgtggctcacacttgtaatcccagcactttgggaggcagagacagtcagatcacctgaggccaggagttcaagaccagcctggccaatatggagaaaccccgtctctactaaaaatacaaaaattagctgggtgtggcggcgggcgcctgtaatctcagctactcaggagattgaggcaggagaatcgcttgaacgtggaaggtgaaggttgcagtgagctgagatcatgccattgcactccagcctgggcaacagagtgaaactccatctaaaaaaaaaaaaagagagagagagagagagagatctgggccagccaaaggcacatgttctggatctctccactttgcctgaacctgcacctattgggatcatctcagttccctttgaggatgtgggggcctcagagcctggaaagccacacccctattctcctgcccactatcagctactggatcagaatccaccaactgttgacaggttcagccagtgttctcaaacaacctcatgtgcagggtgctcactcaggacaggattatgggtgccggaggagaccatcccaataataatcataataagttgttgcacacactgtccggatgtcaggtgaggggatgagtagggaagagccaatcaaagctggaagcagcagtagaaataacaagctactgttctcagggatggcttcatggtagaggcagcatctcagcaggtcctaggggtaagaatgagtttggcagatggagatgggaaggacagttgtacaggagccgaggcgagtgcccacagcacagtttttgaaagtactagatgatgctgcagcacagagccacagcaggacagcaggctgggcagctgagccctgccatccccttccctgggatctgcaccgccctggtccttctgggctcatgtatgaaaggagcagccccaggaatgttgatgaaagatgagactacacgcctggtgtcctcgaaagtgcagcaatgccagtctcttagcaaccatgtttcccccggctgtgtccacaagtcctttgcagatacaagggaagaaggaccgtactgaccccaggggcaccaggagctgggcttctctgatcttccttggcacccctcctctaccttagctggcacccgatgtggtgcaggcaatagggatgtcttgggatcctaagcccagccttgaggaggggcgcatactgacttgtctacaattataggatgctagaaatttacagagtgaattcacaaacagcaactcctctgagccccacaaaatcctgcaagagaaaagagaggtggcatgaattgtctcattctataaataagaaaccaaactgaggttctaagaatctccgtgatttcaggccacctgtgccctggggatgggagttgttcatcagcctggatctctggcatcacacaagactgtcccctctagagcaagtctgcacacgaagctagcattttccaggcacttcaagaaatcttgtctttcattttctcttttctgagtgacttggggttctgccgaattcctgtttctgcagagggctgtagccttttctcctttccacatactttggtgctctcctagctaggataaaatgctctttttttccccctctttggttttatgagaatttttttagcgatgtcagacttcaaaggaggcctcctaaccataaagatctcaaccagactcacatttgtgattctttctcatgcctgcgtgaaaaggacagtggtgctaacacatggctcatctcccccttgacattcagcctcctttaagtgattttacaaagccccctcactttctctttcgggtcctaaattagtatgtcaggaatcaacagctgccttctcagccaagaagctgggcgcctggggacttcattcttcaccgctgtctggagccccgaagatctctgtgctccctgcctcgtgtcagcagcccgctcccctcaaatgtctggctttcctcagcaactggctacatgctcctgttcttgctaagtcactgaaaccctggccacaaggcggacgaagcgagatttaattgaatctttcagcaatgattcacagaacaaagcctgactgtctgacctggaaaccacacagtggggagtttagaaaccccgagcctagtcaaaacaacgttcctctttcagccattgattgaagttcaaagtaacaaagccgtaagtcagaacaagccattgtcatggcaagggcggtgcaagaaacacacttacctgggcatgcagccttgtggggtgaggcttccctggcctgtcaatcatgtcggtcccattgggactggcttcagggacaacatggcctcctgggagaaacttcccagctagtcagtgaagctcagtggttgaggttaggggactgtgttagtttcctgtggctgccataacaaattgccacaaactgtgtggtttaaaacaacagaaatgtattctcttacagccctagaggctagaattccaagatcaaggcgctggcatttctgtgctccctctgaaggctccaggagaggatccttccttgcttcccccagcatctggtgactcccagcaacccttgacatcccttgagtcatctttgcattactccagtttctgcctctgtcttcgcatggcatctctctgtgtacccctgtgtgtcttctcctcttcttataaggatgctgatcattgaatttagcagccaacctaatctagtatgacctcatcttaacaaatcacatttacacaaaccttatttccaaaaagcgtgacaacctgaggttctaggtagatgtggatatttgggagacacatagggaaccatggcttttttgctaaatgccacatatctcctgctccctgcccccatcttgtggagttagttattccatcctcaattttgagacctcctccacagactaaactcttggtgcatgatgttgaatcttgacctttcaactttcaggtttgaggaaacaaacagtgccagcctttgacataggacccagtgtgatttgatggaaagagcattgaaagttaatgcaaggcagactggaaggtgaaacagtggacagtatctagggacataaatgatcagccaaaacagtctgggctgggtgcaatggttcatacctgaaatcccagcattttgggaggctgaggcgggatcccttgagcccaggagttcgagatcagcctgggcaacatggcaaaacccatctctacaaaaaatacaaaaattagcccagtgtagtggtgcatgcctgtagtaccagctactttggaggctgagacaaggagtatctcttgagcctaggaggttgaggctgcagcgaccatgatcgtgctattgtactccagcctgggtgacagagtgagaccctgtctcaaaaaaaaaaaaaaaaaaaaaaagtctggtcagagttgttgatagaccaccagacactttctctaaaaccatttgttacaccgcataccacatcgttggagaaggaaatgttggtggcagtgaaatgactataataatataatataggataataaaatatgagtgaataaaataggtgtgtaccccattcataacagtccctgtctgtctgtgagaaaggaagccaagtccactgaggaatattaaagaaacccccatatggtatccccaaagggctccaccctaaacatttggagtaggggtcagtatagggattggtgtgtggttgccctgagagtgttttaatgctcaccatgggctgagagctttcagagaaaaaatcgtgtcatctccaagatctcacattctggaatgttcttccatccacagcttctactccttccctgcctattccactcctacagattgtacttgccgtcttcatggtgaccccagacacctctggctacctctgctctccaagccagtcagcaagcaccctttgacaaacctagttctgccccgatgggcctgaacccaagactgggtcactccattgaggtcctgctggcagcctattactccctgctctgtcatccctattgcaagaaactatgatgagaccatagggaaatgaaggacccatcaatctaatatcaatattaaattactgtacctttcaatggagtgctaagttctttaccttcatttattaactcaggatgaccacttactttctctgctcttgttctaagtcttctaagtattattggaatcacataactactttgacacaattttttcatcctaacctgtgcactgaatactcaatatatccatgcacaacctcctaccatgctatatattttggggctattccaaacctggcctgggctgccagccctgacccccataccatgcagcctgtcctctgggaagatcctgtcacccctgtattcctgagaagagaaatgagttctatggaaagtacctgatcacttccttccttcacatgacggggtctatctgcatcttcatgtgacctctctctgatggacattgtatttgcccaactactttgcagacatgtgccacataactgtgcttctgcactcaagccctccagcttcctctagaactgttccatcaacccttcattcccttcttttccttcctgcacttctctcctctccactcctggtctctctccactggctgggcatttctcttgtcttaaaatactcttctttttgattctgctatttctgcaagccaccaacttctttctcttcttccttttgccaccacttcctctgaaatagtgaatctcaaaccatttttcctccacagcgcaccaaagagccgtagctattgcagtggcctcccccacagataagttatatggaagactgtgtatagttctatagttttttttctgccctcatatgggaccttctggtgcacaatgacatactgagattggccactttgctaactgatttgctactctggggcttatagtctaggccacttcatcctccaagaacaaattatccatccttggccttgctttttcacactgtgatgatttcttctgttatcttattatcactgctttttccacatttttttctctagctactcttccttctctcttactccaaatacatcctagaccctgtcccaggctctcttctctctctggtccaccttgttccctttgtgaatctggccactcttgtcttgaacaccatagacccatgactggcaactctaaccctccagctcagcccatttctgggtgctggccttattttcaattgacttctgaacacatccactggggatgcccctctgaggaaccttgaggcaaatatgtccccagctgaattaatcatcttctcagattttccagctcccctatttctggcagcagcaccattggcccctgagtcagcagggctaaacttcagagttaatggtgatgaccctgctccacccccacaccaaaccactagctaagttttagctactccactctgctatttctgcaagctaccaacttcattctcctcttccttttgccaccacttcctctgaaatagtgagtctcaaaccattttccccccacaacacaccaaagagttatagctattgcaatggtctcctccacagataagttttatggcagactgtgtgtagttctaggattcttagtaatctaaacccctgccccaggtagccaagaatcaagtttgttgtactcccagcacacaaaagagattgtcttagataagacagtaaagagattgtatatcattatcatttcatgtaattaccttttatttgacatttagaacatgctgttagatgttctgataacccaaaaatcaaaatgttgataacaacttatgaaaaagtgaaagctctgtagtagagtaataaatttattttggtgttattagtaggggtagtaaatttaagtagcttttcttctaccctcatttgtaagtctgttaagagtttgagagaaataagggccattgtctctggaaagaatgactcattcagtagtttagcttagcgcttcctatgattcacatcaccattcgagtttctaatgcttaaccttcctagaagctacagtgaaaaacaagacagatgcctggagtatgatttggtgggttcaataaagccttaatcctccaaaatttctacctcatgcgcttgctggttaacaacacatttaatgccttctctctttgtaacctaccagacatcatggatgagagaaagaaccaaaaaggatgaagaactaggtgcctggaatgttcctaaagattcacttgggaaacagcttaatatagtggactttggcaacagaccaactaggcttcaaatcttggttctaccacctaacggttataagaccttgaaagatggtttaacttctgagttcatttcctatttcaaaagtaaagataggccacatgcagtggttcacacctgtaatcccagcactttgggaggccaaggcaggcggatcccaaggtcaggaggtcaagaccagcctgaccaacatggtgaaaccccgtctctactaaaaatacaaaaattagctgggtgttgtggcacgcgcctgtaatcccagctactcaggaggctaaggcaggagaatcacttgaacccgggtggcggagattgcaataagccaagatcgcgccactacactccagcctgggtgacagagtgagactccatctcaaaaaataaaaataaaaaaagtaaacatagtaatagtatcgcaatcattaatgaggctatataaaacataaacagaaaattgacaactaggtatgctaagaggagagtggatggtaactttcccaatccaaactctctcctccttccctttctttctctttctttccgtcacacacacacacacacacaccccttttgacttcataattgagccttggactaaccctgggaccctagtaagagctaccccttcatcaacaacaatctttattttacttaatgaatgatgtaaatggtagttccctgggtagcttggacttagaagtctatccctagaagaattctctacaccttgtatgtggcacaaaagactaaatccttggtaagaaagatggtagcgatttatagttataatgacttgagtagataagcgctaatatccatgtgataaaggaaaggcaggaaatggacaaaggcatttagtgacctgcggatgaaatgaagtgccttctgtctgtacggctcctccagcattggcatgtactaacgaatgtgcccagcgaactggcattgagcacttctgtctcactatccagctgcatttttagcagctgttctgagactcacccttgcaggcttttggccaagcatcagccccatataaagaagagagatttgttgaggggggctccttgctgcactgatggcaatgacctacagatacagaaagaccggtctcagaaccattttgtagctaaggaaacagatacagccattgtgaaacatcaagccatattattatagtgaaaagagacaaaaaaaaataggccaccactgggtgttttggaacatttgaataatcaagcaaaatggattaaattaactatcaagtaaaatcttctttgaaaaatcagttaccaatatggcaggaaataatattattctgaattccatggctcatgtggatccaaatatttgtaaaatctagtcattactaaatccataaataatgaatactcttttttttggactttcaaataaattttccaggagaaagttaaatccattcctgggtgagcttaagctgatccatgcaaaatctattccttggcaccaggcttctagaataggtccagggactccatatttttatttgctcaatgtttcttgtttaaggggaagcttgaatagtaccattacagattttcacatctaattttcaccgaaattcagaagagtattgccatgcctcacttatcctaaacaataacagatttgtcattctgtcaccagcagaattaagtgtgtgtcccaggtttccatggttggaacaaggactccaaagggaagcatctatttttctcacatcagattggcgtggaagttaaggacttcaaaacgaactccacaagcaatgctattaaagccgcttcctcatgtttagaccctcagctgttgttgatcttaggagggacccttccacagacttgtcttctcctttgatattttagcctcttaataattttaagtcaaccatccatagctgacagttttgctgataaagtacctttataatgatagacttggtgtttaaatttccgcctacgtcttctctaagttggtgacctaattgtagctgatgcttccagtagaaatactcacttggtaacctcaagctatttctgggcacagctgaaataaagcaaattgctttttaagctgatgattccaggttctgtgtcttattttccatttcttcttgtccatttttccatgtaagttttatctgctacctacaaaccatgaaaaacaaattattccattcaaatctttggaaacggctgttcactggcacacaatcacagtgtcttgatagtttttctggttttgaatttctggaagggaaatcctccttctgaggagacttcactttccgtcagtaatggggaaaactgtttccctcgggatagcagaggtcattttaaaagagaacactcagcagaaatgaaaatccaaacaactgatttttaattcgtgtctctttgttcagtgatgttggtcctgattctgcctatgagacgggaataaagagagatttcgggaaaagtgtgaagccaaacatgggtgctatttaaataccaccctcataatttgaaacaagacccagctcctcctatcttcacaggcagaataccccatccccaggctacgtaggacctgataaatgtggggtgacccatactggcctggcttatgcccactggcctgcgttggtgaataaattgtgtggtctcttccttggtgtgatttttccctgggtacttgcaagatgccttatttagaaagaaaacgacaaggctaatggttccagagaacttcgtccactgtttatatgaagagactgagactcagtggggctccacagcctgctcttcagtgacaaagccaagaccaaagtaataatagcagatctttatatagcctttgctgtcaagccaggtacttatacataagcgctttatgtatattgactcatttaatccttccaccaacctgcaggattcgtgttgtttaatcccattttacagcaagtagctcgctttcggccatgcgctagcaggggcagagctgtgttctggggcaggcgacctggctctggagcccactgagacgaacccagcaccctccacctggcagacccagcactcctcactcttggtcctaccctctgttctctgttaggttgctttgggaccaaggggagaaaaaaacttgttaatgaaaatggagcccaacatttcaaagctgatgtttttatactactgtgaacatcatcagagtgctatctaatgcacttaaaaccgacatgactttaaaacagacgtgaaatagacttgccagataatatatagacatgtctttaagcaaacattgagcaaaaggtacctcgctggtaacaaccattcagaaggaaagaaacgctgtcataaaataattaatatagtcatcccagacagaatggctaaatagcagtctggtggtttttatgttagcatttgtttgtcaaggtcttcctgaatgagactgtaagtccctccaaaccacatatgtgcctatgtagttctcttgtagagcacctgataaaatacctatggaaagatttttttaataaatattgtaatattgttcaatggcagttatagagaatccttggtactgacctttgagttgccaacctatgcaaacaaaaaaaaaaagcattggttataaagactatgacttataagaaagacttatgaggatgtatagcatataacgcttgaggcatatcttggagcatatatctatgaacaaaatcaaatccaaaaagactctttctcttattccgggggctgtgggtcacagatgctattccagaacccaggcatgggaatatatgcagcatcctccagacttgacagttcccagtcagctgtgcttgactggagccttcagggctcagagttgcaggcgagatggaaattacgagagatctttactctctcaaactcaagggataatggtctgtctcataagaacctacctggcccaggatggacaaagatgctgtgtgtgtgtgtgtgtgtgtgtgtgtgtgtgtgtgtgtgtgtatctgtgtgtgtgttttgtctgagaagtctggcaagggagagaccccaaggtcacctgaaaatctcctctttgcatccaggtggcttaggaaaacatgcttcagtatcagaaaaagaagccttccagcagacagaggtttaaacaatacaacagcccacagtttatcagtagaactggcagaaacagcagactatccttcaattaccctctacagttgttcataaatattggaatttccttgccttgatctggctcacaaaatgagcagcaaatgttgaaaagtttcgtgctttttaaccaggaaacacacaactatgaaatatgtgaagctgcagtagacaagttttaaaaaaacaaaaactttccaataaagtaatggtctcccagtgacatcttgttatactggtaaaaatagatccctaactttgacagtatatttttccttctgggaaactacaaataataacacatcaaaattatgctttttgtcacattcctgaggacagtaaaaatgaaaggaaagtttattttttatttgtaaaacaacatttccattcatttattccacaaggaccacttatttttgagttctgtagaaaactaacgtagaatgagcaccctcatacttatcaatagaaagtaagtcatcatggcagaattttttacagatttctcattggtcaaaaaatactgtttatgggcggggcgcggtggctcatgcctgtaatcccagcactctgggaggccgaggcgggcggatcatgaggtcaggagatcgagaccatcctggctaacacggtgaaaccccgtctctactaaaaactacaaaaaattagccgggcatggtggcacgtgactgtagtcccagctgccctggaggctgaggcaggagaatggctgaagcaggagaatggtgaacctgggaggcggggcttgcagtgagccaagatcactgccaccgcaatccagcctgggcgacagagagagactccgtctcaaaaaaaaaaaaaatgctgtttactctaaagacattggacattttacacattgcctcatgaatccatgatgaaaactatgaagtagatggaataacagttaccttccttacatagcaataggtcacactagaaggatgttggaagaaagatggagacagctttttggcctctccagcgacattctccattcaggtttacagccaagtcattccagtgtgtttccaagctccaaatatctttgtagaagtaacttctaaaagtatgtgtgaagtcacacataatccagtctggatcaaatacctgactgtccccacttccatgtgtatatgttgtaatgacagtttaaagtatgttttgggattgaaatcctacccctctctccgcaaaagcaggtagtaataggttaaaaatgatgaaccatcaaattatagttttggctgataggagtcttggagtgacttgaccaaagaaaaattgtataagattgtcaaactgcttggtacctaaatccatagcccaagctcagtgaaccaagataaccctcctggggtagttttccagagcttgtaaaagcagtaagttttttcctctaaatggaagatcattgaaagataatagcagttcaccaattattattatattggctcaaaattcccttcttcagaaggatgagccatcgatctttgggtacagtggggaattcaacaccgtgtagactactcttatttttcaaatttttcttttctttttaaagacaaaatggataattttgattgattaaacagaaattcacacaatagccatagtcagtaaaacggcagcaacaacaaaacacaacattatatgctcaaccactctaatttattaaattagacagagatttctccaaagaatatccattgaattggtgaagataaatattttcacagctattacttaatggaaggaacatttccccgtttgagtgaggtaatttggatagcaagagtaaattcaagacttcagaggcatactatgttgatgctcaccctcacactgctatgttttgtgagatccacctctagcatttttttttttaacttttctaccgatatcacctagcagaatgcgtagcaaaaaataaaggcagattattttacaggaaacactggtagcctaagggacgtataataaccaacatgtaactgatcatggtgctctagcaatattgtcttccccagtagttctctaggttctctgtttgatttttgaatcaaatctttcacatagcctatcaattgtcaacctatttggctaggagattgtatccgtcctcccttctgtgacgcagacttcaccagacatcagagagcttccacggtgttcgtcaaaatgtcatggcaaagcaagcttgggcctacaccatgcagtcccaatgggagcaatattgcacccagggggatgaaaattagtattcagggatagaaaaagtcttacaattataatgacttgtggacctccaaagctcaatcctactggataaaacttattccttagtgttttacttccctcattagggagaatttaaatttaattttatttttctcctggaaggatagtgatcatgaaaaaaggagcccatatatttgaggaaatttttcaatttgggaaaggcagttgatgatatactcttgcaagatatgtgctaataaatactaacttcaaaatgtaagcaagagctttgtattaatctgtaatctcaactagatctcattgagcttgaacagtgtgaaaatgattagcttttcttctgtaatttttttttttttttggaaagaccaattgatgtatttttttcaatctccctccaaatttccaataagacacaagtaattttcagagttaaactctggctttcacctacattttgtcctgattttgtgaatactgactcaaaaatatttgatagctttcttctgcagataaaacacaactcaactggccgtgaaaccaagaccttccataatttagtctcaatccatctttccaaaattactttccttaactctcctttataaactcttcacttcaacaaataatcctctctcttctctgttttcagccaccctgtctcccctccaaaactatttccgccccccaagagctacacacccaactgctcttctgtgtcacaaatgtcactgtttttacaaagatttttgcaattgctaccctctccacccctccttccctagctagaagccttctctcccctcttctaaacccacacagctcaccatttggacaacttttaggaagtttagcactttccaccacacactattgttttaagtacagtcaccccccagtatccatgggggtattggtttcaggacccctctggaataacaacatcttcagatgctcaagtctcttttctaaaatggtgtagtatttgcatataacatgtgcacatcctcctgtatactttaaatcaaccctagattacttataatacctaacataatgtaaatgctatgcaaatagttgttatactgtattgtttagggaagaatgacaggaaaaaagtctgcgcatgttcaatacagacaaccatccatatatacagatctatacgtagagagatccacagttggttaaatccatagaagcagagcagagcttctttatgaagccaaatatgtatcttcataatatcccggagggcagaacttcggtctgatttgtaggtattgaggtctaatgaaaatagctagggaaaagatccagggggaagtcttttcctccaccacttactagctggctctgcctagtattacacttgcttgccttctcttttagcatatgggcaatttatccaatcactctgagcctagtttccacatctagctggctctgcctagtattacacttgcttgccttctcttttagcatatgggcaatttatccaatcactctgagcctagtttccacatctataaaatacggtgagaacttaataagttaaaatttctagcacatagtagatatttaaaacatattaaataaattcatgccattataacgtcacagtctgttacttaaaatgttttcctcaaaagtctcaatggctgactcacaaaaacagatttgttaatggatctgttaaaataaacaagagcaaaatagcctttgctatttttgtatagtgttaatcattctgttccttaaagaaaagtcccagggaactacttagtgtggggaaggccgtttctagaaggagtgccggcagagagcaggagcaggagttggcatcacaaagctggtgctgtcttcatctacaccacatttcatgtcaacttcattttattcattttgtgcccctcatctgaaccctcagtttcaggtttgggaaacagaaccaaatggaacatgaaatgtaaaacaaggtccagccaaacacagtgagctctctccggcttcaagtcaaaacttggctgaaccacaaagcttcacctggttttgagtaaaaaccacactgaaccacctttttttttttttcacggtttcggtttgcaaatggggtttcatgcaaagcttgccctcgtttccgtagagttccctggcagaggacaggcaagtcttcagctaatatggactctgccccatgagcacccctggccagcctgtgtggaggtgactggtggttacttattgttcggatctcagaaggcctgggtgttgagtagtcttgctcgtgtgatgattaagatgacagaaaactatcaggcatatcaagaagaagtacaatcagttagtttctctctttgcacttggcttttacgaaaacagagaagaaaatttttgaaaagccatgaatttatgaaggggtgggaggagcatagcctaaagctccatctacgtgtggaggcaaagagatctgaaacaattctttggataatccaggccaaaattccgattcatcagaaatattgagataataaaggcaaagtgggctagaagagtgcacttgtggaagtatgaaaacaagctcaattttcccctcaatgtgtaaatgtagataaagccatcatatcagcgatgcatttctccctggagacttgtagtggatttggtgtcattcatgtgctatgctggcaatagtagaaaggattaaaatgttccttagaagctaacagtgtcagatgagccatttgccctgggtggtgatgacatttgggaataaggtttaatataaagtgtctccaaactgagttttctatgacatggagggaggtttgtgttgttctcttggtaaattaaactagtacttgggatttacaagcagatttataggaggattgtaatgatgaatgcatgaagaatggattggatcagtgataaaacatttattatatcaatacatgcaaagtttggaaaactgtaagagaaaataaatggcctcttaaaaatcacttatatatgtatagtatcataaaattcacatacaaaaatttcccacacatgatgacactggattagtcctggaaagattatgtgacttgtccaatccaggtcaggaagccagtacgttgcagggatttgagcttccctcgttcttctccattcacagacaaaaatttgtccttggcatgataactatgtagcaagggagacaatcaaatacaccaaccactacaatataacatcacaggcaccaaagtgggactatcttttagagatgtgaggggcctgaataaaagattcctacatctgcctcctccctttgtccatataagcatgcaggactgaaaactatgagatagtctctaagagacagatggagggagaaagagccttactgcctatctctagtgagctggggaatccattcaagtgattagtttgggatatattggttttgaggattccatgaagtacacaacaagagctctcaaggttctccagaaatgtcagtctagaattccaaggaaatagttctgggctggagacatgaatttgggagtcactaatgtaaaaataatagattaatgatctcacccagagcaagatgttgagggagaaaagtcaaagggagcatcaggctctctccaacccgtgggtccagttgcatgcaactggacaatgggattattataaaagaagatgcctgccaaatgatgcctgctgtatggaaggctgcacaccaccaatctcattctttgtagagttaatcaatgcaaagtcccaaaccacttggtcatttaagtagaaagtcttgtctctctaaacctaacatttcaacaccttgcttatacagaagatcaatcaagagaaatgttttattttatgataagattcacaacagaattctatcaaatagcaaatgtctttagtgatggtaacatatgattcatttgacaaagcacaaagcaaaaattgcatttatccatactttttaggaacaggagtttgcttttggttattttcatttgtttgctgtatagggcaatgtatattgtacatttctttgagtagataatgagcaagtggacacatgaggccagagatataaataatttttacttccagaggttatttgtcatggaacctagtaaaacttctatttatttaattaccatagaattggaaaatgttttgccatagaatattgatatgaaggcagaaaccaaatggacatttccctagatgaaaagtatgaattcaaggcccccagtggtcaatgttgggctccttagttcaatattttaggagtcatctgaaagtcagagcaggacaggcagtgaaatttccagtttttctggtaaaaatgagcttatccaggtgccatataaatggaatgaactacagaaagatttgggtagtggatataaaaatgccatgtaaacttgaaagttggcctgttaatgtgttcaggagaaagtgttctaaactatatttttaaaattatggtctctaagagatcagttataaccctgcaaagggtcattaaaatcatgcctgagatcattcctcagtgaagacatcagtgcaatccactgcttcatcagggtaggccacagaaatcctttattaggcactggtgaaccacacaacatgttgttatgcttgttctgtaaaatatgtggtgcttgaggtttgattgttgcaattcatgggctccaaagaagcctttctgtcccctctgagctgccggagtttacctccctatctcttgccctcacatgggaacctgtgccctaccttctggtgtagttaggcctgtattccctccttcacttcagtgaaggctagatatgcacctttccttctttgacaaagactttgttcatagtatgtacgccatacataataaatgatggaagggtgggtggataagatagatggtggttggatggatggatggatggatggatggatggatggatggatggctgataaaaattttaaatgtatctggaaggtgataaaaatgatccagatagtaaagtaccttcttaagataaagcaaaagaattatcattctttagagtgattataaggaagaattaatattaacaaaattctcaatgtttggcctttcccaggattctccttatcaatctattatttagaaatcaattaagggaagttaagaaattttaagttacatgctatatcttttaagatcagagtcttcattggcagctactgtgtgtcctcataaaatcttctttgataaaaaagaactgatctaacactgtatttcttcatagctctaggagcctaatactaataagtcaattcaaactgtagataagcacagcatagtatacataatcccaggcattttggacacattcttcgacctccctgagcctcagtttcctcatggacacagctgaaataaatgtataatacctacataaactatataccaacataaccttataagtttatgaggatcaaatgggcgatagatataaaacccttagtttacaaacagctagtaagtagttgagccattactgcaatccaaacttatctagctctggagacctttttttttcttttaattttgaaataatttgaacgtacaggaaagttgcgagagtaatacaaagaatggctgtatactcttcacccagattgaccaactgttaacctcttgctacataaggccatggttttcatcagtgtgcagtgggtccatcatagtccatacaagaacacaaccatggtgcctgcctcacaaggttagtgtggggattaaatgagtttgcagatgtaaagaataatatgcacacattaagagtgcaccaaagtggaacacgacctctgaccaacgtaggagcccagtgaggtaaaatgtaaagggtgaagggaagtggagggctgaaaaaacactgaaggatttttctgaaggctgaaggtgacttttgagggcaaaggccaatcttaaaaccccagccatccaggatcagaataaaacagcagtgcccctgttcttctgccacatctgtcttctcccaggaaaagggctgaatttgaacaatctgcaaagcatatgaactgatttaatttggaaaagtaagtgctgctattgccaacctgatttcgccacccttaatggtgttggagtcatctgtggtgcttccaaaactaactgctgtgatgagtagaatatctctccaccacgtctcctgacatacccccagccttgaagtgaaaggttccttttcctgatgttgccatgattctgggaagtgaaaagagacctttctaaagcatctatttcatttagctgcacaaagtcttatctgaaggcatgaaaaagtgttaaataccgtagcccacataaattatctcaatgcataacaagtgtgttcataaagtaattatctctggaggcaagccatagcttggagaaggaagacatgaacgtctgccatccagcccttcacatctatggaggctgcacatggtcactgcaagaaatgtcaaaatccccagaacagatatgatccataccttgtaaaatgttctgtatcccacataaaacaatcctcaagatgatcaattttgcaaagtaagcgtgacaccagtcttttgtctttctttcagttctcattccacttttgacttatttgtggaaagttataattagattctgcctggcctttgttttttttttgctttaactgataaagcgctgtaaatcctggacatcacccacgagtgcagtcatttatgaattttgctgttttttttttatgcattgcaccatatgcagacccagctaagaggcatgggtccgtgttcctggcatgcaggagagtcactgagagatatcatatggtctcctggcagaagtacaaagtgcctctcgctgtttgatctactgtcttaaacttaaatgcaaaatctgataattgggtcaggcagaagaaactgagcaataaagttcttttcatttccttttgctatttctccacgtttcatcttttcttcctttcttgtcctctctttctcccatccccattttctgtgttttttttttctctgttggcccctgcaggagacagcctgccctgtgagtagaatggattagaagagatgggtttgtggctagacaacctgtcagagggtccccagtcacctccacctgctccctgctctatgcgcatttttgctccattagcaaccacactgggtaaccatcttcagcttgcaaacaccaaagtcgtggcaggtttacatgttgagaaatattactgccttttcagacagggttgtgtttgatgtaaaaggaattcatcgtagtcgccccggtttgggccattaagcagacagaggcctgtacttcaaagggcgcaagagataaatgaaaactgaacttcctcttcacactgaaggagacctgtaataggaaaagcctgacttatacctttctgctcaacagtttctaaatggggaggcagaactcttccttcttgatttcatcactccaagaactattgcagaattgccggcggggttactgaattgttttagctacatgtagaaccacgtaggtctcctaaaatacatgaatttggcactcgctgcagagttcagaaaagttcagaaatgacaacactttctgttagcatcattctttcaaatcacaaagggcagttaccctcaggtgaatcatagaagttttccacagatcagaccacctgctcacagtagtagatgctgcatggataccctcaagcagagttggaatgttccagaaactcctggggtttggggagggggtgcctggcagccaggcacactggttgtcctcatctacaccccgtactgatattagtatagacaatcagctggactcaggataaagaacattctagagggtcttagtcttgaataagaaggcaacagggaggccactgaggagcggtaaggtaggaaaggtgtttgcctcatgaggatgtggaggataagttttcccaatggtagcaaagccaccctcttccgtgctggctgccccacctgtggctccccaggccaccgctttcggagggtcttgtcccacatttggactcttcagaggccacgccaaaggaccctttctaccaggacctccatttctgaagcttcctagcatcctctctgatgatcccatactgccttgcagctctaagagactctgcgaagagacacattgctttggaggaatcagccccaggccaaagcaacaagcaacaccagagtcctgcggagagctgagaagcaactcgcccactcagacatagacacacagatggacaaactgggatgcagtcctggatctaaacaactctgcaacctgcctcctggggacattcacgcccttgccacagttgcaggaagctggatcgggcgtttggggctggtgagggaaatacagcagcctggaaatgtcaatcagtgtttttctcagactttaaggcactgggaagtggggccagggaggcgtccactgtttctctagttgcctcagccacagcacctacattaaggaggctgcaaaactggtttcaatctgacgtggaaaagatgtctttcagcaattggtgattatatgaattgccactcccttcgatggaagctgccttggaaataaaggcagttgccctagtgagttcagtgtggttttgtcagtcttctagctgcagtctttcactcaaacatttgagaccctgctagggagagctcagaggatcccagtgttgggattaatgagtcaccctcactgtcacaatcacctcaggcctcgtcattttatgtaatgtgactctgtgtcacttctcaccactatggggctggagaatccttttctctttaaaacactacattagaccttttcaacttaacaccagactcttagacaccctgtgcatgcctgcaaaagggctgatttgagacaacactgagatcctgtgttcagggctggatggcgaagttcagcctcccccgtgacactgacgtggcacagttgagtctcggtggcctggtgaggggtccatccatgattccatcagtccagacgaaagctcaatgggaaaacgctattcttctttttttttttttttttttttttttttttttttgagaccgagtctcacactgtcgcctgggctggagtgcaatgatgcgattttggctcactgcaacctccacctcccagtttcaagcgattctcctccctcagcctcccaagtagctgtgattacaggcgcctgccaccatgcctggctaattttttgtatttttagtagagatagggtttcactatgttggccaggctggtctcgatctcctgacttcatgatccactcgccttggccgccgcgcccggcctgggaaaatactattcttaaaaacacgtttgtgaatgtgttttcattacatccctaagatttttttccacttactgaagaaattggataattgcatgaataacctttttattttttaaatatgcccttactcttaggacccctgcgctctccttccttcacctcatctggcacattttcatgaagagaacgatttacagccactgcagttctctcgtttgtagcctccatcaccataaaaagtgaaaatcgaaaactcttgggtggaaattaatgtagatacaacattactacaattcttttatggcgtatataaccataatagcattttcagtgggaaaagcaaaaataaatagaagggcaaatgatgttaatttccatttgcagcaaacgcataatcagatcaattatctgatccttggggaaaaagtaagttgtcattgattggtggggtgaagccttctctgaatgtccatgacagagtgagatacttatggtgttgtacattgaaagcagtcaatgagggggtgtgggttgggggctacctcacgccttcctctggacagcagggcagtaaaccaaagcatcttcttctcccttcattggccatgtggctttaggcaagtggcttaaccatttggagcttgatttccacatctgctaactggggataataaaagtatccacctcatagcattgtaaggttaaataaattgatccatagaatgcacttaaagtggcgtgaggcacttagtaaacccttgaaaaatgtttgcttatcatttattattattttaattattattcatgatgcaaggtaaagaacaacgtttggacttagataatgaaaatccaaatttaagctccactactttcttgccttgtgatcttgggcaaattaaccactctcagcctcagttttctgatctgtaaaacagggctctatctaatgtatagaagtgtgcagatgaagtggggtaagaaatgcaagagcactatgtaactgaatgtgagacctcaccaatgtgcctttctcctggggacatcagagacccacaggaggggactgctccatcgagaccgccctgggatgtggctggcacatagccatccctgtcctggcatgcagcagtgaggatgcttactttcccaaactgttaaccacaggccacacaggtgtcaccaggtgtgacccttagcaatgtcctcctcagcttctctttgcagctctggggccaggtcagagaatggcaaggcacaaggaggtagatacttgattcggaaatgccctagatttcagagcatccagcttcacaggactcccctgcctgggtgtgtgtgtgtgtgctctgtgtcacagattttcatctcgagagtcccataactggtgagtatgaccaccaggaattctagggaggaaatggggctccacagaaagtaaacaaggacatgcagttctttatacaaatatcctgcatgaacactccaaacatcctttttatttttttgccatgaatgggaaaagctttttttctctttttttctttttcgtgtttttttcttttgtttcaaattcttctcttggctcattgctcttaatgctttgtctccctaaaagaggtacctatgtaaaaacggaagtatctggccctacgcagtggaaaaagagactaaacccgaggctgcgagatcatcaggattgcataaaaacgctccagatgatttttattttcctttcctgactggtctgttactgctttctgaaaatttggaaataaagtgtggattatagggcactcagatctgtgtgtgtagatgtgtggatgtgcatggcagtgtgttggcatgtgtgtgaggctgtgtgtgtgcacgtgcgggagcatatgagtatgtgtgcatatgtgagagtgtgcatgttgtgggggactgtgcacttgtgtgaaagtgcatggaaaggagtgtatgtgcgtgtgcatgagcatgtatgtgtggatgtagcatgtgcatggaaggctgtgtgtgagcatgtgtgtgtattcacatccctgcctacattggtgtgtgcacgtatgtgagtgtgcttgtgtgtggtagggtgcgtgtgtgaatgagtacatgcatgtgtacaagcacataggtgcaagcataagtgtgcatgcgtgtgagtgtgagcctgtgtgtacgtgtgtgctgagagcattgtgggtgttggtgcttgtctagccagccatcatgccctcagggcaagtcagaagagatcataggtattttgcattcaatgcgcaggtgaggaagctgaggcccagaggacataattcacctggtcacaaagctggtttgtggcagacactggatcagaaaccatcatactacttttccttactctttgctcctctctgagacatcaccacctacaaggctgattcctcacctctgcctccctcaactttgtacttcttcaacatgaaggcatagggcgtgtctgtaattctagattagtaccaaaatgtcctttcatgccaaaaagcacacaaccttcctttgtcatctgaacttcttttcttttcttttttttttttttttgagatggagtctcgctctgtcgctcaggctggagtgcagtggtgcaatctcggctcactgcaacctctgcctcccgggttcaagcggttctcctgcctcagcctcccgagtagctgggactacaggcgtgtgccaccatgcctggctaattttttgtatttttagtagagatggggtttcaccatgttagccaggatggtctcgatctcctgacctagtaatctgctcacctcggcctcccatagtgctggaattacaggcgtgagccaccgtgcccgtcccatctgaacttcttgagttcagcttccatggtgctgctgttggcatcacttgttccaggtcacttggttgagtttgttggttgttctctgttcctccagtggtcagcacgtatcccccaactgggctagacccttatcgcagtggctgatacttcctctccctcatcagttctgtgagtacaggggtaaaacctggaatgaatgaatgaatgaatgaatgccatcccaatcttccatctacatgataaactttatctatttgaaattgaggcatgcaggctcttagaatatacagagatcaggtgtgctgcttgcttgtgccaggctcagggttccttgtacctgacagtcaggcccagtgggtctctcgaaagcctcccttctggaggaatctgctctcacattaactgtgctctggatctccctgtttcagcgtcggggtagagacagctgtgctgaataatgccccattgattcaccgtcaaaatccacatcttgtctcgcctccggacctgcccagttgtgatacttcttgggggtggactatagcttgaacaacttacagatcaagggagggagaatcaaaggccacccttggctgtcaaagttcccttatttcaggtcttttcttctccttctcccatggttgctgggcaaatagaaggatggatgttgaacctctgagtgcaaccagctcacatcatatttgaaaacattgaggttcagtgaccaatactgagctgctcagtcagtggccaaactaggacgagagacgactctcagttctgggctttttcatcctcacgtagcagcaacctggtcttacaaggactcctctctgcaggagctttaaaaggccactactgtcctggacagcctctctgcagatgtgccggggggaggagtgtcatcttccacgtggacccagcaccttcgtcccagttggccataaacacagagcagtggttcagggttcagggaagccaggactggtctttggaaaccaaagagtgtgctccttcgcaccctaggttcttcgtgggcgtttcttctgtgctgcctgctgggctgagcgcttaaagatacaaacaccagagtcccagccctgtcccaggaggactgcagtctaacctgtgctctgttaacagagttctcagccttgactgctccttagaaccgccttcggagcttttaaaactcattgagaacaaagtgctgatgttgggcaagggtgtttcctccttccctccgtttgctgggggctctcttagatgataatagggcaggcctgtgatgtggtggcaaagttcaagaatacatattcagattttattcccatagccaaactcaccaaggttgtcaggacagtgacaacggtgaggcaggaaagtgagcactgtgggtcaacctactcatttgcttctcagaagaaacgccatgttccccatctctgaatcaccctttgcaaaatgattgcaacgcgaatgcgtatgtctgtgaacgagggagtggaaacttgcgtggtgcataaatctggatttggactgtatagccgagatcttttggcttaactttttcacccaagcacagcctcaaaatgccagggtggcgtggtaaagaaaaaacacacaaacaacaatcacatcaatggttgagcaatcttaagatttaacaaaatagaagggaaaaatcttgccagattactacaaatttttataagtcgttcctttactggctgtttggtgatattatcttttatatgctagcaaaagggaagagttaacaggagaatgaaaagcagagaaagaaactttcttttggtcaaacagaacatcctgttttgagttctaaacaaactcttagttgtggagttctcagtcctttgcctcaggcgaaacacagcctcttcttcctaaatgtttaaaaatatttagtgggagcaaacagtgcaatgaacttctcaaacatcaaaacaatctataaatggaaaaaaaagaatttaaatacaacttacagctgggcacagtggcacatgcttataatctcaacactttgggaggccaaggcaggaggatcacttaagcccaggagtttgaaaccagcctgggcaacatagcaagtctctacaaaaaattttttttcaaaaattaatcaggcaaggtggcatgcacctgtagtcccagctactcaggaggctgaaatgggaggatcacttgagcccaggagattgaggctacagtgagttgtgattatgccactgcactccagcctcggtgacagagtgagactctgtctcacaaaaggaaaaagaaaaaaaaattccactaaaaacaataagaactgttgaatgtaccagaatgcatactgacagaagcacactaattcagagacataatttactgaaaaataggaatcaatccttcaacaccaaatatgcctggtcctccctcttcttatggaaaatttatttggcaaagaatattgtctgtgtgtcatgactaaaattgttgctcacctagggactgtaaccgcctgacttacggccaggtgtcgttattagtaaaatatacgagctgctactgcttgccttaaagtcactttcctctgtcctgctaatacattgttaaagaaagtgataggctcttcacaagctacaaggaactgaagttcagatgatcagaatcactaaattgcaaagtctgttgtggaaattttacccagacttttcttcagatatcacaatttgtcactctctcatgtagtgagtcaaaatatttagaaaacgtatgaatgtccttgtttctgttattgttattattattattattatcattattattattattattttgagatagagtcttgctctgtcaccaggctggagtgcagtggcgcaatctcagctcactgtaacatccgcctcccctgcttcagcctcctgagtagctgggactacaggcatatgccaccacgtccggctaattttttgtgttttagtagagacggggtttcaccatgttggccaggatggtctcgatttcctgacctcatgatccatccatctcagcctcccaaagtgctgggattacaggcgtgagccaccacgcccagccatgaatgtccttgtttcttaaagtttatttggttttgttaaaatcttgtcactaatgaggagcttttatagctcccagactacctacggcttcttatgctacaagactattttatcttcacaactgtctgctaattccaaaggactcagctgatgatacaattcctgaataagaggggacctttgcaggcagctccccagcagactcctcctaatcttcccattgtcattcaccccaagacatttacaaggctctttgtccaatcttcaggcagctttcccttctccctgtgtttacagacacacacattaaacactaagagtttgttcatcggtcacagccagcaccataagggattcttggggtaaaaattatacacaagcaacaaaaaataaactgcctcctagaactcagccacggttgcagccaccaagcaccaaagggccctctattgcttcatcttaaggctgggcaagtctcagaatgtctttgaccttaacctttgattgattctatccatgaaagcctcagcttactggtttacatttataacactgacagatgtaacaacaaaatccagaaatctaagtagttattgcagtatgttccaaaataggtgttccaaatcagattcagtgacccaagcttcttccatccatggctcttccatctcccaaacgtgtcatgttggtctgcacccagtcagcaggaaagggtaagagtggaggatcttgcaggggagcctttgggaccaagcctgggatgctccccacttctgttcatagtccactggtcagactcagtcacaagccagcttccacctatcgggagccggggcagcagggagcccaggacatttctgtagtcatggacccaggaagaacaggaaatggatttggtgaacacatggttgagtctctaccacacacagaacagctgtgttcctggaaattcccagattttgccccaagcttctctcttgtgaccgatgccccgatctggtgctggacccctgcctgtgttactgagttctgctcttctgtgtctctgctcgctgaccccctgtgcaagccgacctccacatgccagatttcccactggagccctctgaacataacctcacctgccagcccagtcctacacccctggtgctcccctcctcatccaggtagcccccttgaccctgttactaggttgcccaccctgcacaattgctccttctctagtcctcactgttcttcctcagtactgatgggttcccagcagggatcagcctctccccagaagactaggcttatcagctttaggaccagctggaggcactcagtgctcttgatactttttccttctaactccagttcccagctgagctttctccctcaggtactcaggttcctaaagaaatgaaccacccaccaccactcatcccaacccggatgagatgcttccagctccttaactttttctaaatatttgcttctttagtacgttcaggtcttcttatcttctctcttctggtcttatttttaatgcacttcagggccttaactctgtgtctctctctaactgccaaaggaatctgtagtttattttctttctatttattcaccaacatccacactgcatttatgatgtgctaggcactgttctccatgccttagtattagcttgtgtaatcctcagaatcctatgaggtagatacattgttatccccattttgaggtgaaggaactgagggacagagagcttgcgtaccttgcccagggtcacgcagctggtagcttctcccaggaaagtcacagtgcacttctttgttcccctaacaataccactggagacctgtagctcaaaaaacattgagtctttttttttttggatatgtctttttttattattatactttaagttttagggtacatgtgcacaatgtgcaggttagttacatatgtatacatgtgccaggctggtgtgctgcacccattaactcgtcatttagcattaggtatatctcctaatgctatccctccccactccccccaccccacaacagtccccagagtgtgatgttccccttcctgtgtccatgtgttctcattgttcaattcccatctatgagtgagaacatgcggtgtttggttttttgtctttgcgatagtttactgagaatgatgatttccagtttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaaagggatggctgggtcaaatggtatttctagttctagatccctgaggaatcaccacactgacttcaacaatggttgaactagtttacagtcccaccaacagtgtaaaagtgttcctatttctccacatcctctccagcatctgttgtttcctgacttttgaatgatcgccattctaactggtgtgagatggtatctcactgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatttgtttgagtctttagagcaaggaaggacttaaaatcatttgcctagctgggctggtttcattttacgaatgttcactgagcctctgtaggggaggggaaggggttcgccataagcacacagctgggcgctggcagtgtctagacttggagtcccgtgttgtctacttgctcagtaatgggcactgtttctgctctgttttgtcctggccacacatcagcctgttagacagccctttatctcacaggaggtaaataattgtaattcttctgagtgcccccaaatttgtctgtctttcaaaaaagatgaactagaaggagttattattttaccgccatcctttacaaggatgcatttgttgggagacttgtacaaacaaaccactggcaagagaaattcccattggtggcctgacgggcaaaagggttggctactgggacagacatcctgccccatacccctcagatgaagccatagagtaaactgcctacactacatgtgccgatagccggacatgacatcagcctcgggattccagatgaccctgaaaaggctaaagatttccaagacaagaacacttcagtttataaacacaatcaaatggccagaggaggtgtgtgcctcattccgggatccttgcaaaagctcaatgattatgatgtgtgaatatcatcatgatgtgtgtctagaatgtacgaatatctgaacggcccagaggtcttcagtctatcaccctgttatcctcggataatagagaaaggatgagggaaaagcccaggccaaactccaagtgggacatttttttcatggcacccaggtggcactggagaggtacacaggcaccccttgcccagaattccaggagtacttaataaggtagtctctcagggggccacctcgttagctcaaggaagcatttaccttccaaagacaaatgagttcctggcttgccccaggtaagggcactgtgtgttgaacttttcacatttcacgagccatcctggctcctggcttcctgtcacaaacatttatatttcctgctcattcgcccctagtgttccagggagtagtgaggttttataattgataattatcacatttagtgccccataacgcttttcatcttcaaagcagttggcaaatattacctaacacacccacgatgtcggccaagtcagagtttctctccctatttggcagagaggagacagcctggccatgcgtcaggtgagcatcaggtcacaaagctcagaggcttcgtggccagcttctttcttgtgtcacctttccctggcatcagatccactccttccaaaaagaacaatgtgggtgcctgtcctaggggcacaggctgtgctctgtaacccgtggccctgccacgtggaaatcatcaggttatttttaagctcattctttgcagcaagcctggtgggtaaattcaagactgaggaacaagagttagtttacctcacaaatggaagtaattttgtaagctttgaggactgagatctatgatgtagtggtatgccctgcatatcactgtatatatgggagagaaaaagaggaagaggaggagaacgagcaggatggggcaaatgggctcaaatgttctagcaattcagatcaactttgctcagtaaccaggggccttagagccacagcccatgagtgagctagtcacccattcatgcccaagagcacaaaaacacaaagtggtatctagggcgtgacatcaaaacagcattcatcaggccatttggtgacaaacaagactggccaagaatgtggcactgtgtaaacaaaatggcccagtcactgtgttttttatttcagtggttgtatctctatggagctgcagacataaaagtggcctttcgaagacccaaggagcttgaaatttcacagtaacaacttcaacaaaaaaatgactgtgttctgtctacttatatccttgttctgtatgttcacaattctctaccagttcatctttcaaatgagagacttttttgagtgaattttcaggtaaattctgccaaccaaaactattgtaaccagaaaatgtatcttctttctgcttgggctatggcaaaattcacaatgaatcttcacacagttaaagctgggcatgacgctgtctgccttagtcactggaaatccatctcactccacctgtgttgcagctcattttagggtttaaggtttgtgccaaaacccacatctccaccatctctcccttaaacagaaaaaacaaaaacacatcttttgctgaattttatttcagaaacaggcaggatttactacaaatgtgctgttttgttttggctattagctgaatttatttttatacttttgcttgcatatgcatgaggaaaaaaaagatgttagttgaactaaaagaaatttgagccaaactcctcttgacagttaacctggttgaagtgcagttgacttcttgcctattccggaaaagcaaccaaatgttcccagtagctccttaatgcaattacttgattagagaaaggcatttcatttcctaaccactacaggaataagcaatatagctgtcaataatttttcaacagagcttcaggcatggtggtcaccattcaaccacaattttatatgctcattaacgcatttccatcaatgcttaaaaattcaccttcggaaagcctgggagtcttaagggattttgctgttaggacagcaaccttctccttcatctgttttcaggttgttattctgttgctgaatactcaacacatcaatgatttgcctcagtcttccgtttaagtcaaatcgggttacattcagtgtgcctgccctcttggctccctttgagttcagagttataatcctgagaaagagtaatgccatctccctttttccccttcatggacttgcctagcttttctgaccaagttattctacaccacagtgtgctctaatgataaaaataattgcttccatatatggagcacttaccatgggccagatatagtcctaaagtctttgttcgtattgtctcatgcaatcctcacaactgcttagaacaatcatcctccaactttagtaagtgtaagagtcccctggataactttaaaaaaaaaaaatagacttcctcccacccacaaagatctggattcggtagcttccagatgggcacacagtgatttgcagtgtaatagtcctgtgggtatttctgatgcaggttttctgtgcaaccatactttgaaaaataaaaaactgccctaggaaggaggcacagccattattctcatttttatagataaaaatctggggctgaagaagttaagaaacttgcccaaactcacccaggaatcaagctgaaggctgtattttccaactccgaatcccatgcttctcatcaaaggtgcaccacctctcacttattttccttgccaagaagtaatgtcaaaatcagagtaattaatgccagctgccatcacaaatattcccatgtttcaatgtcttcataccaccaacgcttatttcctgctcacacaaagacagatgctttgaaaacttctcctctgcgagaatctcttccacgcagtgattcagggtcccaggctgctcccaccttgtagctatggcatctgtaattcaagatataatgtcactacagtgaggggagagagggtgggtgggattataatataggacacctttaagttctcaacctggaagaggttagcttattcccacttacatcccattaaccacaatctaattagttggtcctgccctaactgtaagagaggccaaggaaaggttaggattacatggatatttgttgaacaccagagggagaagtcagggatatgtcataagctcctgaagttccctagcatcgttagcccctggggttggagccctaattctttaccctcctgcctttgaggctctgctccagcctgacccctgcaatgaaacaatcagacaatcactcctgccacaaggagtcagaagggatatcccagaagggatcccaaataactatttcccctctccttttctcctttctcctcccacttcagtcaaagacagctttttaacccaggcctatgactgtaggactgaatcttataaaagtcatctctactcaattatagccaaatgtgtaaaggaagatgactctttctgtagcttaagatatcaccactgaagtgatatgtttaaagaaagagacttaaatgtgctggtagataatatctcaagtgacacaaacttgcagtttggtttagatctgggtccacagaacaaggtctaaaagtctatgactagtcaatgctttgctgaaaacttaaagaaaatcattttggaaatatcaaagccatttttttgcaaccaacttgccatcacttaagctcaacttcttggagtccaggctttcttttgcttactgagttttctgttccacttcttatcttcctccatccaaggtacaacaagcttttcttgataccttcttcttagcagaattaatttcttctctctctggaatgctccccactgagtttatgttttcattagatcattggatcaagtcacattcagaccatactgtagtgagttgtggatttgtctttcctaaagactaataaatatatcttttccagctttcctgtaactccataagttagaagttgcatttagagatcagaagaaagtagtcatttaaacaaaataaaagtttatttctttcttatggtaattccagttgtaagtagcccaaggctgactgggcagctccactatgtcatcaaaaacctagactccttatatctttcttctccatcatccccaacacttggcatccattcacaatgatgttttgtggcccaggatggctgcctgagctctggacatcatgtccacattccagtcagaaggaaagggaaggaaaaggccctttagaaagcttccctgggggttgcatgcagaagttattcacacgactgtgccaagctacatgaaatgatgggaaatgacatctcttacctaagcacactgttatcctcaacaaaatcagggttctgtttatggccactttttgaaaggaagaataggaaatggacattgggtatcacacagaatttgcacaaaacaggcacttgtcaacgcttgttgcattaaattaagttcacgtagacgcataataatgctgtaaaacgtagatttaaaaaaaaaaaaagtccccaaaacagagacttcttgactgaactatcataactgtagccatcccttaagtctttgtgcctttgtgctttgtgcctgtcagatttttaaaaatggaaatagcaatagccttatacttcagttggaagggcagctgggtgatggcaggaaggccacatcctcttgagtagcaagccttgcgattagatgccagcttgatcagacatagcctgtgtgattcagctcaaattacataacctcactgagacttcatctgaagataaaaagacctacatacctcctggtgtgaggaggtagttaatgagaaacaaaagacctgcctaacaccagtacccagtatgttcccagcaaacagtaattatgacctgaaagtgagaagaaagagcagctgcacagacctatgcatcttggttatattaaacgtcccaaatatcaatttctttttctgtaaaatgagaacattattttttaccttctagagaggtgttgaagagatgattaaatgaaataattaaataagagagctgtagaatcataaagctattgcaaacttaaatataaattcactccttcaaagcatatatattgaccccattccatgccagacattatcacgtatgaataaaaagtaccaagtggtgccaaattgccacctcaggtacccccgtataatgacaggccaattccatactattttttttccaattttaatagccatgtatatattttcttttttattattattatattttaagttctagggtacatgtgcagaatgtgcagttttgttacataggtatacacgtgccatggtggtttgctgcacccatcaacccattacctaaattaggtatttctcctaatgggttgctattcatcccctagacccccatcccccgacaggccccggtggatgatgttcctctccctatgtccatgtgttctccttgttcaactcacacttatgagtgagaacatgtagtgtttggttttctgtccttgtgatagtttgctgagaatggtgatttccagcttcatccatgtccctgcaaaggacatgaactcatcctttttatgactgcatagtattccatggtgtgtatgtgccacattttctttatccagtctattattgatggacatttgggttggttccaagtctttgctgttgtgaataatgccgcaagaaacatacgtgtgcatgtgtctttatagtagaatgatttataatcctttgggtatatgcccagtaatgggattgctgggtcaaatggtatttctagttctagatccttgagaaatcgccacactgtcttccacaatggtttaactaatttacattcccaccaacagtgtaaaagctttcctatttctccacatcctctccagcatctgttgtttcctgactttttaatgatcaccattctaactggtgtgagatggtatctcattgtggttttgatttgcatttctctaatgaccagtgatgatgagcattttttcatatgtctgttggctgcataaatttcttttgggaagtgtctgttcatatcctttgcccactttttgatggtgttgtttgtttttttcttgtaaatttgtttaagttcttcacagattctggatattagccctttgtcagatgaatagattgcaaaaattttctcccattcaggacataggcatgggcaaagattcatgtctaaaacaccaaaagcaatggcaacaaaagccaaaattgacaaatgggatctaattaaactaaagagcttccataatatttttaaaagaaattatcctattcaaaagaattatagttttttagaatgacacaaaaggaattccatgcagcttctcaagtttgagtgacaggggccactttggtgggattgctgtcattccacctctcgccgacttttagaacacattatggtgtggcttcaaaacatctgagtcaccatgtgaactatcccttgggcagataagtggatgaagtttccccacctgcaaggatatgtctaacactcggcagcactgtaaaacacgcataccttgtcacttgacttccagaggctattgacaaattgctgctaatgtctcttctaacaaacttcataatgagctattaaagagcactacatcagtagcactgcaatcgttcactaaatgtcaataaaggatttataaacagaactttaattatattttctgggattctgcagagtgtcagtgcctcccctaaaccacgctggaagttagcacagagatggacacctgtgggtcttatggtgggaaatcttggggggccatccacaggtactctgcctaccacatatcctctctgaaatgtaactaagtcatcacctaactatgtgtgcaatttttttctgagacaaagtctagctgtttcccaggctggagtgcagtggcaagatctcagatcactgcaacctccacctctggtttcaagtgattctcctacctcagcctcctgaatagctgagactacaggcacccgccaccatgcgcagctaatttttgtatttagtagagatggggttttgccgtgttggccgggctggtcttgaactcctgacctcaagtgatccacctgcctcggcctcccaaagtgctggtattacaggcatgagccactgagcccagcctatatgtgcagttatgtacaaggcatttccttgttaagagcttgaatctttttgcttataggctctttttgttcattatactctagatctgcagtacaaaattactttcccatatttcctcaatacagtttctttctcataatttctgttatttataatataatttgaaaaataaaatattacttatgtgtactaaacaacaaaataagatgcgggttatgaatgttaaacaatgtagctgtgtaacaatgtagctatacctataacactgtagctagaagacctgttgcaatgacttaactttgtatcagtctctctccttccaaaacctgaggggcttccaccaaataataatcatgtttgtttagcatttggcagtttataaggaactataacaatcatttaattttaactcaatttggtgaacgatctctaaggctgcttcatgttataaaattctatgatcctatgatgtcagttcagccgtgattctgttattctcagcacaagatgtcaaagccccatcatccgctttatgccagtcagttcggagggacatcacatggtttacctgaaggatctataaattccttgaagaagggcctcgtgtattattcatccttgtactcccagggcctagttccttgcttgacagaaaggatatgactagtgaacatatgttgtgcgttggctaacgatgagagtaggaggcccccttcccactcccactccacgctgtgacaggacggcaatcttagcacagcctctatcagcctgccctcgctggcgcgggtgtggcatccacagcgattggggttggagctaccttcgtggttttactcttaattaacaagtacacctaggggaggccaatgtagtaagcaaagttctcttgcctcattccactggtaggttacatcctcaaacatcactttaaccattcctcagccaaacaaagcattcaacccagccacattggaatgtttctctgctgaaggttgcatctctgcttttattacagaaaattgtatttttaaaaatgacaaacacaattcactttccagaaattaacttcacagttcagcagctggggagcgtctattcaataagacagaggttactgtttttgaatcttgccattagtaaaactctccagtaagcctcagaagtgggctaatggcaatatttaaacaacttgctctactgatactggttgtttagtgaaaaggactttggtgtgtcatttagctcatttcccccacttttaggtcaaatgtaactaaaacatcacacacatctgttcatctctttcttccaaatctccaggcagtgtagctgtttggggggatggggtagggaaggaaataaatgaacatctccaggcaagaaattctgcacatcccggccgggcacagtggctcacgcctgtaatcccagcactttgggaggccgaggtgggcagattacgaggtcaggagttcaagaccagcctggccaagatggtgaaaccctgtctctacttaaaatacacacacacacaaaaagtagctgggcacagtggcgggctcctgtaatcccagctactcaggaggctgaagcaggagaattgcttgagcccgggaggcggaggttgcaatgagctgagaccgcgccactgcactctagcctgggtgacaagagtgaaactccatctcaaaagaaaaaggaaaaaaaagaaagaaattctgcacatccccttgtttaggcaccctggagatgggctgtaagtggtctgctctgtactgtcctagctctccaggtagccccatccttgtcaatcagtcattcccaaattaggaaattagggaagggtagaccatcacatccacaaatgataccacctcattctcatcccacattctcacagccccagagcaaatgcctgtgagccatggccctgtccctgagagcctgaaccttgagtaatttaagcaaagcaccttggacctcttctgagaaattctcctctcagagcctgttcctatacagaacttttataaagtacttttgtggctgaaaaccccgagagaatgaatacagaggaatgaaatgcaagtcactcttgcttgaggtggggcagagatggactgatcctcttccacaaggcccccggcatggccccgtgaggtcaggttaggtgcacgttggcaatttctgcagctgttgttggagaggtgttgccgttgctattgatgtttggcttattgatgtttggctttttaatttatatgaagaaatgattttttaaaaaatatttacctattctaaatctagagctgaaatatgagccttcatttcaaaagtgaaacccccccccaaaaaaaaaaaaagatttcttttgaatttatgtcggggtgggagtggggatgatgagggtaatggggagagagatgaaacagcagcccggaaaacccacaggaggggagctgactgggtgctggggtctaaggcttggacgagagcaaagaaggtgaaatgtcctcggaggactgaactcagaggcctgcaaatacttcctcgcagcatgacagtcactttccaaatgttagcaacatcccacgttgtccagaagcgcttctataaggacctcagaggaaacactttggcgaaagtttggaagttaggagtgggttcgtagacagcacagctgtgaagtcccttcagactgtggcggacctctgagggaaatacagggagaaaaataaaggcttctgtggaggaaaaaagtcttttgtgccatttaccatgatagacagggcttctgtgaaaactatttataccaccagtgaaatagctgtgcattcctgccatccatgggacatgtttatgaacacatcaggggaaaaaatggacaaaaacaaaagacaggggcttccttataatgataaggatttctgcttgcaggaaataaattaagttgtagcatattcacatgtatttctataaataataaaatgtgagattgttcagtcactcatgtaagagtgtgcgtgtgggtgttcatctttattctaaaagctgccccacctagaagccttgtaaaaagtcatcaatttgagcagcagattggtaaatagatacatgtttatatggcacacgtgtttcattacatcaacatagctgagagtaatggtagccaaaaaaatctgaaacttcatccttcaatgtttattcaactaacatgtattaaattccagctatgaacacagggctatattgtgcattataataataaataaaatttagtctccagactcaaacatcttataatccatttggtaagatgacacatgcaaagccagggagaacagtcattgaaccacttgaggcacagatagagtgccatgtgtgaccagaagagggagagagtgttatgactatgggttgaagaaagaccatggtagaattggcctttgaggtggtctgtaaagaatgaaactgcttaactaaggtgaggagaagtagctcattacagacccaagggaggacctagtgggatgcaagtgcatgagtctgaaggtggacgagcttgccttttctctggagctcagcgacatgtgatgcctacatgtagagtcacataggaattaccagtccctttgtgataaatgagaaaacctagagaaagccaaaatgtcacagcccaaactcacttatgactgccaccccatccatgtctgtaggtcaccagacagccctgacccaggaagctcttgtacactcagcttgcaaagctgtaccctttgataaataaagctctgcccccagcagccacttcctaaattgattcatcaaccacctgttgctgtattgctatgagaccctctacagtctttttttttatatagcacatgaatcaagccgagctatggaaaagtacagcaccttattgtaacttctcaaacatcaccaaaagaggaagtcttcctggagactatgtcaacagaactgggccttgaaggatggcaagtgcagaagtgtgaaggaggagagtccacacagctctaggggcatatacaaggggacagagaggggaatgtgctatgtgatctgaacctccccccaagcccatggtatttgtgggaccatggctacatgcttgagaaagagcaggagaaaaggttaaaaacattaatttggagggtcaggatagaataaggcatttgtgaagacagaaatgtcacagtgatatcatttctttggcaaggttcatctgcaaaacgtgtgaggcacggaacagagtggaaagagactggcatgagggagagcagttcagagagggaattcatgaagagctgaagagaggaggtggcaggactaactaaaagtgggacagtcacttgttatagtgaaggtagaatggacagaattgggcaactaattaagagggagaaccctctaggagaacaggagaacgcatccaaacctggaaaaccaggaagagaagatccttggtgagaagcagtcaatgagtttgctttgggatatgttgagttcccaaactcatcatgaggtgaggcttccaggtagcaaatgaagacatgggactggagtctgaagagaagccagatctggagaaagagcttcgatagttcacattcatagatacaatagtcaaagcccaggaaatacccaattctacaagaaggttgtacacagagagcaaagaaagccttaaagaatcttactttagggagcaagaacaaagaagatgaaaggaactgtcagagaggtgaagaaaagtctcgagttgccacagtgtggagaacataccaaggatagagagcttttcaaggagggcattttcaagggtgttgcagagaagtctgggagggaagaattgaatcaactggtggtactttgacatttgagaaagcaatttcaggagagcagtgggagtaaaaagcaggttcctggggctgaggagtggaagatagtgagaatttggaggtggaaaatgaggctgctttttgtggggtatgtggcggaggagttggtaggggaaaatgtactctcaaagaaactaggctgcaaggccaaggtcaaaggatggtgggttccactcattgggcaagcctgagcatgtttgtaagcacagagaaatggacccgaatatgtttgtgagattgtagaattgttttatttttgaaaaagaaaaattctaggatgcctttggctgtattttatgtaactatgatactatagtccatctgaaactgtagatgtgtgcatactatagttcatatctgtaagtgatcaataaatgtttaccactgtatggctggcacatcacagatactcaacaaatatttttggcaaattatacatcttgataatatctatattggcatgcctgttctccatgaaataacttatttaactgtgctcatattaatcttagttatgaaacagatcatttagaaggtaacattggaaacaaaaggctaaactcagatacataatttgccaggcctcataaactgtgctttgatgttctaacaacttcccaataagtcagaagccatctgttaaacaagcaattcattcagagtggaggtattaacattaaactgtctttcatatagttagtcattagttattatactatctgtctctcatatagtatagttagtaattactgaaaataagataatcctattaatggccacaacatgattctgatggttagtatattctctagccacaaaaacccagacctaggcctccccaattctgccattcacactgcagcatgtgccatctgtcctaagaggagacgacaggctctcctcttcctccatagatttcatttgaactgtgagaaccaagtttgccaaatgacatttgtgctagaggaagcactcacatgaggccaaccacccaaagcaatacaatatttaaccacatatttcagtgctggcattcgtacccacacaaatattaaccaatcaaaacttatagtctccttgccaaattctcagaagaatggctgaagaagtatcacatggtctgaatctatacaactttacccagattcctgtgtaattcaggggaattctctagttttgtttagtacgagtgagaaactcaaagaataagaaaattgttggggacaggcacagtggctcatgcctgtaatcccagcacattaggaggccagctggaggactgcttgagtccaggagttcgagacaagcctggccaacatagtgagaccccacctttacaaaagacaaaaataattagtaaggcctggtggcatgcatttgtagtcccaggtacttgagaggctgaggcaggaggatcacttgagcccaggagtttgagcctacagtgagctgtgatcacaccactgcactccagcctgggtgacagagcaagacctcatctttaaaaagtaaaaaaaagtcttgagggctatagtaagcacaagaaattatttccttaaactccttttttttcttcctacgctattaaaaaggaaaagatttggggaaaagagaaagggtgtgatataagcaaatgctctatatcggcaaatctctctgtaactttcaccactactatctctgtcaggcgagcataaagtgaaaatatttagctcaacatttgtgtaggaggatttgcgagggttccaaattttctccccacaattttgcaaaatccagttgccaataatcaggtaatttttacttgagtgctttagagcaaccccaaagactgaattttatttatctctgagtctctttagggggtgaaaaaacatcaacataaacaactgaaggaatatcacctggtaaaatcattgaccccacaccgggactgactccatgttccctccccaagccatattggctttctataacaacttctgtcttttgtatgaagtaagatggattttgatccgttgatccccttatctttctttggtgtaacaactggaaaactggcaattcatgtgaagtactttgccaagaggatagtaaagatccttttaatgttttaagcatcctttgttgagttattgtgtgctggaatgggcctaaggtccattgtgtggttcatgttggagcctggatgggtacatctggtaaagacagcaaagaagttaaagggggaaatgttcctcaagacagattcttttctgtttttcagttcctgggcagttctttgtatttttccacacagggtgaaaaacacagtcataaaaccccgaacagtagaacagtcagaatgaaattagtttgttttcactgaagcatttgtgcttgtttccttcagaagctgatcttgatgacatgattgattgtccctgtggatccttcccctttatgctttccatatcccccaactgctcagagattgaccgcgtgccaatgcaggcagaagggacacgggttaaaagctgccaaggcgtactcgctgccctcagcccaacacagggaggcagtcctaggagcttgacttgacttcagggttcacagttgatatgtgcatctggtccggggagaaagagggaaactttccttcaacctgacccaaggctctaagctcacttgctgcctcactcttttcctctcataacacaaagttgtgccatgctgagtggagcctcctggctctgaaaccaatgtggtttgccatctagatcaatgcagacttcattgtgcactgaatgccagcaagagaggggcatctggtgtcatctcaaccatggaaagggtacattagccctgctaattgtcctcaccactatgccttaaaaatccccactcacccttcccaggtggctgcaaaggatcactcatattcactttgtgtctgatcctggtatttaatgccatttgtattcatcagactaatggaaatatcaattaagcccagtcaagactagctcttagagcaataatggacacttgtacctgagctcagagcagagggaagaaaggcatctggaggtaaatggtgaatgacggtcaagtgactatgaaacctgcaagtgaaccaataaagttaaagtattggtacaaatttgtacacatttatatagccttaccaggtatagtcatcagtgtacaggcaaatgatttttttttttttgcttgagtgcattagagaaagtccaaaaatgcagtcttataaatcttggaaaactgcaatttaaaataagctgtggaagatcacctagcctaataattgaaccaacactgggatctagccccaaattctatcactgtgagcacacaggctcactccaacataggcggaacctcggggaatgatttctaaatatcccattaccataaaatctctggtatttgaatctcactaattcaatctggtatttgatggatgcagcagggggtggccgagacattcataaagtttgaaggtactttttcttcattgtttcctagttttccttgaggaatcagatgatattttgcatagttcagagtgccctccaaaagaaaatcaacagtttaaggagttttctgcattactgagatgaagtaagcttacaagctttaacttgctgcatatgtctctcattaaagaatcttccaaccttcaaaaaaaaaaaaaaggaaaaaaataaaagaaaaagaaatcatcatctatagctcaacatcaaacaataaaactattttcagccttccataccattaagaaattagattctatacattaatatttcagttatctggctttagtaaaatcaccttcaaaaagaatggaggtgaatagagataaaacatttttttgtagagtatatgggctgacatttaagtgagttctttagtaagagtcttaacatgtcatacatgagaagacaagaattttgaaagaccgattggtagattatgttaagacccacaaagcaaagtatgtttctttggtcccatgtttgtgtaggtctttgtgtctcacagccaggctctctgtgtagtgaagttagatgccctgctcaggatgtgttgaattgggcaaaaatccgaacccacatgaaagaacagagagctattcttacaaaacagcaggtggattgtattcaggaggagttccaggagttgctgcaggaagagagaaattccaggaggaaaggagggagactatactagtggtttagaatacggttagcatcagcagggagtcactagctccctctgctcctaccacaggcaccctggaggcacagaggctaaagggagccagagggactcctggacattagagggaacacagggttgtcacaatcgtggacgaaggcttatcagaggatattcttgttgttcacacactggtcagatgactgaggctagagaaagggacagagtaattctgtccggacctttagcatacaggaacctgaggaaagaccattccatactctgcatagaagtggtagccacaattcttctatggcagtgacaagatccgacatttctagttctctgtgctgatattttaatagtactggctcattgctgccattgagaaggcaacctagacctgagtttatttcagtccaacttgaagggagcaaatatatttttgaaaaagccaaaaacacaaaccaaaggtttctgagatcaatggaggagatgcctgctattccctaagtgtgtctaaattcctgcaccacttctgaaagttctagatgaagcgtcttcttacctcatgtggggagcagcacagttcaaggctaagtggaactggttaggggagagacttctgaagagtttacaagccttttgctcctagaataaaactcaatgtagctgatcttgtttcttccctcaactctgacttagggcataaagcacataggatgaaaattctcctttttaattcatctctgggttagagaatgtatatgtatatatgtgtattcacctgcactcatacatgtaagaacatgagcattgcgctatcagagaactgatgttaaaaaccatgaggaaaattattcctgctgggtgccatttattattttctgtgtgtttagaacttcgcttgagaaattctagattttgatgattaacataaaacacttttaactgggacattaaagaacgaatggctgtgtaccacttgggagatcacatggaactctttacttagggtccaagaagtctaggctggggctcatgtggaaactgccatcattaattttcctcataaagcattaatgtttccccatcccattgacagcttccattccacaagattctcagtagccactttctggcatttttttctcaactcataccacccatgaggcatgcacagcaaaaaaaccatcggaatttactgtgtaccagaaaaaactaacatgatttttttacaaaaatctgtttggacacggaaaagaatccagaaaagttatgaggctgaaatgctccagcctcatcattgcaatcatgaaatgggtggcggctgttgatttccctttaaattaaaaacaaaagaaaataggaaggggagaggcatgcttggttacatgttgcgcaatcgttgggctaacctgaaaggtcttgtctgggaggaagaaaaaataaaaataaaaaaacctggaaacaaagtgatacaaagatcacagcatttgaaatgttccagaactttccaaaccactcttatagacgctggttgggatcttccctaacacatcttccctaaaacaacagcttctacaagctattgttttcacagatatgtttcaactccctggatggaaaggtttttttaggtcctctctagttagcccctgttgcagtggggggatttttggtgcttatgttccaaacctccctggggcctaagtgctagtgtgtatttaaggtgctcaagactgagactagagggcccctctttcttctctcattctgatatggcaggtggacccggatttgcctgggcaaactctctcttacgtgttttctgctatgaacgtgtaactttcctacatatcacacatgatcattatattcttctccaatggaagaatcaaagtctattttagtagtagataaagctacacagaggcaaaatgactgcatcgtcaattggcagcccagcagacatgaccatttctgctatgaaaataatatttgttcatctgatgctgttgtctgcagaggcagctgttagaataaaaaagtgtatctgttgagcctagcaaagtatcacattctatttcttgaactgttttgttccagaggataattttttgtggaaaatctaacatttgatccattacgattctctaatgtagaaggcatctattagatacagcaaccatttacttgtttttacaaagtatcagatactggcagagtatgttcatgaactagtcatctgatttatttatacatttcatctataaaagttttgtgaagggaacatttaaaataagaaatttgccgctgtttgagccgaatctagaaaaatgttgtaactatgagttttgccagtggaagaataaagtcccttgatctcaacactttgacacataggtaacaaaaccaagatcacattttaccatcagattattctcaggagcctatctgatgaaaagttactatcagaaggttattccttctgctactctatgtgcaagcaaaaacataatagggattgtaataaatgattatatcaagcacaacaaaatactgagaagaaacagaatgttatctgttacagaggttttaatgaagggccaagtttccagcctcatttttaaacaatgtgtgttcatcattttcagacgatgtgtcatttggcaggtcaggaagatctccacatatagcaaagcattaatttccaagaataaaagaaggaggaagaggaggagaaggaagagagggaggaggaagaagaaggaggagaaggaggaggtgtaagaggaggaggaggaggattgcagagcagaaagaaaatgagagaactataaaataaaacttgtctgcattagaccctgagcaagatattagactgagagaatgtatctaaggttaagagagaataaagccattccgatttttcattctaataggaacctaatttatcccttaattagtaactgaaagagtttagttaaatattaagttctgaggaggagtcacttacttgttgttttgatggggatgactcagtgaaagaagataagcagaacaattttacttctcctgggaagataactggcatgagactacttcaaaaaaatcatattcaatacatataggcatttaatatctcaatcacttcatggtaactttgaggcttttcactgtgtggatattatgtaactcatgatttattaattgctcctattaatcaaaatgtaaactgcagaacccatacatgtcactaaatggcacggcactatgcatatctgaaatgcaggactgcctgcattatcgaagccctcaatgaactaagatttggcatgttggggaaaatatgtaaaagaagagatgataaatttaacttccaatttcttctagagaaggggaccttttgtgttaccattaaatccatgagtcaaagagaaaacaattttagaaaaagaaagctcaaccttgcctggcattttctgttgaaaatctccggaaaggcaggagaaaactaggatcactgggtcagcggggatgttctctttcttcctgcacccaggcaacagggtattgtatcttttctttctggtttttttttttttcatgggaaactgcaccacctcatagaagcaggtataaaagatgagcccagaaccccacattgagcctcaaaaaactttctgatccaatttctcagaaattttttccaatggaaagaaactattccttgaatatttagagcgacttcacataaaaagtgactgttaataaggtaatcttgcaatatgcttgatagttatttaatttattattaagttgtatcttacaaaggagataaaatgtatatactgaggaataaaagaaaacttcatcgattaacttataggcatgatttcagagacattatccccagagcctatgagtcactggaggagttccagctcaacaatagattattgtaccttttttttttttttttttggctgatggccacaatgttacaatggcatgttcccaggtccatctgtgtttttaaatattacagtaacaataacaataataataataattgagtattaagaaaagatgacattaaacagagaatgttgcataagtcagtccagcagaataaatgataacctagtctttgattcagtgaggctttattaggtgacaggtgacaaagattggacccatgtgtgcataatcttgcgtgcttcaggccaggcctctgtctgtgtagggagcaaagagacatggcacgcctaggtcagtcatacaatagaatcctttgtctcccctctgtctgttctgtgcagagttttttaaataaatactttttaaaaagccaaatagagaatcattttcagtttttaaatcaaattaaccccttttcccactaaaccaccataaattatagtctggataggaagaaaaaaaaagaattcttttcaactgtcaagtatttacatagaaattacagaagatgttatatgttctgctaaaaccagagacgaatgcttcgagagctttaaaacagagtcttttcttttccactccagccggcaattacagcaagcagactgcacccatggggtctcccggccaggatcctgctaagcgttctatctgtcgatatttcttgccatgctgagactttcttttgctttgtgcattcgagtgttcttgcagtcccatccctgggcaattagatgagatgccacacctgtagcagcctcgtacatttacacagttagcagctttttatcacaaatgccttctatggggacgcccatcctgtttccatttaaattcgtgaacatctgttacacaggagatgggttagctaccaagcactactgttagatttctcgccagcaagtctcattccttcatgtggtttctgttttcttctttaaacagttaattatgttttattctttcttctataaaagctaaatttagccaagttttgtactaatttaaaacattttctggaaatgacagagtgctatttttttttaaaaaagaggggggctgaattctaagtagttatcacaaatgaatatgaggggggaaacgaacatggcagcttgtgtctttaagtctcaaattttatttgatgtatgcagacaaacagcacttgagtcataaattcaattcacagtcattactcacatatgtgttgtgattcaaaggggggcttctgggaaggggggtctcctggctttttatcccgccatgttagtcacctcttagtgtggactgaaagtaaactccgaattctgtttgtcactggctgcagctgagtacagccgtgtgctatgtataaacattggcagatgtactgttgtgtataccaactgcattagcccatttgctgtttggaggtatctattatgtttgctttttaagttttagtcaacacgttaatataaggaggaaaactatagctctagtggacatgctgtatcccagtggttctcacctgggaaagattttacccaggaagggacatttggcaatgtcaggagacatttttggatgtgacatcaggagtaggggaggctaatggcatctaataggtaggggttagggatgagccaaaacatcctacaatacacagcatagctctccacagcaatgattcatccagcccaaaatgtcaagagttctgaggttgagaaaccctatgttaaccaggttacaaaaaaaaaaagtgtctcaacttgttcactgaagggctagctcaactattattgtcattcacagcaatcatattcttaccacaatactaaaattcctgaacccgagagttttgttgaatatgttcaaagtcatatttaaacattatttcatttctttcttcaacttccatataccgtatgtgtttgtgaaggtattatctgtgtaaaaaatcagaaactaagaaaccaggcacttgactcttaggatgtttggatatcagagtcaggatttaaaccaaggtttaagtccaaccacatcccagttaggaatcagcaatgctatgactccgtgaaggaaatcatggcagtggaaggagagctcacagctgtaggacccatttctcggttgtcttcaggctcccaaagaacacatcaactagaatcagctaacgcatgagtgacagattattttcattatagaagtgtatttctatttgctctctaagcctctttattaatttcactcttcaaaacatataccactgggttaagaattcattaaatgtaaagatgtcacattttgaatcatcaaatgtagaataaagacagaatcaaaaacatgaaaaaataatagcagtaagggagagagagggaaaatgaatatggggaagtctaaaaaatgaaaaaggggaaaaatgaaggaatatgcctgctgtttcctaatgagtagctgaaagtcttcaacctatgaagcctcctggatcatctgccaattgttcaacacaactcccacccctgccttcatcctctttccctgattcacaccctcatggcctcttttcattacagtcaaggtccatcccagctttgacctcatgaatccattatgccctcctctgttactgctagacctgcagacccagtgtccacaaagatgctcctatattctttattcctgcttctctggaatggttttaatgccccctaaagcaccagcatgtgaatcgacctttgtgttcatatcatggagtcctcttagctccttggtgcctccaaggccaagcttccatcacctgccaagacacagcgagctggaccaatatttgtgtggcaggttgggtgtgacatgaatgtcaaagccaccctgaattgagggattctgctcccctttgttgaacttcctttgggtggtaagccagacattgtcattcagcaaacatggtttcaataaatatctagatgcaatcaagagaaacatgaaaatgacatggcctcagtcctccaagagttcaaatctaacagaagggacaaaaagtgtcttagcctaagatgattaaaaaaaaattaaaaaaaaacttgactcaaaagcttatatgctttttggggtggggcaacagggtgtacagtcccaaggaagtaaaagtgaaagcaaaagaaaaggcacagagctagtcacagctcatgagaaacttagctaagcctttgctctctcaggacatacacagaaaagctgtacgaatctgctgtgtcttagaacaaaggcaagcaacttatctgctggattctccctatccactgcctctcattgatcaaaagttcacccaatacagtattaattccccctgcacttgcaagttgttacctggaacccccaggtagccactgggaaatccaagcatctctaagttctggccaagtagcacataggtacagctgactcctcttgtcagtgagcatcacacatgggaattctttggtctgtgatggcaatagcagcagctgtggctttatgacagtatcctttgccccatttccaaggccacccagacccagaagcaagacaaactcccaggcactgagccaggaaggtctggagtggtgcgtgaacggggtccatcacaccagtgagttcagtgcagtgtactgcatgcccagccaacccaaagaccaaggcaagacctaggaactttttatttcaaaaggaacataggtcttgaaaatactctactttcagctactatacgtcgaacacagtaaaacaacagtatttgttcccttttctggtaataaatcctaatgactccagcttgccagaagtcataaaaaaaacatcaaaacttgctgaaggattgataacatcccaccactcataaaatgtcagatgttggattcattgttagtgacctaaaacattagaaacttagattcaatggaaaataagtgtaaacacatcagagcaacacagcctagctctggatgtaatttgacctagttatgtagacatttggaaacactggcttctacctgaggggctacttgtagcatgtaacaaggacgcatctcacagtactcatgcactaacagctctgcagaagggcactgaaggttgaggaagaggtgtttagtttgaaacaagtccaccatcgagatgttcccaaccactaattttccaagataaactgttatgtcctgtgtgtatagctttgcaatcctgattaaagccaacagctttgggtgaacacacaccacattatacccatatctgtcccacaatttttgtgcaaactctcttaataccacttcaaaagcatgtgatcattatgcacacgtacatgtacgtactaaagtgagaaataggagtagaagtgaatgcataaaagaggatgcacatgcaataagaagagagatgggtataatgtaggacagactggctaattggtcagaaaatcatggatgagagaaatgggtaaatgggagaggagtatgggaaatgccgggggtaatgaggttccactaggcaccgttggttaacatgagatcagaagcatggcatgagcattttctagaatgtatcacttagtagtgagagacagtgtggggaaacaaacaggggtaaaatttagaaggaaggcaacttggatttgaatctcaactctactacttgagttagtaacctcagtagaaggggtataatattgtccccaatattagggagccataaagattcaatgatacattgtatcacaaatgatatcacataatggactcctcaataaattgtaactgttttacataggtaaagatcaccggcatggttttctaaaagaaaatcataaatcagctatatggaaagtgatatgcaggaagtagtcgtttagaggggagaacccacaacccagcagtggtataatggtaggtttgaagaggactggaaagctatgtctgaactggggacatctctacagagggccctgccaacacctgaaacttagaatgtataaaatataacttgtcctcttttcctcaaaaccagctcctcctcctaactttcacttactctttcattcattcattaatttattatcatatattactcaataaacatgtttataacatctatactgtaataagcactctacatgaaaacagataaaaagaatacaactctctataaattaattaccttcattataaattaaaacaccctctcaatcatccaaaatgggaatctcatggttatcatttgctccaaggcagttctaatgttcccacatctgcactgtccttaccttttcttatttaagctcctagtttattggttatcctcccccacttcagtccatcttacatatggccaagtttgcttcctaaaagttcagatgttgtcatattgctataatgctcaagactcttccactccccactgcctaaggaattcagtacagacttctcagggcgctttgaacacaaatccaaccactctacgcagccctatctcccactgtcccctccacaagcttcattctttattaagatggggactatctggtatgcagatagccagccacatcttcccctcttgcctgttgcagacatcaataattgatcacagcactcattcttgctgtgctcagttgtggtctcagtgtccttccttcagccaattccaatcaatcagagttgggaccccagataaaccttatttggccatccctcctctagtcatctcatcagataaaagaaccacagtctatttaggcgcatatatcacgttatatacatataaaatataatacatatacgtgtatatataatgtaatacatatacatgtgcataatacatatacattatatacatatataatataatatatacattatatataatatattgtatacatttatatatgctttatatataatatatacacgtgtatatattatatacatgtatatattatatatacacatatatatacacatgtatatatatatataaatgtgtatatatatataatgcatgttgattaacttgttttcaaatgcagacaaccctagcaaacaaagacactaccttccagacgcttagaaaaataataatattattggagggattctaaagaagtgaatcacctctaggcagcacagatgtgtaaggaggattagcacaacccaagtcaaaattccttttatgcgttcatcagaatgctgggctccaagaatcacatagagaaactcagaggtaaattagataatccttctactagacaacaaaacccatctgattccggcccaaatgagaagtgggtggcagtgatggggcctctcttgccaattctagccagctctgtctgctaccattgtgactgcttgtgatctcttaggatattggatgtgagttgcctggcagattcaaccaagaaagtttggaaggttaggatgaggaactgtcatcttcttcaaaaaaagtctaggaagaaatgggtgaccttacaattgagaaactacttctatatatggttcacttgcagttttcttccttgtcttttctcaaatctcaaaattttatctctgaaaggaattgggtggagtgtgtgtgtgtgtgtgtgtgtgtgagagagagagagagagtgtgtgtgtgtggcagtgtagccattcagtattcattccaattgaagaactcaatatgaaatctagaactctggactctaagtggtgcaacagaaatttccacgattatgtaaatagtccataattttacactgcctaatatggcggccactagccacatgtgcccattgagcacatgtcccctcttgcctgttgcagacatcaataattgatcacagcactcattcttgctgtgctcagttgtggtctcagagtccttccttcagccagttctaatcaatcagagttgggaccccagataaaccttatttggccatccctcctctagtcatgtcatcagataaaagaaccagagtctaggttcatactattcaatggctaatgttagttgtaaaattttatttatttatttatatatatatatatatatatacatacacacacacgtataatatacatatataatatgtatatataatatatatacatgtatatatgtatatataatatatatgtatatgtatgtattttttgaaatttggtttttgcagctaagaaattaatattaaatgacattaatttaaattcaaatatatatatttatttttaaatatatatctttatgagatatattttcatgagatatgtatatatatggagagagagaaagaatttattcttgaaacatatgtcattcatttgtccttacaaaataaagagttgtatcttattcttttgcatctactatagggactaatacttaaaaggggatatatgaatacttaaatactaggaaagtttcagaattttccgggatgacaacagttcaaggaatacctggatggcagcttcaggagctctgaagagctcactgtaacataaggagttgtatgtgtgtgttaaaaaggatagacagtgacagcagaagtgacttgggtaaagaatattcaactaaggtcttttgagaggctgtaagctggttcttagcctcatctcttaaaaagccaatttttgttcatgtcacttgttattctcagatgaattatatattgagtattttaaaaattttcctcactggtattttattcaaaaccagtgccagtctccagtgtcatgttgttcagccaaaaggtattccctcaaggtattgatctgggcatcttggcaatcatgaaactcaatggcaaaatctataaaaagtcaaacatatgagaatctctcttagataaagagcagagagatcagcgtcctccctggatgtactctttctctgttgtccctcacccaccgcccctaaaaatgtatttctgagaatagatctatttctgtgagttcataatgagtcaaattatcaaagccatgctatttccaggtgataaactgctggccccagcttttgtgtttttccttacagtggtccattctacagtgttgctatagaagtgttttataaccaaatccctaaataaatacactgtgattaagtcagacagcctgttgagaaccctaacgtgtatatgattttccagggaaggactgcatctaataatttgcattactgaatttgaaaggtaatctgcttctcatcttccatttttctggtgacaagttgcttcaggctgatgtacagagttgagataaagaggacatgcctagatgctttctacaggttcgagaatttaagagagaagggggagctctaaagtggatttgtacacaaagtgaaatctacccccccccccaaaaaaaatctgtagaaataagcttgcaatactctcagggattttctgagccccgaaacttaacactgcattgtgtggagactgttcttttttaatgagcttggcaatgaggtggaagtagtcattatgggataaccatggacactgaccacagctgtgggcttaacaaaaaacactactgttttgagttgtgcatcagatctttatctcaagaaacatataactttggccaaaaaatctaaatcagccttctagttgtaacttggccttttttttttttttaagatggagtcgcactctgtcgcccaggctggagtgcagtggcgcgatcttggctcactgcaacctccacctctggttacaagcgattctcctgcctcagcctccttacaggcatgcaccaccatgcccagctactttttgtatttttagtagaggcggggtttcaccacgttggccaggctggtctcgatctcctgacttaaagtgatccatccacctcggcctcccaaagtgcttgtattacaggtgtgagccaccgcacctggcctcgtaacttggcccttatagagatgggtatcaagataaagaatctatggcaagaatattttacttcaaattctttttggtagtatggccattcagtattcattcagcttgaagaactcagtataaacctagagctctagactcttaagtagtgcaacagaaatttccacaatgatgtaaacgttccataactctacactctccagtgtggtggccactagccacatgtggctactgagcacttgaaatttggctattgcaactaagaaactaattgtaagtgatattagcttaaatttaaattatcacataagactagtggctatttatggatgttgtcactccatagtgatgactaattctggccgcttattgaagttacttggagaactttttttaaacaccaaagactgggtcctacccctcaaggattctgatttaatttggtatgataaatagcctgtgcattacaattttttaaaactctccaggcaattataacgtgcagtatattttgagaaccactgttctagagaagacattgccagagctaactcgctggtccatccattagctgtggatggattcacatctctgaatcttatcaaccaaatatacagtttgatttgtgtccccaaagcaagctcttttcagacaacagccttcacgagcctactatgtggcaggccctctgtctatactaacagtaccattaatgtgctctaaaatattcattgtatggtgctctgcgcttgcaagcttccatccatgtccaaagtaaatggcaaattcgaggcaagggaaccttattgaattcagagtctgaatatacaggtaagtcatctatagtcaaaggaaaaggctcaggagaaatgagtagccccctgcatccacccaaggcgcagaggagaagagaaaccgtttttgacccagggcacttgcatggcactcaccaacatctgtccaagacaaagcataatgtctgggaaactagttgcatcatagataagagtccgcaaatgagaaatccaattcacaaatgaacatcagcttgccctacacgtgcgagtccagagaaatcacacatgtggcttggtgtcttgtgcattctgtgttacgtggagtgtggcaagggaagaggaggctgaagcccagcctgttactaaatttgttaatggtacttcccaagactgacttcttttcctgcttcacaatcctgtaaactccagctctttaatggcctcactttctttatgaattttccccctgctcttataaagtgggagtcaaactttctgaaatacttgaattcacactttcttttttttcctactgctggcggagcaactctttgggcaggcaactggttcctcagcactaaacgactcattccagcaactgacctttggacagtgctttagccaaagggacctctggggaaaggaaatgcagtgagagaaaccactccagaactgctgagccaccctttgtagacactatctgcagctcttccttgcctcacacttttctgttgagtagttttgattttctctctaaggtgctgatgtctttagggaatgtctgttttatctgtctggccaatggtgaaagctaaatgctttcaccattcttcctgtgcttagaaaagaaatcctctattaaatcttcagttcttattgcattatgttaaatcccacctggagagactatttcacataccttaacctgatatgttcaaaacattggttaaaaagcctgctttataagaaaccccaaagagctttagaaaaacacaatttgtgtttgttgtagatcaaaatgctgacagatttagtcaataataaatatgtgctgtagaaaaacacaatttgtgtttgttgtagatcaaaatgctgacagatttagtcaataataaatatgtgctgtcttttttttttttttttttttttttgagactgggtctcactctgttgcccaggttggagtgcaggggcatgatcatggctcactgccctactgggttcaagggatcctcctgtctcagcctcctgagtagctgacaggcatgtgcgaccacttgggctaatttttgtatttttttgtagagatggggtcccactatgttgcccaggctggtctcaaacttttggggtcaagcagtctgcccacctcgacctcacaaaatgctgggattacaggtatgagccaccacgcacagcctgtcttttcatattaagcacatttgtatttttaaaatacatacttttaattattaaaggaatacataatttttttattagaaaatataattaaagcaaaaggttaatcaaaattacccaaaatattaccatttagagataacttctgttaacaattgtgtatatgttctgcccttatttttgctttgaatgactgtgataagaataagttaagtgacagagaagcacagcttttccatggcccaacgagatgcacaaggaaagcactctatagtactagcctttgggaaaaacaggtgactctacacccttctgactattgtgaactcccatctccatttcatgcacccattcaacatttacgtaccaattatttctcgaacctctttctgagccatgctgtaatcatgctaaaatatttcatcatttttctacctctaaggatcttacaatataattagctgtatttggtccctagggctgccataacaaagtaccacaaactgggtgacttaagcaaacagaaatttattgcctcaaaactttagaagccagaagtctaagatcaggaagagccgggcttcctctgaaacaggaaggggagaatccttccttacctcttcccagtttttgatggttgccagcaatccttgacactccttggcttgtaactgcatcacttcagtctctgcctttgatatcacaaggctttctcccattgtgtctgtgtcttcccatggctttcctcttcttatgagaacaccagtcatcttggattagaaccctccataatgacccatcttaacttgattataattgcaaagaccctatttcaaaaatggtcacattcacaagtaccagagattaggacttcaacatatcttttaggagggacacaattcaacccataacattgaggaagtgaaaataaactcacatgatccaattcaagagtaatgaaagacctgtataattatgttttcagatacgtaacccaaactaccagtgctatggaaattcatacaactgttctaaaggataacatagtttgggaagagtttatggacttcattgcacctgcatagaactcactgggaaacacagattggggatgttaaggactcaatgtttgtatcctcccaaaagtcatatgttgaagccctaacaccccatgtgatggtattaggaggtggggcctttgggaagtaattaggtcatgatgatgaaatcttcatgaatagaattagtgcccttataacaagagacatgagagcttgcctcctctctctcacacatacaatgtgaggatacaatgacagcatggccatatgcaaaccaggaagcaggctccctccagagctgaatcttaatcttagacttcccagcctccagaactataagaaataaatgtttgtagtttaagccacccagtctattgtaatttgttatagcagcccaagctgattgagacagggaagaaatggaaatttcaggaaagagataaaattgaactcttcagcataataaacatgatactccttcaaatggctcccacgttcctctttggtctcatgcccaaggagactttttcagtgatactaaaccgcataggagtctcccaaacaccttcttcgtttgtaccaccatgactgtgcacatgttgcttattccaactcgaatgtctctcctcttctcatcaccaacacaccacagccacaggtcaatttcctactgtcctttaacaaactctaccctgatatcactagctccaggaattgtgtgccttccaagacaattagtcaccagccaccctgtgccacctctacaccttgtagctattgagtattaacctgttgtaccttaaggaaagagactgtgttccattcatctccatattcccaacacagagcacagagcctagcacttagcaagtggtcatcaaagatgaactgaaatttagttgaaatgaattgaaggaaatgaggagaggagctaagttgggcctagcaaagggacaggatcccaagttggattgatgggtaagctgttgtgaagagaagttagccatcataggggaagaggcaaaaccaccatggcggggggtgggtcactgagtgagtaaaggccccaacttgtgaactgccctgtcacgtatgaaaacacaaaaatgtcaatacaacaacagcattagattcaagagggggaagacaggagatgtggacagtgggcccagtggccaggacctcctggcactggggactatagaaggctttcaagcagggaaatgtgttcagattttaacgcgagagacatggctcagcagcagcgtggaagatggcaaggtgggagtcaaggccaaatcgaagagatctactaagtaaactccagagaccagcagtggggaggaggtgagggacataaccagaggatggggaggtggtaaaatcaacagagttgcagtgttgggaaagaaagacttgagcttttgcatttgaatgatggttgacagaattgctgttcactgaaatgggaaatataagaagagcagaaggtatggggtcagccacaagttcaggttggcctttgtgcaccttgaattcccgtggaatgcctagactttataaactaggtcaacaactaggttatggtttttagagtttggactttttttaagtaacaactataattagagttttgtttgaaatgaagttctggctgttcagaaaggtgccacaagttttcatgacgtcacaacttaaaaacgtgcataactgtcatcagggtgaacagggccggtctcatcactattcagtttcttcacaaatccaattctgaactggaaagaaatgaaaaccacaaagctaactgacagtgacagcccacctcttaaggagcccaatttaaatatagatatttcatctttactgttgcacaagatgaaagggaatcagcagcccctgggtgcttgatagtcattatttttcttttggggcacactgagctatacagccacccgtcctaacggccaaggataagccataccataacagaggtaatcaagacataactgtatcatgctaaggtgagaaagttggctgttagggtctaatacataaataggacattggtaatgaccatctgtagttttttgggcttacatattattctaatcaaggccatgccaattgctatctattttctccctctataaaatagggtaatcatagaacctacctctaaggattgttgtgaagatttagaatgataatgaaggtgaagtacttagaatagtgtctggcttagtataagcgctcaatcaatggtagatacttattcagtaaaaatgattctgatgttttccatctgtttatgtcagaaattcccaagcagcagaaacccaaattgagcagaaaatatccagcctctccaggtgtcactggtgctatcctaccagaaggacaatgaggaagagatgagggaacagggggcttccccaggcctcaccaccaggggggactccagcaggcaattgtggtgaccctacttgtaaggacatcttgcagttctccaaattcccccatgctccttcatcagcccatgtgatgtagatcactgtttctctctttctggaagactcttcaccccttctctcccttaccctgttaatacctgcttggaacatcaatgtaacagagtagttaagagctataaagtgatgtgcttcttactaggtatgtgaccttggccaaactaatctcaccaaaccttaattccttgtctttgatataaagacagtaaagtacctacctcataaaactattaaaagaattacataaaataagagagatcaagttcctagcccagggatggtacattgcatgcatttctcttcagttctggtctctccaccgctaccaaacccctcctgacaatcctggaagggcaaagcacaactgctgtcttctcctctagaaccggcacacaccttgcttgtggcacacagagcaccagcctcgagccccccacttacagtcctgtctcctctgttagagacacttgaagcagaatcctccagatccagcaggctgctcagtacatgctgggcggccatcaagtgtctattaaagacatagatgaatctatcaggagggttggaagtattcaagatcaattaattaatattatcctatcctgccacagattttcaaaagggattgatcatagttgagtctgtcacaatttttaaaaatcaattatgtaggcctggtatggtggctcacgcctgtaatcccagcacttcaggaggccgaggcaggtggatcacttggggttaggagttcgagaccagcctggccaatatagtgaaactccatctccactaaaaatacaaaaaaattcgccaggtatggtggtgcacacctgtaattccagccactagggaggctgaggtaggagaatggcttgaacccggaggcagagggtgcagtgagcccagatggtgccactgccctccagcctgagcaacagagagagacactgtctcaaaagaaaaaaaaaatgattatgtcaatagagtgaataagaatgtttatatttgtgcactcttgttcatagcagcatgggtcgcaatagccaaaaggtggaagcaacccaagcccattgacacacaaatggacaaacaaaatgtggtttgtacatacagtggaatattgtttagccttagaaaggagggacttatgctacaatatggatgaagcttgaggacattataatgagtgaaataagtcagacacaaaaaatactgtacaatttcacttagatgagtttcctagagtagtcacatgatagagacagaaagaagaatgatgattaccagaggctgtgggggagggggaaacagggaggtggtgttgactggttcaatgtgtaaagagttttcatttgggaagacaaaaatgttctggagatggaaggtggtgatggctgcacaacagtgtgaatatatttagtgccacataactatgcactttaaaatggttgggttcagtggctcatgcctgtaatcccaacactttgagaggcccaggcaggcaaatcacttgaggtcagttgtttaagaccagcctggccaacatggtgaaaccccgactctactaaaaataccaaaattagctgggcatggtggcaggctcctataatcccagctactcaggaggctgaggcaagacaatcgcttgaacccggaaggcacaagttgcagtgagccaagatcacgccactgcactctagcctgggtgatagagtgagactcagtctcaaaaacaaatcaaaaaacaaaaatacaattgttaaaatggtaaattttatgttatatatatatgttaccacaataaaactagaaaaaacatgaaaaaatgtttatttagctcctggtatttacacaaaaggactttcttagtgagtatgtggcttgcccatgtggatgtgtatatataacttctcaacatatcacatcacaagagaaatagggatggcctcagaacgcaagtttttaactctaggttttatgtaaggaactgaaaagttccttaacaatctaaaagtttaagaccttctccagacagtcataccaaaagatctttccaggtgttcccaggtatgtaaaatatacagcttaaatatgaaacaaaggtacaaatgcttacatgggattttttaagtgactatccaatttggtctgaaactggtaaatttcatggtgtgtttccagttggaagctgcccccagtaggtagtaccaaaatccacaagcattttcattcttgcttcacctcattgtgcagaaatgggacaatcaccgtctctaataatggccataatttgccatcaggaggagaaaaggctggggttttgggaaagaccttggttgtggaataagaaaatagtgaaagaaacaaaagagagtgggagtaaagcctcaaagtgtgcctacgtgctaaaatgtatctttgggaaaaaaataattgggattcccaaaattggtaaaatagtatggagccaagtttctaaatatgaagagtacttttttccttgatgatggttattttgctatgtccacacaccacacatgcaattagaattcatttcagtgtttctatctgcacctggaaggtcagctcctgaaaggaagaggcttttgctgtctgattcactgcccaagtccaagtacctaacgcagagcctggcaagaacatctgctcaattaccgtgaggaaggaaggaatgcttaaacctactccagtatgtttcaaaaatacagcactaattcaggatgtgcttgttcctttcacaatttgattcacattggaaaagtttcatctgaaatagttcgttctaatgtcctacaatcgttattttgggcaaaaacctaaatctaataatactcaattatcaagcatcagttaccaaaatgcatgccacttcctgaatctaattttgtttcaattctataaggagaccactcaatcgaagaagaaagtatttttatctccatgctaatttggtaaatcattttttccccggaagagtcaggctctgctggtgtgagccaaatatgtggtgagaataagccactaaggagtgagtgaagcccccagacttattgcagcaaaaggcaggccaatggtgcctggtcaaacccacagagagcaggagcttccatgcaaaatcgatatagttatgtagtaagtcagtaggtcaagaagtcaaaaacacgggatgggtcccttatctgttctccagtaacagggctcaaacgtaaaatgtggtcttgaatgagtgtagttgtcttggttctcactggtcaccagatcagggatccctcacaaaagtcccttctctccatggtcatcacttttcaaagactatacttgcaaatccaccttattaagtttgagtaccaagggaaacagcttcgactagttaagaccatgcctcaggaaccaaattgtctaggttcaatcccagctcctccagctgtgtgatcttaggcaagttaatcaacaactgtgtgcctcagtttcttcatctgtaaaattagtgtaataggaacaatacctacctcatagcattgatgcgaaagtgaaagccctttttgtgttcatttataatgaattgatatattacaacagtgtctggcatatactaaacattatgatatatctcaaaatacactctactgtcatttcacacatacatttcatgtatccttttattgtattttatttttttgagacagaatctcactctgtcaccaggctagagtgcagtggcatgatctcagctcactgcaacctccatctgctgggttcaagcgattctcctgcctcagcctccccagtagctgggactacaggcacaccactatgcccagctaatttttgtatttttaatagagacagggtttccccatgttggccaggatggtctcgatctcttgaccttgtgatccacctgccttggcctcccaaagtgctaggatgacaggcgtgagccaccacgcccggcctcatgtatcttatttcatgtacttttttaaatttgtgaaagatttacagtataggcctcaggatttcaaagccatgatattccttcctaacaaagaataaaatcaagggcatccatggcagcacaatatataagataagcaaattttaaaactaaaataatctgttaaacatagatccttccttccacataacccttgcaaggggggatgactatttcactgggtaccagtgttaatctggcaatgctgataatgatcagctacatttttttcaactcagaccaggggacaattgtcacaaacctatgttgagaagtctccccaagaggttttcaaggtgagaatattgtcatgcccctgcatctctcatctcatgagcacccccaagggattggggtgcttggattattgcatagcgatttatcagatcaacttgaccttaacacacagcatcatcacttgggtaaaagccaaggacttttttttttttttttttttttgagacagagtctcaccctgtcacccaggctggagtgcagtggctcaatctcagctcactgcaatctccgcctcccggattcaatcaattatctgccttagccccctgagtagctggtactacaggcacccaccaccaagcctacctaatttttgtatttttagtagagacagggtttcaccatgttggccaggctggtattgaactcctgacctcatgatccatccacctggacctcccaaagtgctgggattataggcatgagccactacgcccggccaagccaaggactttataacaacctctcattcttctgtttatgcgtttagggtcctgacgagccatcttacaaattgattctgacttccagtgatgatgattgacttgcctttcatactgaccaagccccacattcatttcaatgcttgtatgagggctcaacgttccaggctttctcgcttgctttctttatgtgtctgaccacctttccatctgtctatcttctttgagatatttctgccaagaatgagagagatatcaagggatgttgtcattttattaaatttgttacccagcagaaatgcctctgattgatgtagtattaaaactctggtcagcatttctcttactgtctaataaccagtcacgcctttaggtgtaggatgtagaatgctaatgcagaattccaattctttttgttcaactgaaaactgcctgatgatttgcaatcatcccagtcacccaggctaaacacctggacatctgcatctgtgccctagcctcaccccaatgtctaggctccaaagttctgagtgtcctctttcaccctgtctccatctgctttctctttccttggcttccacagccccttcacaaagacatgtgccctatctcccagttggccgatgggctttcaatctctgcctactcattcttttcactgattcctcaggctctacctgaagcatggtcacttaggtttctctgctgctcagagtccttctgtgatgcccacctgcccatgggaaagaagtctccaaaccctagccatagacttagttataggacttctactgtgtcggaacagcatggggtcacagcatggcctttgctattttcagtcctgaatctaggtcctggctctgccacttgctggctgggtgttcttgggtattactgaccctccataaatctgctattttatgtataaaattagagcaatcatgatgcctttcccaaaaggattttgtgagcattaagttagataacacatagaaagacctggcagctcagaaaatgccgccgcgacccagggctggcctcccttcctggccttctgttctgcctgggccctctcttcccatgctgatatgtcccgcagctgcatccaacatgtgccattccgtgacatcccctgtactttccctcttccttgactttgcttatgtcatgtgagctagctcaaattcctttcccatttttgcctgtctaaaccctgcactctttccagactcaatctagtcatcatctcctcctccgagcctccctcctcagccctttcagatggaactcatttctcccccttcctgtgctcccataacacttgccttatacctctgtgatctcattcattgcattctacatcgaactctcagtatttggtaatcacactgccacttccactagactgtgcatttattaacagtgagggaccatgccttcatcaaatgttacccctcaaattctccaggacaggactttgcccacgggaagggcccatattatgttcgttgaacatggggttcatgtttgttgctttcttccagaactctttagagtatattaatgatcaggtaacagaaattatccctttctcccacccgtgaaacacaaacttatagcagctgtaatgcagccctgcatttaacaggggatcgtgtgtctgacatgcaataccaatgagccactggcgttgcctttcacttgttgtgtcagaaaatcaatcagtgacttcagcaaaatcttgaggctttctgccatcactagaatcatggtaaataattcatgactcttccccctctccccttccccacacacacaaaaaactcttctattcttaacccaaataactttcagaatatggattactgaatctgcttggatctcattactgtactttcaaagagttaagaagacaacctatatctctgggtaaaagcttttcacttccaaaaacgaggaatgtgaagaggctgttgatattcagcacttcagaccccagagaatacttttttcatatttgtataatgttaacttttgttctctatctcagcaaaataacactgacctaggaaaaatggaatttgcaagccttaaagtttgaagataattataaaatgagtcacccaaacatcattgatctcttgcacttattcctctggtctgacaacaccttccactttgccaagaaacaacaaatatgttaaaatacatgatcaaagtagtcatgtgattgttaataatattttacatttgcatagaatgcttcttcacatgcttttaaaatgcttttcccctttgaggctcataaaacaaccattctctgcaattaaagcagattccatgaacatgagtctttttgcctatttgtgtttaggctggacaaggaagaatgaatggtcatgtaaacagttaccagaggaatgtcaagtattgtcctcagctcagcaggaccagatcagtgatgagcttgactttacctgtgaagtgcttcctatacacacctcttcttcctcataaagggtgcactcccttgtctccacatagtcattaattcttcccttcaattttcctcctgtaagttttggtcagaatttaagatgtttccaaaatattgaaaaatcaaatagcataatatgttaaggtttttaaacactttttctacatctttcttctggtactttgcaattaaaaaaaaagttcaagtcctattaactgggcaactgctagggtaaacaaagtctaaaagcggtctcgttgaatatctcatttagtcctcataacggtgctgtaaaggaggaatcgttatcctcattctataattcaggaaactgagcacgaatgaccaggccaaggtaaggaacacagctgagaagcaaggcctcagctcactgtgcatcaggtttaagtgggctcgttctgccatcatcacatgtcctggctttacactcagattgaaggacatgcaatgaatggcagccctcttgagttccaaatcaattaggacacaggcaaaaagaagtgggacacatgcagatccaaatgccagctcaaggccaagttgcagaatggggctgtgaagtgcagccacacaggcttcccaatgctgaattctctcacctgtctcaggcgcagttgaaccagtgtaaaacatgccacatgaagacactgaccagaatgtgtgcttcctgcaggcactagctccaagtggagggagggaggagggaactgagttccctgagttgccacttccttctcccatacgcccaactgaccatatgaaggggagaaaggccagagtgatagctcccagaagtggggaagaaatgctgccccccgtgaaatgaccctgtcaagagattcatattgtgggtacagtaggtgttgaaatatacatggtgacttcctggcagttacaatatcatcctcatcacagaattgccacacaaatccctacagaagccaaaatgtcaggaggtccttgttcctaatgctccactgactcagtgcatgacccagggcaagccacttaactaatcttggtcttaacgtccccattaatagtgtctgcattgttgatgggaatcctccctgtgtataattcttctatcatggaatgtcaatgaatggatcttgcaaactcagctacagacaaactcagctcctgccaggagacagccgctctcagaacaaagctcatatttgcctccttccaagagtccttagcaaaccacgttttgatggaatggctcctgcttcacactgactgagagagaattccctcggcatagcctgagtgactttaatccagagtgttggccatattgagtaacagtaggttattttatgcctcctgaatgttcgaagtctgagcagctacacacactggaacccatattttaccccattgacagcctggaaaggacatatggtttagatttttagacaacacgccatgtaaaaagcctttccttttatagaggcatatttttagagtctcctaagctaaactctgggtggaatttaatccatacagccctcggttcaatcaagagccaaaacacaacttcgtgtcagtgtaatacattgttaactgatacgtcagaaaatcaattaattacttttaagaagcaattaaaagtagccctacgatgctgccatgtgaattattaaagaatacaatgtaaagggtccccatgcccaccccagattgaaaccttgtggcatagggtggtgcaaagtatgcattctgccctgtctcaactgaaattagtgtgagtttgaaggggcaaaaaagtaaagagaaggtgacgaggcttaagacgtgtggtgtccagctgacgcagaaggctgcagatgccaccaaccactgttcccaaagctgacactcctggcctggggtttccattctgtctctacaccatctctgcaggagatccacttccatctgcacctctccattcttttgtgggtgaacagccccgcatcagaacccaacaggtttcttcctttcctgagcccagttcatcccagagaaaagtctacgcaaagccactgctccctccttctcctgccattatttctcttctccttctccttctccttcttcttctttttgagatggagtatccctctgctgcccaggctaaagtggagtagcacgatcttggcttactgcaacctccatctcccgggttcaagcaattcttcctgcttcaccctcccaagtagctgggattacaggtgcccaccaccacccccagctaattttttgtatttttagtagagtcagggtttcactatgttgaccaggctggttttaaactcctgacctcaagtgatccacctgcctcagcctcccaaagtgctgggattacaggcgtgagccatcacgcctggcctctcctgccatttctatgcctgcttctagattaaactagaccaggtgaaggccccccagccccaccccaagtgaaaggccaggggcttctccccacaccctagtttgcatcggtttggaatgttgagctcagatccaatcactactcatctgttcatatcctatctgtcatcacacatgtcctgtatatctggaaacaattacgtgactgatccggagtttcaggtatgcatcagatgtgtgctttccaaatgcctgcatctcaaagactaggaaggcaatgggaacagtcttctgagggtgtaaaaagagggacccaggctggggcaatgggactgaggggactatatagatgagtcttccttgctgtgtttctgtagttttgacttggccagaaatgttttccatcggaatgagaaaaaccatatatttgcataaccaaaacatcggtgcaatatgttaagcagaggcctcctcgacctactggccagttgtggttgccactatgccagaaactcagaagtggttgcttaggttgttgaccgcagcaacctctaaagccctcagggcacccaagagtatcgcaaaacagagaggacgggtgatggagatttcccaggcttctagccttactgccacccagtgatagaagagtaagtagcaaaggaaaatattttttcaccactcaatgcctggcagtcatcatctccttgctctgagatctaggatgcctcagggtacgtaggctggaggaggtggcagctacagttcattgtcatcgattgattcattcattcttaagaagtgtctgttgactatctactcagttccaagcacttttcttgatgctgggcagtgaacaggacaaaacttatccttcactccatccactccctctgtcacttggaggatggacaacaaatacataaacacagaaatcaaataagacaaatgcaatggtgaaaagaaacccgtgcatgtgacatgatagttgtgatggttcaggggtagggagcggggttactttacccattactttagtagatgacggttgagcagccatggggaaaactgggggagtttagagacaggaaagtggtccaggcagaaggaaagcccctgaaaaggtcctgaggcagaaaaagcttggcgcgtctgtgagacagacagaggctatggcagagcaagccgagggagacaggtgctcccaggtctaggtgatgggctgggctggtttcctccagggcctggaattctgagtgccctggaaagccgtcaaggagtttgggtggaggagagacacaatctaatgtgtatcactctctggctgctttactggagtggggcaagggcagagctggaaggatggccaggggttcactgcagtgtggggaggagacattcgctgcccaggagggttggctgcagaggctgttcctcttttctcccagccacaaactccaaccctgagcagactgcagagggttcctctatctgagtatgggttcaaatgcagctgtcaggcaccttggtggatctcccattcctctgtcctcatgtatgtaagatctccctcccagggttgctatctatgagatgtctggtaatagacgcaggtggcagctgttgttaatatcacctttgttccttacctgatcccaataaatgtattgtcgacattgattttcatcaacctttattcagcaaatatttgttaagcacctactcttcttctcctgggtcctgtaccaccactagaagcagctgtatgatgcatatcaggaagagaccccttcccacctaatgggatagctcgtcctgcccccagtgaactccaaaaaatgctttctgtgccctctttgcaggccttttactgaaatattatgcgatatttaaataaaacatcagtatgagctaattggaaggctgaggcaggaggatcaccttgaagccagaagttcacagccagctggggcaaataaggagacctcatgtctaaaaatgtttaaaaattagtggggtgtggtggcgtgtgtctgtagtcctagctacttgggaggttgaggtgggaggagcccttgaacccaggagctggagcctgcggtgagccactgcactccagcctgggcaacagagtgagaccttgtttcaaaaaaaaaaagaacaacaataacataacgacaaaaaatacaaaacaccagcatttgcattcagagtcctgactggaagcatgtgattcaggagcaagcccgccctggacatggtcctggcctggatgaggactgaggctggcatccactcacagggcagcacctggaccctgtccagcatctgaagagggcttcatctggcacagaacaattgcagggtttcactggggaagagcgaggctttctgtctcaccctcatgtccagggctggtgacagagaggacaaagggcaaccgacagtggcttttgcctctgcatttagctttcattatacagttcttgacttcagaaagacagttcatttgtttcttagttcccagaagccaaaatgaattctgtaccagaaaaaaaaaaaacagttctgaaaattatcttcattgctggagtttctatcaggaaattaccaaaaggagaaaaataggacctgggagagtcctgagtgctccagccagtgaggagaaggtggagaaagcaagagaagttggagccctttgctggcttgccagagactgggagccacatggatgtggtttccctgcaacagaaggctaagggtgagctgcaaagtctgagaacccactgggaagacagcactgaactaggaatatggcgagtgttccagctggtttgtagaagctgacttcagagccaatttatgcaaatcttgatttgtttaaaactacattaatcactggcttctttcagtggccaagctggcctgtagaagttcctcacactgcaaaacactgggggcagcccaggcacagcttggtagataatagttgaagaagaaggaggaggaggaagaggcggaaggaagcaaggagggaggaggtaaagaagaagaaaggaaagaggaactggaggagcaggaggaggaggaggagacaatggagatcatggtgtgagcagaggaaatttgatgaaaggacccagaaccctaaagattaagttttagtcttgctaaaatgtatcagcttggctatactttgcaacaatgaaacaagctcatctctcatggaggatggccctctgtagccagagacccgggggacttgcctaaggcagtcttccagactcagctgaagaggtcactctggagaagtgcaggttatcaaatagaacaccatcttttttttttttttttttttgaggaacagtgacctggtctgtataagaaagtgatactctgtgtttgtagccacatgtgagctgcactgagaaattgcctctgtgcccagagaaggaaggagtaccaccttcttcatctatcccatcctatattttcactgttgcagaggagggtttgatgtgagacatgcaaaaaatgacaagggaggaacaaagtaataaacctatctgatgtgctccaagtggattctctctgttttccacatttaaaagatataagtgatatgagcaagcattttaattcctcaagcaaggtttgatactcagttccagagatcaccatatcaaaggcaagcgaagcaagaatcttagggtcgggtgtactgtcaggagcatggggactgcacacgggagtgaacacagagtggtcctggtgtactgtcaggagcatggggagccacacggatcagaccccgaaattagccctacctgcaatgcggcctttagtacaatcctagacaagttgaactttaagattcaggtttaatttgtgcaaaactaaaaggcataaattattggtataggataatctattgcattatcttctaaaggtaatgagattgtacatcttacccctagcacacacatacacacacacagacacacacacacagacacaccagccccaagaaaatatagaagaaaggtcaatggctctgttcctctttctttagaattataagataagcctgttacatatcctgaatcattggtcccattctatgtatatgcaaaagaagttcaaaggctgactttgacaaagggtgtttggagaaggatgataaaatgtgtctgataaaacaaacacaaaagacttttgcaataaagacctacaaattgggaaagcaggacttgggcagcagggtgtgaaactgtgttatctacagcttcagcacaaaaagatagtggcttgcagcagaagtctttatctggccttcacaagaatggagattgcacctcccccgacccccctgtccacaaaacccaggaaacaccttgcagagttgatgcaatatttgctatcccagcccttggtgacagttaaaatagtgttacaacataaaattgagcaacgaccttgctgtatcatccaagactatgttttatactactttttttccccgaggacattttgcacattttttagttcctcccttactttcagttcagatcattaatgggaagaaacattgtctcttcttcctttccaatacaatttaaaaataccttcctgattgacacttcaggaagaagattaataatagttacccttttgcatctcattgcattatttcttgagaatttcaaagaattctctgtatctcttcttggagatgtatcattactctgttcgaatgacttttttggggctggagtttaatttatgtgattgcaatcaggaaaccactttgaaagggaagaaatccatttagctttgcatgagttgtaaattttctgtaaatacaatttcataagaccctcccttttttaaagaagtagcaaaacggctcttggaggagtggcagagcatgggggtggaccacaaattcacaggtcagggggtcccagatcagccactgtttcgggagcttagaagagccactcacttttcagagcctccttttccctctataaactaaatggattggacaaaatgtttgctaagaatcttttcacctctaaacaaaatgacccaatgtttgctaagaatcttttcgcctctgaacgaaatgacccaatgctattccacagaaggatggccttcaaaacagcttcactctgttttatttcataataatccttcacctctcatgactgtttagcttgacaaggcacttcggcagttatgatttaattggttttcttgataacttttacatggcatgattttagacttggcaaaggtggaagcggaggcacagaaaggagaacttcagagagtcacagggagccaaacaccaagtcaagtaacaaattgagtactaagaaaataagacattttaggctagaggcttgcaaactttttgaatagcaagaaacagtaagaagtaaatagtatgccagggctcaggggagatacatcaatcaaaaaaagagcttcaggaagcagtattcacccttactactgatgaagcactctattttccagttattctgttctatttcttcttcttaccttgcttttgttattattattattaacaaccaatctatgggtcacaacctattgtttagaagtcactgtttagaaacttttcacatggcagcatacttctttttgctaaattagaagtctatatctccttctctgtgccccttacctgtgggcagatgctaagtgggattctcctgtttaggttttcttgctgtcaagagcccccaaagactgtacaccaggaaagtgctgtccttagagtcaaggttttcactgaagggggcacatgaccctcctggctgactttgaatacacgatcaagtcctcatgaataatgaatactaatgacaatatcaaaacacctatttgcattgtacactcactaaagtcagagggagaattggggctgctcccacaaaagggcacgtgactctctaaataaagagctttaatgcattttatatttaaaccataaggccatgggctcaaacccaaactgagatgggctctgcttcttaagtactattctggaaaggcattgaaatatttatccatctatctgggttctgtgtttctaaagcagttcctttccttgtactgcaatccagagtgggcctgtttgcaaatcccctttaactggagagtggctgcccttcagaagcaaaaggagtcctttgggaaagtcattgtctatgaaacttattcaatgagaactatgaagaacagcctttttttatttaaatgcatgtaattcaaagattgtctactctgtgcactgactgggtcaaattcttactttcactgctccatctctatgtggccttgggcaagttgtctaacttctttaagccttaggggataattgttcctaaattaatagtattaccaaaaggattaaatgacataatgcacagaaagcccttgccacaatgtctgaagctcagaatagctcagtaaatgttaaggacctctactatttgtccactaaaatttgctcagttgttataaccctattagcacaaataaggcttttgcttttgaggaatgaattccacagctttctctgtcctcacggactagcaacacttaatggattcctagtgacgaaccaacccagtttcttaaacccccaaacctgtcaaaacccagcataacccaaatctaatgcattcgtaggctgctgttctgctacccagtctcttcctggtatgataaactgttttcttgaccaacaaagccaatagtatgtacacttatatattagtttaaaaaatagaaaagtaccacatttactttcgaaaatccaaaactttgtctcaaaggggaattcaggttattttcagaaatactgaagctccttcccttttgttcatagcaaaataaacagaccaccaggagagaggattcttgttttataggttgctatagaggagttatgtgaggtatacatactcagggcttcaacatttaaaatttttaaagatcagtaaagagaggatgctttttttctagagaagtttttatttttaggttctgtagggggaaaagctacgtgataagtttcagatgatccagcattttctagatatttatcccacacttaatttttttagatccagatatttcaagcttagtaaaaaccaaggaagtattaacttttgttgtatccattctctgtaactgaagaaccaatgtgcttttatgcttccatataacttcctactttgtatccaaatttcctaattttactcataagcattctagaacactttaaagatgacaagttaacagaataacattctggctaaagaagtttttctcttgctctttaccttaaggcagtgtcatatcttcactaaaggaatgtcttttggggagagtgggattaattaaatctgtgtttaccatgatcagaaaagagcatcatacacaacggtgaaaataaagcttacacataataacgttatttccttctcattcccagtaacggaggggttaacctgaagtcttaatccatttccactctaattgggaaaggtgggggatggggaaatcatttaggtagcaaaatgaaaattgctagcctggatatgcctgaggcaaaaagaaaagaatgaattctcttgtgagcgagattagtgagggggaagaaatatctacatcttgcacttcatttcatgttgtcgttcaatttgccggtgttaaataatgacctccagagcagtgggtgaattgggagaagggggcgtgcgggtctcctagagtgagttcactgtgcacggtgtctgggcactatgtgtctatcattcagctcaatcaggacctgactcaatttgacagcgcagctcccaggtgtagaggtttgcagactaaaagtggagcccccactggcatatttggtaaagttttcttctttcctccttagaagtctacttcattatttggtgtttttggttaaagagaaggctaaacaaaatgatttctattttagaaactttactatttctgcattaaggaaaaagacttgatctagaatattcttctctaaaacgtgaggttcttcctaaaccgagaagttgacaattacagaacctcctaaaacagaatacttctgaaacaatcttaaagtccacatttatgtaaatatttgctgcaggccccccttgagaacttacctagaagtgctgtatcaaccaataatacattttaaattctcctcaaaatgggtatcttcacatgcatttgaattgttaagataactaggaaagaaaaaaatgggagtgtgctatgtagttacttaagattagtgcactaattggtcagtggttcaactagaaatgacctataatttatttttgggctcatttgtggtaatattttggtgatcatctgtttctttgctctggctgttttcaaaacaacctactctgcaaaaatatgtgataacatttttcaagtgttgtttgtatgtttctaataatttttggatgatctctgaatatagatttcattgcacgtataaatataaattaaaaattagctatcaagtcatatctattttcagatgttttagtttaattttattaaaaaaatctttccactctttctctctacctttcaaaaagataactctacagaaatatcaccattttttaattcaaaaattctagcaaaatttgccttaccttttagaatatagttttaaatggtagtatttttctaagcaagtccaaaacaatcatataaaaaagtttaaatctcacttaactattgtttgagaggtagacaatgatgttttatgagaagtctccgcaaaaaatgtttactattccatttcaatgtattacccataaaaaggtatcatttattgaatatcaattgtataatagtaataatgtaacctgaaaatatgtaaccattacaatacagatcttagcagtttcatgaaatttagaaaatataattacgtaattagagaataggattattacttctattgttgctttttccagctattttttatttcagactacaacatgaaattttaaagtttttgtaaactatggcaatttcatgaccccacaagaaagcaggatattgatagtcttagccaactgtttcttataacagtctgttttccaaatttgaagataacaggattaatatgaaagtatttgccatcttatccgagtgcctatagaatactctaaggctgatatttggcaatttattatttaattgacaaatgtagatatctcagcacttccttcacagatcaagaccttgtaagcaagactgagatcaaggtcttactctggattcttgagtagactttctatgtcccaaaacaaataggtgattcggcacccaaaatttagctaaagcttctatattccctttctaaggaattctgctatgtttgtgggaaatttctctatagtctatatgggatcataaataggaaaaattttattttagtaaaaaagtcacaaatttgaggtagtaacagttgtaataataataatgaagcttatctgtttattgaataggaattaaactatattgtacatccatattatttttaaactattattttgtaatatacatagtgaaacttcactaatttggtgggcatggagtaaacagaattaatcaaagagctgaattgtaatatttttagtgattataataataaattattttggataacactgagtaactgtgggtctattctcaatcaccatgtaaattatagaatacgatagcaacatgtctgtgattttctagaagatgcagaatctcagagttatttttatgtgtatacttgttttaaatcatatcttcttgaatctgctttttaaaacaggcaatacttatgtgaaattagagaaaacctatgtgaaatgggaaagtccttaaaatgtcctatctctagttgattctgggtcctctttttccttcctggccccttcccactcgaaacccaagttcactctagccatatgctgacatgggtaagcaccagacccgggccgatttcccacaattccaagtggcatttgcataaatgttcctggagctggaaaacccaccttgtccaagcctcttgttttgtggatgaggaggctgaggctggggcaaggtaagtaactaacttgctcacatggctagtaacaaacttcctacaggttcctctaccttatgagatagtgagtactcctgcactcaaatatattggggttcatgttaattgcatgaattaatccagtcatcaataactctaaatcttaaattttgaatttggaatctgagtgaatgattacctagctatcatttgaagataatatatttgtgtgtgtgaatctcatgtatacctttatatagaatatatatgtatttatgtctttataatatatattgatgtctttactccaagtatccaagaattagttgtccatgtagaaatttgctgtttcagccagctttggggtatttcctttgcctgtcctgtacccaccattgtccacatttaaggtctaacatagacctacctactgctctaccagctcaccaagggtcgtcttatcaagctggtctgcagttaatcccctaccctcctcccttcaagaaccaattaaaatcactctgttatttttgaacacaaaagttgcttaaggaaaaaatactttctatctcataattctcctagtgaaagagtaaattataaacacaaagaatccaaataaatgattctgtttgggaaggagcatttgctgtgggatagcatgtgggacatgaggaacaggacccctgctttcaattcatacattcattcatttcttttttactcaacttagaaaaatcatgtcacatttcctattcattgtggtggaaatagctttaaatatattaactaaaatgcctcaaataaagcagattacaaaagaaagcagactccagaagtattagcaactttatagactctgcatctatcatccaccagaaaatcttactagtgtgacattcgccaattagggaactgaaagccatggacaagtccctaaactcccctccctggagcgcaattttcagatgctccacttggatactttctcacaatgcttagctgaaggatatcactcgaagagaagactggtttcatgtggagagtgacttctcagtctatctcttaaaacataacctctgtctgtagctgacggaaccaaagagcatgtggagaagggcccacaccaaagagaatgtggagaagggctcacaccctttccagggtccacacgttggccccttaacctctgtcttcaacccgtaagactaacagatagaaactggtattgttattattattattattatttatttttgagacggatctggctctgtcccccaggttggagtgcagtggtgccatctcagctcactgcaacctccgccttccgagttcaagcgattctcccgccttagcctctcgagtagctgggactacaggcacgcgccgccaccacgcccagctactttttttattttcagtagagacggggtttcaccatgttggccgggctggtctcaaactcttgacctcatgatccacccgcctctgcctcccaaagtgctgggattacaggcgtgacccaccgtgaccagccagaaactgttatctttgcacaaaagagacacttggaccttcaggggttcccagcagccccttaagaaccaacacaggcaagtaggggcagtggtttctgttgtgaacctctccccacattcccgctccttggttatttcttctgatgaggatggattccatagcttagaccattagaccagtagctccctcactgaattgatctattactgtgttttaactggtagattgccagcaaactgaaacattgatggctttttgaaaaatttatatgctatatttcaaaataaacctgtttataggaattcctatttgagagtgagtatcgtttaaccaattggaaattctattttaaaatcatggcctattaaaaatagaacctccaatttctgatccataatgcttatatttaaaaatacgtcaggtgtgtttcatagggaactggttttgctggaaaagaaagggacaggagatgcttttgtaatattgtttccgagctcaaggaaaccaaagcactgttttataggctgaggcatgcatgactggtgaatgttaagtggaaatgaacaatgtgtgagattaacttgtggctatccatggctgtaaaaatgcattagtggtgttgtcagtggttagtaggcctttgcaactcagttattgctgctgagtatgtgtgttcttccacctttgagtcaatcaagtcatgctgtaataaaaattctgaactttgcttcaggacagctcagagggaaaacacgagtcaagtaagatgcactatttagtggtcctcactaacagcagtttaaaaacagctcactcaagcactagcagactagtagcaaaattgctatccagggtgaattgtgttttgagtggttcctgtagaactgtactgtccaatatggtagccactagccacaaatgagtattgaccacttgcaatgtggctaaaccaaattgagatgcgctataaatgtaaaatacacacagacttttgaagacatagtacagaaacaaaagaaaaatgtaaaatagctcattaataattttcatattgattacatgttcaaatgacaatgttttcaatagattgggttaaataaaacatattaaaatttattttgcccattacttttttaatgtggctactagaaaatcttaaattatgtatatgactctcattatatttctattggatgtgctgctctagaataagaaagaatgtccacatagcttttgtttgttttttgtagagatggggtcttgctatgttgcccaggctggtctcaaactcctgtgctcaagcaatcatccagccttggccttccaaagcactggagttagaagcttgagcctctgaattcagcctgtcctaatggtttaaaggcaacttgtcaggatctaataaggaaatttgactggtaatacaatgttttgaccatcttgcaagctgctggctgcaaccgggcactctgcaggcaaactgcatgggctgagaatgggtgagctgattactaaatcttaagtgtcctcatttgtaaagtgaagggagtaatgatggaccactcactgctcaagaattaaatgggataatgtatgtaaagcagctccttgtgaggcctgatagaagatgtactggtgacttctattaccatacttgtcttggtcagctcaggctgctataacaaaataccacagactgggtggcttaaacagcagacatgtatttcctcacagctctggaggttgggaagtctgagatcagggtaccagcacgattgggttcggtggagggagggagggagagagagagaaagagagagagagagatcaatctggtcttttcttataagagcattaatcccatcatgaggaccccagcctcacaacctcatcttaatctaatcacctcccacatatcctactcatagcagcacatagaggattagggcttcaatgtgaattttggagggatacaaacattcaggccataacaacagcttaaaaagtccaatcgcaccaggcgtggtagctcacacctgtaatctcaacactttatgaggccgaggtgggcagatcacttgaggtcagaagttcgagaccagcgtggacaacatgatgaaaccccatctttacaaaaaatacaaaaagtacctgggcatggtggcacgtgccagtaatcccaacttctcaggaggctgaggcaggagaatcacttgaacccaggaggtggaggttgcagtgagtggagatcatgccactgcactccagcctgggtgacagagtgagactctgtctaaaaaataaaaataaaaagttctatctgagatactggatcctccaactctgagtgcagaccttgaaccagcggcagtggcaacactgggagcttatgggaaaccaagaatctcaggcttcttccgagacctgctgaggcagaatctgtagttaaccagactcacaggggctcaggtacgcattcactttctgcagtgctgcctagggaatttaaaggtgagtaaaacacagcctcgctggcaaggtgttcacaatccactggtgcgtttgtgtgggaatgagagtgaatctagagagatgaagacaattatctggtgggctgttaggaggctcaataaaaaacacccctgctctccggtgatccacaatcaacagtgagatgacaaaggagtcaagcagatggagataaaaataccagcttggtcactgatagaacttttggagagcatggcttaggtatgtggcttcctgctactgagctccagaaatagggagactcactcaccaatacccaagcagtgtctccccaaaagaataaggagagggaaagagcatgcccagggtacttgttttcttattgctgtaaaacgagcaaattgccaagcttagcaccttaaacaaatttagcccacagttctgcaggtcggaaatctggtggtgctgtactagattctctgctcacagcttcataaggccaaaaatccaggggttggataacctgagcccttacttgaaggctttagggagaaattcacctccaagctcatgcaggtagttggcagaatgcaattccatggggctgtagcatagtggccctcgtttccttgctggctgtcaatcaggggtcaccctcggcatctagagactgctctctagttcttgcaagtgcctgctctgtcttctagctacaatgctgacttcacttctgccccagcctgagaaaacactgtgtttgtaatggtctcctgtgattagattagggctaccaggaaaatctctctgttgcatgagtcaaagccaactgattagtaaccttaattacatatgcaaaaaaaaatctctttttttccatgtaacataaccagagcatgacaactcatcatattcccagccccagggattagggtggaaagtttgaggggttcattttatgcttctgccttctacaaccagtttctgcttccaacgctactaactaggtaattcaatcttttatggtggaggaggaatgagggtgtaaaaagaggtcaagagttttacactaaggaatgttgttccacatggaaacctgaagccagggaaggggtggttccaccacttcctctcacccgccccaccacccaatatatttaaatagctataacccaaaatatattataattcaagtcacataggagatgtggaaatgatgataaagcatgtgattggtctttaagaggcaatttcacctgaggcagaaggatctgcccccctccaagatgaggacaggaagggtagctcttaatcctgcagaactgtgctaaagaccttgcattgaattccagatgcccaggagaacacagcagaactatggtgcaggagactaatctggaagtactgtatacaattagcaggaaccccctttttcagagatctttgtaagaaatcttcagagaggtaatgagaacttgaaccagaatgatgtcaataggaattgaaaggtgggggccgaattgttatcaaccaaagaaatcaaaaagagatcttggcaacagactggatgagggcaaagatcaatccatggatccaagtctggaaactgggagaatgatggtgcagtggggaaaacaagaggaagacctgggttgaagtggaaactgatgaattttattttcagtaaaatacacatggcaaacactaattttctcaggttgcttccatcttacacacatgcacacatatatatacacaaacacctctcaacactggtctttctctcctcctgctacctcaccagtttccctccctcctccaacaaatttcattctctccttccctacatcccattcgctttctactctctgctccatttctgctgctgccactcaactgaagctcctttggcaaaggttacatggcactctctgtagacaaatccagtggaatattttcatattttcagtccttgttttcatggcccctttgtggcctttgggccatggttttcctccaaagctggcattttcctttattcttttcttttctttttatgagacagagtctcatcctgtctcctaggctggagtgcaatggcacaatcttggctcactgcaacctccgcctcctgggttctagtgattctcctgcctcagcctcctgaatagctgggattacaggtgcccaccaccatgtctggctaatttttgtatttttagtagagacagggttttaccatgttggtcaggctggtctcgaactcctgaccttaggtgatccacctgccttggcctcccaaagtgctgggattacaggcgttagccaccatgcccggctgcattttcctttactcttattacttattctctcctctttcttttcctagctccatctccttggttgctccctcttctgctcaccctggaatgttgataatcccagaacctgagaatggtctcttctcactggaaacagtctctgaaactagcatagagtttgattgtaccctagatacaatctgaaactacaatagatattctaaggatgttcagctcattatttctacatgaaacctctccccagaattcctgttttccccaccagcacctcctattctgttctgggcatccaaagctcagagagacatcacgatgtctctctgtaaacccgctgtttctggtcttctctactactattaaaggacagatgctggggagactcctccccctccctcacctcaatcccctcttccatctccattgcttaatccagatcctcatgaccccttgtctgacaactgctatagctccccactcctcatctctactccctccaactcaccgagctgttgttgacagacttatttttctaatatatatattaattttgttatttccctgtttggctttgacagatcaattttcccgcatgttgaagttcacatttcctcaggttgcttgtgcttccaatgacctatctacgtctatgtatttttgaactgctgcactccctcccccactccccaacctggtctcaaacctatgccccaactgtactggaactgacacactgatgtgtttcataaactcacgcccttattcatgatgcttattcagcccagagcaccatttccccaccccaccgtcacctccctaaacccctcctctagctctttgaaccacctaaaaatctacccaacctccaaaagtcaagtcaaaaatcacctctgctaggaaggaagtctttcctgagcccaccaggggctgttggcccctcttcctcttatattccctcccaccagttcctgggaccctggacatgtgtccaccaacagccatgacacttctttactctcatctgtttggtgtttgtcatcagtgagcctagcaccttgcctgggacagaggaagcattcaaggaatgctgaaggcaggtgaatcaaataccttgtatctaggaaagtcctaaagatgcccttttaaactagtggaggtgggaaaagactaaaacgccattttatattattatcaatataaaagcttctcagccaaatggaccttggctttctcctcaaactctgtggatgacagaaatgacattaaaatctgactcctaatgatatgaggtttgcatggtgaagaatttccaagatattttctgatctagaccctgagacgggggggataaaagtgaaagatgagatcagagttaattttttagaactctaccaaggatagccacaaaaataatcatgatccaaaaggaacatagcttaccatgcatgtggacctatatgtagatatgaatatgtgtgtgtgtgtgtgtgtgtgtgtgtgtgtgtgtgtgtgtgtgtgtgtttctatgtaggtcaagagtgatgtgaatttgggcaagttacctgaactctccaagggtgaggttccttatctgtaaaatgggggtagcaatgatgttcttgtgaggattaaatcaggcaaagtatataaaagcacttcacccattgcctggcatataattacattcaatgggggatgtagggaagagagagacagagagagagcatgcaagctagcacactggaggatgggctaccagattcattgttcactgtcttaaacacacgcaacctcccctctcttgcagtttgggttctggcatctttaacagtttcatgggcaaatcacttcaaacctccacaggtgctacttcacctgggcagcagttgctcaccccctaccccttccccctccccaatttaaccacacttgctgtgttctcaaggctgctgatacacaacaaactaagaaagtttttaatagttaccaatcacagttttcaaaatccactcatttttgcccttgtttttgggtttaaaaaatcctggcattttcctcagaattgctgaactattaggtgtgtagatgaacttgtgttttcttgctctcctactccaatttcttagactcagacatggaaaagcttctctgggtctcaagacataatttccagggtgcgtggttccgctgggtgtgctgtctggtcagtcttaccgttgtggattccacacccccaccccactgccccaacacctattaaagctgagctgacgtaacttcaggatacatttattatttcttaccttatcattcacaattagtgcaaatgattagttctctgccttgctctttaaaaagaaaagtcttcatggagtcattttatctacttgtgaaccacaatctcgtttttttttggatgctcctttgagactatacatatttaattcctttaatatttcatcatagagcagtccttcagaacctcttattttagttgttccttttactttggcaaaaatataagactaaagaagctgcaaatcttgttttcctgcctatttaaacagcatctagaaatctgaagtaattgtctcctcttattttaaaggtttttttttaaaaaaaaaaaaacagcatactaaatattgtggcatggagttgaaagctttaggtctgcagcatttgaaatgctcaaatcctgtctttaaagaacagtatttcctctttgtgactcagtgctgttatcaatatacaaggctgatagagtaatttcaaattcacaacattatatgtagatattcaaaggaaagaaaaagagcttcatgtgactttgcttaatgggtttacctatagttgtaaatgtatactgtaagtgatccatatttgggaattatcatgtaacaattatttctaataataattgatataatctattagaacttgtgagaggtttcgatgtaaataatttacctgcctagcagagagaagggaaggagagtaagcaggggaaaatgtttctaaaatgtcctatcattggaagtaaatgatcataaatgtttttgcgttaagttagggtttggttttaattttcccttgaattctaatgttcctacaccttccaaatatattttaaatcttcattaaataaatcacattttaatcacacacggagcttaaaagaggtgattctatgacagatattcagtattagctagtgaaggagaacattggttgaaggtacctaaaaccacgtgcataaggaacagtttatttcttatttggtgatttactatttcaagtcatttttgtgtcaaagctataaaaatctccagtgctaaaaagtgtaagaagaaatgagctagcaaaaaaaaaaaagtcgggggaaagttaatttttaaacttgcattacttttattttcctactttctgttatttcagaatgcatacttggaatgaatccttctagagacgtccacggtatgttaaattccaagttatatttttaaataaagtacacaccttcatagatgtgtatatgattttatatctatgtatctctatgtataacttgtgatataatttaaccaaataattaaggctgtttctgctgattccaatatacttaaaagcagttctccatattgtaaatgttataccatataaaatatttcaatgaaagcttaaatgataccctcagttctacagcgtttaccataggtgcattctgatgctattaaatgcctctatacaactctctaaaaacaaaacagagcttggcttccctcacagcccagcttattacctgtgttatagcagtggtaatgcaagatttttatgagagtaaaatgtttactaagcattcctaaattttaaaaagattaattttaaaatgtcctcagcttgctacttgtgaggtacacaatgggtttatgaagtgaaagtgaaatcatcacacattaaccatagcatcccacagaaacattcagatggaggaaggatgtaatggaagaactaagggctctcctcccccctctcatagtaattagatttgaaaagtgaagtaatctcaaagccacttcagaagaaaaaaatgtttaattaaattccaatgttcaaaactggatagtgtgtatggcaggtgatttgtacatacatgttactcttcatcaaaattgttttccatccctgtgacatcaatacaaactgcagctatttggttccaaaccatagcaagatacattctattttttaaaatgtaaatggtcatttaaaatagaaataattcttttagacgtactgcatttttacaaatgtgattttggaaatatattgctcgcaaagggtaattttaagagaattgttgagattctaatcccatctttatgcatattttggggaggcttttgaaagagcaaaaaggtaaaagatttagttatcttctgagaccacctatagttctttacctaaagttgtagaagaaaaacgtcaatgcactgttactgttttccaatgaaattatttttcttccaactaaccaagcagtactttttaaatccactgcagaaatgtacatttcattcctgttgtgagccgttttcaattctcctccctccctctccccgcaacaaaatttggaaaaatctgtcacgtagcatccgcccaacgtatcgcttcgttgtattttttttttttttaattttgcattatgacaaaagtaaattctagcattactccagggaaacactgggaatgaacctggtaatgtttcctttcctttctcccttaggcaaaggaaggggaattctgtattgtcgctaaaatgagcgctcttggtggaaaggaattcctcacttcgtacacgctgtggctgtccttgaaagtgcaggctccgtaaaatgcccggccgactaaggggttccctttccccggagcccctgcctctttccattcattttagatcctcagtaaggaagggcagaggttggtctgtttcttcttttcaagagggcaccgcgctgcgcagttaacagcctgcgccgctccggggaaacccaaatgtcccgcgatcccatcgagtcaaggagcaaaagctgtgattgctatcagctttttgtcgggcttcaaactcggggtttatcggttgaaactcctagctgagcagctcccacgacgctgcctctgacggctaaactcggtgcatgcaaggctgggaccaactttccttactcgataaaggaacttgactccctcctgggagaccgcagcccgagtccgactcgcagcccccgtcgcggggtttagggttttaggcaagcggcccgagacccagaggagcctccctggacctttccgaggggcaaatcacccgagtctgctatttcccctggagtcaaaagcctacttttggagccgccacaccctcgtgctccctcccgcatctcgggggttccgggggatgcacgtgggggtggccccaggagccctgggtgggatctcggggaaatgcattggagaccaggcgaaaaggtttcccttgcccagaacttgcctctagagcgggccgcgtccgaacccgcaggcaaaggcgctgcggcccctgcgggcgggcgggcgcgcgcgatgcactcttctcagggacagagttagaaagtggacgtttgggcggggggagggggggatttacaactggaattaggcttaaaaaaatcattttaaaagaaaaatgtagtaagttttctttccgagaccccaggtccattaaaacaaaactgaactcgggtgctggcagtgcccagggggagcggaggcggagagggttgaggccgcgggccgcccgccttagccccccggaagcccgggctcctgaagcacagatagccaagagcggcccgagtcaagccccaggaacaggggcttcgggaagagaccccgaccgggccgcacagcggggaggcctggtccgagagtccccacctggccggctgcgactctatattggaacctcggaaacgcgccttggccgttccagctcaagtgggctctggggcggcttcctgtcttttatcctcgaacgctagttcttcccgggcgacccgaaggccacgaggcgggccgcacagccccgcgccgtcgggggcgttccgggagctccggggactgcgcgcggcgtccagggagggcggctgctgccccctggcgtccgccagagcccgcggcgcgtcccgacagctccgcgcagtccgggcccgcccgggaaaggcctccacgccagtcaaccccggccccctcctgcgtccgggcccgcggcaacgcccggggacagtccctgcgcggcagcggccacagcaccctagccctgggggagggaggagcgggcgtcaggggccccgtgaggtcggcgagggacccccgcgccggggagcttaattgaggggctccgcggggaccacaaagcagcccgcggtggaacggggccgggatccggggactgggttgcagccccggggtggatgagaggccccgggaggtgcagggcccggcagggagggcgtggagggactcatggtgacgggagcagcctccgctgggagggagccccgccgggcggggtcggagttggcagcgcacgccggaccgggggcggggccctccgagctccgcgaaaatgcccgcagcaccgcggggaccggcgcagggggaagcggccgcccgcacgcgaagccggggtgggttccgcacctggggccgctcgagcgcacgggggcggggagaggagcgggggccgcttccggggagccggaggggagacgcggggcccgggcaggctgtccggctgctgcgggtgccggcgctacaaggcccgggagcaagccgcgtggctgctttcaactttccttccagccgcgcgttcttggggtctttcctgactaggaaactcttcgctggccgctgacgcacgcagcaagtgagacgcgcggagggatcgagccgcggcccgggcgcagcggtaaaaaacacccattacagaaaccgacccaagggaagacgctgagagcaaacggcacgcgcggacgccgtccggcctcatgcaaggaatcagcgccgcttcgccgcagctgccagccggacggtgcaggagcgcggagtggctcccccgggccccgcggccaaatcgcacccccgccctggaagcggaggcctggccctgggcggccgcgcaggatctggggccgtccgcgggctgcagcccggttcgggagcctcgtggcggccactgcgcctgcctgcagcggctcgcggggccgggcctctccgggtgcggcgcgccggccgggtcctcctcgggccggcggggcctgctttctttttccaggtctccggaccgtggccactcgcggagccgcacaagcctgcgtgtggctgcggaaaggggtccgcacgcgggcggggccccgggccagcatgcaggcttggatgcggggcgcgggggtggcctccgactccccgcccgggctgcgtacagtagcgcgcggcgcggcggcgggggcgcgcgggccaattccaggagccggcggcggcgagccgcgccctggctgataccggaaaggcctgtgattggccgccggccgcccctatgcaaacgagctgagggaatggaattcctccggccgggcttacagtaaaagcacgttcatttccaggcactctcattcatagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtactggcccggagagggtggtgggaggacaggcggaggccggcgaggccgggggagatccgcgagggcagcggccaggcgggcggggccggattctggaaaggggcccccgcagccccgggtcggtcttcctagcttgggatgtgggggatgctgtgttgccgtggcgaccctcgggaggcactcgtctcagctttctggggcggcctcccaggagggctgaaaacatcagggtgtccccaaagatatccactgggagccggtcgggacctccctggcaggggccttagctttgatacaaagtaggaaaagttataacccagcccggcagagacagcccgtctgctaacttactgctgcccctaccgctggattaacacccaaaccattttgtcttcctcagatgaaaggatcaggaaataaaatagtaagacttttctgccttcaagtcagtgaaaagaaactaactagggaaactgtcagggattttttttccccttctctaaccgccctataggaattagcatgtccaaagtccacagcgggcgtagttaagtttgcaaaagttttctgaagagttctctgagctttttagcctgctcctgccagaagccgcaagtatcgaatcctgtttcttttcccggaaccgttctgaatgctatcatcagctcacctagattaagccaggggtagcgaaaggtgacgaggctgttttcggagagccaggggtcccagcggcccgctttcctgctagaggagggggcggcgcgtagccggagacttcagcgcggcggctccaaagatctcccttcacttttcacccctgatcatccccaaagctttgagctgcctttaaaaaccttgaccttcaacaggggtatgaaaacaaccccaggcgtttctaaacaatcaccctactacactagcagcaagcagtaggaatttaatttctgcagtggagattctgttttgtctttggtgggtttgaaaagatgcgactaagtaaaatcagtgcgggtcatttcctgttcgtttaaagggcgaatcaaggcaggtggttccaagtgtaaagataagctactaaaaaaaaagtttaaataattgtcccctttaaagggagattaatttaatataagctttttatagttccaagcctcagctgggtcttgatcttattacaacgacgaatattcactttttaaaaaagtattgttgcggttatttttaagctttatacagtttccacacttagattgtgatttctaaaacaaaacgaaatttgcagttggctgtgtctatagattggcctctttttccactcacttttctaaaagcagttttttttgtttgttttgttttttagtgggggtggaaatgaggagaaggaacgaaggaacgtggtggcttgcttgactcttttttccctccctccgtttacttagatttgggtttgggagaccattttacttttaaatcattctaaccctttgcctaaatggactcagcgatgactctttagggcacccgcattgagaggggacccaacagggttgggccatggggtcactatcagataaagagcagaggcaagacgggctgataaccaccaaaggccattaaaacctggctgccccaatgcactagggctctaagagatttgtggcttccttttgggggggaaatcagggtctcttctgaactccctcctctgccagggaacccacactcaaatatattaaaagactaaatgattaataaataatcttcaggaattggagcaattcagagtctcaagccattacatgaaagtatttattttcttctaaaaaatgaaaaattatacatattgcttttatgagctgtcagaattctttctagcagaaaccataataaccatagagtttcctttttaaaatgacttttggcaattcacttaaaaacaattaatttgttttattgagtgataatctataggctactaaaaatccaaatacagagctcttgaaaaaagttcaagcagatcccctgagaacatttaggggaaaggaaaggatagcagagaaatcagaccatttgattattgtctgtcaccaccccaatcctcataaaaagaggcttcttcctggaggagacctgctcactgcataactagaagagtagacaaaatgttcagtgagacagtaaacgtgaagggataaaatgttagggataaaagcaagcaaaacatcaaaacctgcctacatcccgggctcatttagtgtgtgtccctggcttcactctatctgcccacccaaccacctcacaagcagcttcaacagaaattattactttaaaatttggatcttaaataagccgcaggcaatctccctaggaagttaaccagtaaataattattatattccctatggtaaagagaagcaaatgtgaaacaatgataaggcctgatgatattgatgaaaagatcactgaaggccttcttaggaatctcctgaagttctgtaggtaaatcctctacgtcaatcttctgaactaaagagagatttaaaattatgaattttctttaaaatagattacaataaccctacttgcttattttgagccccaacctgttctccccctactccttccctcccatggaacacctttattttttacagtatgagagatacatgttttttactactaagaaaaccttaagtttgctgtgtgttttgctgtacttacagaattagcctaaaaagctgttttgatgacttaggatgtatttggtaataccatggtgttatagcttgttcaggccctggtacaccagagtccaaagacgtaaacgtgccttcagcagggaagttcggaggtcttggattctgatggtaatattcttttcataaaaaggaaataagtaatatttttgtcggcaagatcacagtccctagctatgccttaaatatcatctcagctgaattctgtgttccactccacagccttctttgcaacactggaaggttaacggatttgaagtaaatgaattgtaactgtaatttcaacctaattagaattggtttaaaatgccagtttggaccgtgaacaggctagccaagaacagtattgggaggtccatgtaatatagaagagagttgatatttggcccaacttcctgatactttaaaaacagagaagtaaaacaaaatatgagatatctttggccagcaagtcccttcttgcctgtttggtctgtgttaaaatgtaaatgtttgtgtttccttacctattgtttatagcttttcattccagttgtttcttttttctgtttgaagttagatatttttacattctctccatattgcccatcagtgacaaaacctgtatcaaattagcacgcatgttagttttgaattaaaaagaaactttttaaacctggcttaagtatgcttgttaacaattggacgatatacagtattaatgaattgccctggatttactagttcccctttacccacccgcctccaccaaaaaaaaaccctcagagatcaatacaaggccaagtgaatgatatgtaggtgcccaaatatggttgattctgctgcatttaaaaaaaaagaggagtgggagttaaacttctaatttttttcttcttaagttccaacatcaacagccttttcttatttagcctccatgataattttattctatgtttgtttcgacttggcgaaggtctcctgaatttgccaaattaccaatgaggatagtattggaaagatgagagaggcacaggcttggagcactgtgaggggaacagcagtaggaggcagataattcagaatacattcctgtagttataaaagaagatttatttattttcacctttttacagatccagacccaacaatgagttattcagtttgaaacccacgtagtggaggcagtctctgtatacctgctgaatgttgagttacaatagagaagcctgggttaccacagggagaggaggatgaggaagtaaaaatatgtgttcaaagagggcatttcaacactgtgagctaactttacaacgggaagtgaaaatcatgaaaaaaaggggaaaatttgttgtgagagactaaaaagagcaaaataaagcaagcccatttttcgggaatagaaaaaaaaaaaaaacagtagcaataaccaaataactgatcagggagatttatttccgtgatatctttttaaaacaaaaagggaattgtcgtatcactgctcttaattaaatggcaacaaacacacttataatgggaactaaatagctaattagagggtgcttggggaataaatagcagagttttaaaatctcctatatggaaaacatgtccaacaattggaatgaaaggattaaaaagagagaaaaggcccagaccttgtttggcagtgcaagttggataaaatagaggaaaatgcctccctgcttctatgagactagattatcctggtgtagtcttggggttggaagtatgttcatctctcatagtgagttagttcgtgttctgtgccacaaggactgaagcagttctaatgaataaaaacaatagatagtcatctggaggccacagggaaagggtgatggctaagcagatcatgaaaatgggaatcttgagaaacatgacttcgatatcatacaagtgagtctatggcagccttttttacatatagaaaaagaggcctgaaaatatatactacaaaaaattatgtagcagttattaaggtaaaaattgggaagtaggaggcagaggaaggagtgataacactagattaaggaatgctttactgttaccaattcaaaaacagcaaccaaaaatgatgatgtaattggaatgagtaatataaatgtcactactgactttaccgtaaagaatgtcagaaatgatcagaataaatacagcttggggcatttcgatttgaagttgtatgactgctttgaaaaatagaaacaaaggaaatacagccaatagtaaatgtctagaccaagaaaatagtttctagaaggcctaaatgatagccaagaaattgatgctattgtacaaagtatctttaggtcatgcttttcagagtattttactttggaattcattttcttaattacctgagtataaaaacatttatctaccagttttctccaatagccctgataagacttcatacttactcagttacattaaataaattcctggtcaagatcagctgggctagcagaaaacctcaggcatctgtgaggacatgagtttacacacgctgagactcacagatacaaaaatgcaacccaattccacccctgaattgaggggagtgcatagaagtgaatgtcccgtctttctgaggtctgttgattttgtaattagtaaacgaagggtgcatttctgatttttttttcttgtgtgctagaattcattgctagtaaaactcaagataatagcgatgagtaggaggtatcaaagatgaactgtagagggacagtttaagttacttaagaatcgtcagcaagatgaaatctacttttagcagaaattgggtttttttgtgtttttttgttttgttttattttctaaaagtaaagtctgcaccttgttcagcctgttagtggaggtctgagcaagtaaaagatgggttggattataaacttacaaacacaggatgttctgtttctcaaacgggagaaattaagaagagatgcttgtattcaggagacggcatagctactcaaaatccttgatatcttgctatggttagtcttgttccaactgtgctatgtgacctactatggctttatgaggtaaatttagtatatgtgtcactatttgaaaatttacatatagttatacataatgtattaggttggtgcaaatgtaactgcagtttttggagttaaaaattgcaaacactgcaattacttttgcaccaacctaaaatataataaaaaagtgtcttctctttataacttttctgttgttttgcttaagttatcattgctattcctctgcaacctaaaaagaaatcattgaatatacatttaattttagaataatcactacacaaatgccctaaaagtgtatgtataacatccctgatgtctgcatttgtcctttgactggtgtttaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagaggtacgttatctgtcaaaactatgcttgaaacacgtttcatggcaacaaacccacatttcaaaattctagtgatttctgtgatggaatccctagaaactcggtctgtcttaacattcttattgctatgtcaagctcttaaaaatatttatttgaagtttaatatttttagcagaatctctatattattgctttatgttactgagtggatttaagactgatttggaacatgcaacgtaggaattgtgaatttcaaagaaacgcctgagatttttactaaaatgcaaaaaatataaaactgactttaatgaaactaggattatacaattacaatgaggattctctcttggataacaatacaaaagctatttaatggaaactgttgacgtatgatctgtgggctatctgtgaaaagtgacagagtttcgaatgaccacttctaataattttagggatttctagtgtatgatgttgaaacatggtttcaagcaagcttacctttttagaaaaagacatgaagaaataatgttagtaccattgatggcagtatgatcttcctgttgtatttcttttcaatgccttatttaggaggaggggttgggcctggttagcattttagatactaataatattagagattggattatccaagaaattgttgcattacttcagctccatgtgtgattttatttttccttgcctttaactcattatcaaagcattagagcagaaataggaatcttggcttattgtaattttttctggtttccaattattttcaagtattatgttttctttacattgtaagaaccaaatcatattttataaatagcaacaagtagtaaaagtttagttgagggaggtaagatagttttttaaactcattttttgtaatatagtaccgattaagcttacaaataagttatttcaagtataataaaaagacttatggtaaatacctaaataacagtaatagttctcgtattgaaaaaaatggaagcaccaatcaaacaacatttaaaataagagaaattattactctttaaaaaggcatttaaaaacaagaaaatctcagttctcagagaatttgattagtcagaaaggagaaaggggtaaatgtgagttgattattttggtgattatttttgctatcctagctatctggagcattttcataatagaatcatagctggagaaaataaaaaatttatataatgtgattgaaaatatatattcatagtactatattaataatagggtaatgcaaagaaaattatatccactttttgaaagcatgagtgatgctataagatataaaagcataagtcattaaatgggttcacttgttgtattaaaagtccccacctttcagtaaatggaatttgcattatgattcagagatgtgtgtctagaaaacatcttaaaggcttcggatgagtagctggcagagtgggtgagaagccaataaaaaacaaaggccccacagcctggtccatgcccatcggcctagctaactctcttaattcagttcttgtggatttctgctgttaggaatcaatagctaagtatcattgaattgcttttctagagaaagtgttatcatcatactatgcatctgtgtgggtcttcaagttaggttttggtcataaaagttttaaaaactatttagtgatccgtgccagtgacattttcccacaagaagttcagtagtggctttccggcaatgcacagtaaaccagtgataataaaaaaatgagattttgaaagcagtgtgctttcttttctggcattgatggctgatcttgcatccctcattgaccatttctgttttgagtgggtgactaataggtgcttgtgtttacttgggtaacagtgaactgtttccccaaggtgtggagtgtttgcatttggctgcaggattcgtgccagtatgcccttgagtttgcataaaccccaaaaagtaaaatagctgcaaccaaggctgggctgtcttcccatactctggaatgagaaaattaattgaaatgccataaacagacaatattttgaacagactctccttcccaccagtgataataagcaataaaaaatacggaaaccctaatggaacatttgacccaattgtaattactgtggatatgaatattgttggtcttgagatgtatatatatatgtgtgtgtgtatatatatatatatatttttttttttttttttagtcagcgctacaaaagtaaatgagctgtctgaaggcccgatttgactctgtcataatttctttccatagtcataaaatataacttgatttttctctttcaagtgtaagtgtcaacaccaaagcctgccagatttttttctttctttttccttcttcttctttttttttttttttgcaatttgcttcccattaggaagagagcagatcattctgactaattttaacaattagtcttaatcttcctcactgaatcttacctttaacagtttcattacgttttattaagtgatcttaagacaactgtctcattttctgtttttgaaaatgtgcttgaaaatatacccttggcatgaacacaccacgccatggctcagaaggccctggctcttggctcatccaaactttcagtgccaattttgaattctgtcaaaagccaccagtctgatggattctccaaggggcctagtaagtggtgcaaaatgaaaggtagagaaagaagttctctttctgtgaccagctgccagtccatggggattgtaaacctcatagaaactgccagaggttgaacatggaagggtttttctctgttctacaaaacgaatctatctgggcgctggctgccatccaggatcacagctcctaacctcgggttcattccgtaactgggaaaacctgcctgtccggctttgatggcctcgctggctacactggccctgtagaagcctgaaccttctctcttttcttccattccctcctttttctccttggcagtttaaatcttggttcagagtgtatctcacccttggaatgtttctctctttgattcagtatctccatgtaaatcgaccgctcctttacaaaggaggaagagatagcagctcccaggagatgagggttagggagctctggggaccgggctgaactccagaggtcatgtgagcacagaggttattgttcagaataattcacattttagccaaatggactgggactccatgacacccccaaaaaattgaagttcagggtcaaaaggaattctcttatgtgaaacgaattcactgagcagcttatatcagtttacatctgcagttgaggcaagtgctacatcacctgccacctttagaatgacaagaaagtgtatcatggcttcagctgagagaaatttaagaaattttagcaattggtatccgggcacagtggctcacacctgtaatcccagcactttgggaggccgaggtgggtggatcacctgaggtcaggagttcaagaccagcctggccaacatggtgacaccgccatctctactaaaaatacaaaaaattagccaggtgtggtggcgggcgcctgtaatcccagctactcaggaggatgaggcaggagaatcgcttgaacccaggaggtagaggttgcagtgagccgaggttgcgccactgcactccagtctgggcaacaagagcaaaactccatctaaaaaaagaaaaaagaaaaagaaattttagcaatgaaatctgtgactgcttcatcccagttggagtatttaatcagtcagagaataactgatcaatcaggaaatacagctttagtaatttcatttcagaaccaaagaagaaatctctccagctgctttatcagctgcattgttgctgcaggaggaaagatggtctactgcacatttctttctagttttttcttagaatatgatttttaatctttggggaacatcatagatacttttgaaaatcctttggaaggctttttccaaggacaaaaaaaaaatgcacgtgttcacttacacacagaattacgtatatcatttcagtttctaggctaccagaactcatttatggaccttctggggatccacagaccctaggccaaaaatttgtgaatttggaactttgcattgatcatggagggccagcttagccctatgccgcatatagtagacacctgaaaatgaataaatacatgtacaaatgagctagacattttcttgaacctgtgctgttttggtaacacctgtgtttttgttatcgccggggtctggtttgtctaattaagaaagtagatctccttgaaaccactggccaggcctttggatggccatcaggtatgcccacatatcatcacgggtaaaggggagggggcctattctgtcattgaaaggacagtcgcttccctcgtactgtgtccacacccagccctgtaaggccaagtgttctgtggcctgtcaggatggcgttgagtttcttggcggaatttgtgtttacattgacctccctggcagctttaatcttgcccactttcaaaatagtatcctttcccaacacatttatacaatgaaattccttcggtatgttcttgctgtgaatatcttcccagacataatatttatcctgtcacaatctgggttattgcatatttgtgtaatgttagttgcttaaggcattttcattcttaaattattctacattatttgggctaaagtgtgggaggttgcccttcaggtgagtggaagactgtggtcaagaggaagggaaggtacatttagggaaggataaacggtactgatattctaaacaaagagacatggcttggctttatgtagcggttgttaccaagagatgatctgaatgactcgcagtattatcgtaggatcccagtccttctctattctattaacagattcatataatagaagaaggaaaaattcatctgaccaccccagagttgtttcacgggtaatgttcatggtataaactggcagtcagatctcctggagagaatataaggaaaagacatgagttatattaaaatcaactctcccattttcccactttcttctgttacatactgatctacactttaaaataatatatatactgaaatctgtattcagatctcattgcaagcaaatatagatgaataaagacccagtctctgatataccaagcctcaaccagccctaacaaatgctgcttttcgacgggcaggtcaaaagcttgcctccatgatctgatgtagaattcatctctagagaccaagtttctcatttcggtttcacatttgccaataaaaggatagcaacactttcctaaagcaagttgctccctgccctgcttaaagcctggggtggcccagtcatggcaaggaccagcaggaaaagctttcttgaaaactgcttgtgcttgcaacaggcagtttcgcagttgatcccttcatagttttcttgctgattttgtgaagtgtcaggcattgctgatggcgtcacacagcttttttaaattgaggttatttgtatgaacaatattttatagtttgatgggcagaagctgtacttctctccacccaccctcaaccccttccttgccagccggcttgtgtttggtggaggcatttctttttggtcgggacagaagactatcaatcagaaagtgcctgcaagagaaataatggttgagtgatttttagagcttcctgtttcagcaacaagcattatagacataaacagtgatccagccaacggctgcaaccctgctctggttctaataaatcagttttgtattttcttttttgtgctggttggcaaggggcaagagagggtggagaaggttggctaaagaagaacatattctgtgtttctggtttttttgttgttttttttttaaggaaaaattacttgttgacaaggagagatggtgtactgtctttttttttttttttttttttttttgagacagagtttccctcttgttgcctaggctggagtgcagtggtgtgatctcagctcactgcaacctccacctcccaggttcaagcgattctcctacctcggcctcccaagtagctggggattacaggcatccaccaccacgcctggctaattttgtatttttagtagagacgaggtttcaccatgttgactgggctggtcttgaactcctgatctcgggtggtccacctgccttggcctcccaaagtgctgggattacagtcgtgagccaccgtacctggccggtgtactgtcttaaggctgttttctttctgtagatgattatgacacaagttcagatcagtaaagagatgtttatgaataatcatatactgtcaatatggggagagtgtatgcttttgaaggcttcattgattcttagccagtggagtgtgtgtgcgtgtgtgtgtgcgtgtgtgcaagggggagagagagagagagagagagaatgagaatatccatacttccattgagagacttcttgggccaaattatctttgaggactaaattcatgctaataacatcttctcatctaaagcccaaataaagcaattaatggaaattaataagtgagcagtgtggatttaatgagctgcctatgaatactatgacatgcgctcgttttgtcggctccctggcggggcatggggacagatcgcagcacttcaacgtctgtatttataaacatgcattcctggacttcaggcagcgcgcatactccatcattggttctgctgtgagtcctacattcaacggagatgtattttgatctctgttgaagacagagcaatcgacggcattcagtttgcactgcactgatttgggattccagtacattgcccagtccctgttagtctatattgggcagcatgtcccattcaggagctccatttgacatcaccgaacgttctccaatgaaggtgtcaggcagttgaggtccatagaggaatcccagcaacttcctttgagaggctcacggccattctgctgctagactgaaaatgcgtttcctctgatttccttagtgaggaagcattcatttaggagccatttaaactgtgtttttctcaaagaagatgtaagtacatttcctgtttatttctcaacttagattaatttgggcttttaccttgagatttaagaccatcattaagaatgtatgggcagggccatctgcagaactaccccacctcccccatcacctatcccaaggacgtgcctgtccagttaataggagggctggccagcactctggggtggtgtatggccctaattgagtcaccgtatgcaaaccaaggtaaatcacaggaatatgggcagattgagcataattggtcatctgtgtgctcatcagatctctggaggtggaaacactccagtttgctcaaggcattgggttggggtctttacagatttttttccttcattctatttgaaactattgtatagaggatagtcagtattaatcatctatctttctatctatctataattagtaaggagctagtctaactcacatcataataaggctttgtctgcctctttaaatggtgtgtctctagtacctaggacaaatgtcctgccttcattattctatctgaaaccactgggcagtttattatcagtatcttgtctccctgcttatcaattttgatcataatcttgctcagtgtttcccagctggggtgatttgactcccagaagacatttggcaatatctgcagacatttttggtggtcgtgtattgggttggggagtgccggtggcatctagtaagtagaggccagggatctactaaacgtcctaccatgaacctgacagcctccccaacaaagacccaaatgtcagttgtgctgagattgagaaactcatctagctccagtcatgcgtgatctcgccctgatcatgcataggttgtaaaatgtttcccttgccccttttattctgacattctgcctccctacaaacttatcaaaatgtatgaaaaacttattttaaattttatgaaaaacttatttttaaaacattgcacagaataaaaaatagagaacatcactgaatattaaaagttttttttaaagggaaaacagcagtgttctgtatgcatagaattgcaccatccccctggcgccactgaccctgcctgctatcctgggtcagggatgtgcagtggctggaggagtggctgcaggtgggggtggtacacacagcagggcagcttctccgagaaggctccccactgtagccaccccctcatgaatgtcacacaggtgaggtccacgaggactgcagaaactaggaagccctctgccagaggctcactgcttttccctgaatacttcagcagagagtccatggagccactgatctaggaatgggaattgatgtcagtggacagtgtccactcatattaaaaaagtgataaagagccgggcatgctggctcacacctgtaatcccagcactttaggaggccaaggcaggaggatcatctgaggtcaggagtttgagaccagcttggccaacgtggtgaaaccccatctctactaaaaatacaaaaattagccaggagtggtggcacatacctgtaatcccagctgctctgaaggctgaggcaggaaaattgcttgaaccagggaggcggaggttgcagtgagccgagattatgccactgcgctccagcctgggtgacagagcaagactccgtctaaaaaaaaaaaaaaaagtgataaaagcaaggtcttggtgtgtgtcactgacagacaactcccagacaccaaaatggctcagtctgcataccctaaataaaaatgaaggcactacgtggcaggaggggagacaggaccaaggtttgtgggtttgccgcccacaggatgggcttgcagatgccacccgcagacagatggctgggttcctctggagctttatcccacctgccccagcatgtcagttttgccatcaccggtttttacactgagattcagggcacgatgatttgaaaacaaaaatccgtagggagactcccctaggtgttcccagtgcatcaaggtagagcctgctgcaggttgagtttctggaataggtcaggctgtgtctgctttgtttgtttgtccgtttccttgcttttgtgctgcatggggaccctcacgcctaattttccttctccgtgtatacatctgcttcctttaagctccctacagtagagcaacgctcctagattcgacagagatcacttgtgtgtcatgtaatctgtgactagtaagcattaactatccaaatgggagttcgtggacggtgtctgagccagggactgcacagagctcacgagttgctgtaggtgtgctctagagagaaggtcactggggaaaaagcttgaaaacagctgtggcatgcaagggtgtgtgtaggaacggagacccaagcactgtggaaaggaagatgtgctcaggagccccgaggaagtgggctcacaggaattttccaaaatcaagagatccagcctttaactagaaagctccaggtggtatcatgagtgacattagatgatgcctgatacatggtctgtgaatgaatgactgttcaggactgtttgtttttttgtttttgtttttttttgagatggagtctcgccctgtcaccaggctggaatgcagtgtcgtgatctcagctcactgcagcctccgcctcctgtgttcaagcaatcctcctgcctcagcctcccaagtagctgggattacaggcttgcaccaccacgcctggataatttttgtatttttcatagagacggggtttcatcacgctggccaggatggtctcgatctcttgacctcgtgatctgcctgcctcggcctcccaaagtgctgggattacaggcatgagccactgtgctgggcccaggactgttttgatgttaggcagtacagcctagtggtcagcacgtggactttactggcttccccactgtgtttcaacttgggtgttgctgacatttagggccagttattctttgctgtgagtggctttcctgtgcatggttgaacatttaacagcacccctggcctctactcaggggctactagcacccaccctcctggttgtgacaaccagaaatctctgaagccattgcgtcatgtcccctgggggcaaatcgcccctggttgagaaccactggcttggagctatctgtccttgaacaagctacttgacctgtctaagcctgattttgcccttgtctgtgggaagacagagggacaatgaggattgattacctgagacaagacataggttaggagttgttactttttgcagtgacaccaacaccatggggcagacaatggggactctgtgagtgcatagcaaacaacagcaaacagcaacaacaaccagaggtctgctttttttgtttgtctaaatgggtgagcttccaaggaggaaacacaatccttatccttatttcagggccccatacggttctgtggtcgtgaaagggttatatgcggcaggccctgagattcctgttagcaataggagaaacgaaattaaatatgtactgtaatttgaagcactgcttttcatgggaaaagaagttctcccaactcagcctttccaactcttttgtccaaacattaatggcatgcaaatatttatgattcatatgtgccccttttaattcccaatcgtattttaacagtaaacacttcattttaataatgaagcagaataatccctttgtcctgtcgctgggttacacaggctggcacctggcagcatcacattcttcctgagtgatcattgctgcctccacccaagttgaaggggttttgtagcagtgccacggcagctcgccttggactacttgaggacttccggatgttccgctggaagccattcttaaggttgtgtctcagcattttcataaactgcaagtgaacatccatgcatatttttctcttttggccacgtataaactcagcactggttcatctggctgtcacttggaagggttcttactacactattatcttgcattctggccaaatccctgaactctagattacaccgaacccattgtgtcctatttaatattcctttgattcgtaatgatgacatagaaaacacacacatctattagcgatgattctgtgagtcctagaaaagtagcataatgtaatatgagaagagggcacacctgtaggactcagatgtgccagcctcagtctccccatctgtgttcaataggtttaagagtgcctttcatctatgacttatatcatctatgttaggatgataaaagcgagatggtgtgtatgtaactatacttaggaagaagagctagggcccctcttgatgatgttcttccttctacagcgagaatccctgagggaggaggggagagagcaagccagaggcagcatgggtcttgctgaatttgaaaagttgggaatgatgctgtttttcagggcccactcctcgatggcaaggaatttatattccttggtcctgctaagggcctactaaaatgagagtgcatgagataacagcaggcattccataagtattcacaagtaaaagcctatgtaataataatataattacaaacttttattgggcattgaccctgtgatggaaatatagtacctattcctgttttattagaactctccctctgccccaccccccaaggtcatttactaagggcatttctttcattcattcatttatcagatatacattgtgcacctactgtgtgccaggaactgggctagcatgagaaatacgacggtcagccaaagagaacccacagccttgggggctagtaaggaacatggcaattaagtaggccatccctgttgtgagtagataacacatgatagatgggtgtggcgggagccaaggctcagaggtacagaacctggtgaaggttcagagggtctccctggaccacttgtcattcacttgagacctgcaggtgacaaggagactaacccggtggaggcatgaagaatcatgtcccagcagagaaagcagagtgaggaaggagcacctggcctgttgggagctgagagatgctccagtggcggtggttggggagtgatggcggggagccttacagagagatagggcggggattgccttaacatccacgttgggaatttggtctgatcctaatgaaatggagaaccacttataactaactccagatacaaattgtggaaagatacttggcttacagtttaaagaatggaaaggacatttggagggtgcgtggggagcttagagacccatccagagactgaaagctctcctttctcctttcaagcagcgccaggcatgtgtatatccagcttgcaaggaccccatttggtagatggcactgtacctagaagtcagctccctcctcaagcttgcctcaagcttccctctcttccctctctacctccacactcacctgcctttcttcctacctgcagtggcaagtgctgcaaggctggtgagcaggagctgacgccccccaagccttccttccctgaagaatgtccatgcctcaggcctcccagctgcagctctgtgtggccttgggctgtgtgtttgaggcacccggctaggggcactatcggaatcaggaggaggccaggcccaggaggtcactttggtcacttgccctgtgtgaccccagcccaaacacacagcctgatggatgagtgaagactggtaaatctggtggctgtccttgggggaagcacagggcagcaggtgtggccttggtctccagggggctgcgaattcagggttttggggtgttttggttaaaacttggttccccagctgagatcctagggaactgtggtatcaaaaggaaaaggaagattagaaagggaaaatgaaatctcaggaaaggaaatgcaagattgcatgagaacatcatggtgttttgtgggataggtgatattctgccaaataaagaggcccgcccctccactccttttgcaaacctgagcttttcccctgcctgcagttgagcccagcatacctgtgccttggaaaaagcaagctatgccttccaagtgaaattcgacgttgtaaaggactggctgtcaaactgaaagtttgcagagtgattcattgatttttagagacagggtcttactctgtcacccaggctggagtgcagtggcgtgatctcggctcactgcaacctccgcctcctgggttcaagtgattcttgtgcctcagcctcccaagtagctgggactgcaaatgtgtgccaccatgcccagctaatttattttattttattttttatttttattttattttattttattttttatatttttggtagcaatggggtttcaccaagctgcccagactggtcttgaactcctgagctctagtgatcctcccgtcttggcctcccaaagtgctgggattacaggcatgtgccaccatgcctggcctcatttatcaaacttttctttattgcctcagaatagaagatacaaagatgaataaaattctgtccctgtcctcaaacaactcattttcatagaacatctccagagaaaatgctttgcatgtcttcggttttctccaagtaaaacagctatttttcaaacaatccataattccaaacaaatgccatttccatggaaaactgagttctatattctaaggacctgattttcagtctgacttttgagggtagtcctggtgccagtagcttaggcctcaagtctgcattttgcatgtgtgatgtgagtgcgattggatcaagcaatctgcaaatacaggcactttgcacacaagtatatacagtacgccgacatcttaattcaattcagcatggagaatcaggaaattatgtgcaagttgaaggatttgtatcccgtccagaaatccccaaataaattaattatacaactccactgtcaaaaatagtggcaaatgtttgggtaaggaaatggaagaggagcataagcatgaattttggctgttaggttgttccagtggaaaagtgagaaatcaaaattaaaaatacttcataaaaaatactccaaatgcagactactcctggaatccgagggtacgttaatttttatacttagttatccgcaattaaaattagacccaaagccatctattgtaaaaggagaaatctccctgcaacctttcaggatcttgtgggatttcctgaatttgcaaagagcagaacctgagccttcactgactctcttggtttttaaaagctgcgatgtttttcttttatttttcctttctcactctttgggcgtttcaagactctgggcacaactggctttcctgcagacaaacacaagagtgaaaaatgttgcgattgtgtttcctaaggactctgagcccccagggcagacggctcctttgtgtctgcagccttcctttgcgtgacaaagggcaagtttcacatcccctgaaactgtccccaaaagaagaagatgactcatgcttacagacctacactaaggagagtgacaggaacagagtctgctgcagagccaactcaggtagaccggggatacctgcaaactagacctgaggaggccgagtcacaacaggagtcggggctcgcccgtcagacacggggtgttataggaggattctgctctgatgtggcctggatgcacttttaaatatgttcttcacacctaggcaagaaatgaccccgagctgcatgtctttttgctttgtaatctccttgccaccctcagctctttggggagcagtgtgcacatttgaagcaatcctgaggtttagccacttcccagatgtggtgaggaagtggagagtgcgctgggccatgcggaactgcaggttccagccgtggctttatttgaccacaattggctgtcagagttcaccagccccagggccgccaacgtcaagactaatcaagcctagacctggggcctccccgctgactggccctggggagtgtgtcatggcagcgagtgtccaggaagactcaccccttgaccttcttcccaactaaataaagcagttagtattttgccctggcatttggatggacacactggcgtcgagggagacaacacatgttgcagtgaggagcactggcctggcttgtttacatagcatatcagccactcacagttgtgccttacaaaggtcgccagctggcggggcaggagtgaacttgaacttgaagttcaagttgcgtttaggcctggtagcagccccatcacctgctgaacacacacacacacacacacacacacacacacacacacacacacacgcacaaaacccctcctcatgtcagacgtcagtgcctacttcatccccagctccttcttacgggatctgtcacagctctggtctttgtggaatcacctttatcatgtctttaatgatcattccactgacatttactgagacctttccctgtgctctgcttgtatattcagcattccatttaacctgcagaacaatgctacgagatggaatgactgttattaacccccttttacagatgacaaagctgaggccccagagaggtcaagtaacttgcctgaggtcacacagctagcaagtggcagagcgaggttttgaacctaagtaggttgccttgagagtccacactgaatgaatcaccactgtgtttccaccttcatgggattttatatggaattcttctctctcactgcttccaagcctacatcaagacaaacctcatctgccctgttgttttttgttctcaccttcttattcagtatgagtgtcgtttggtgcttctaatggtcttctaatggtcctcctggaacccaagccctggctggaactgatgctgctgtggtggtcagggttcagtgagcaggaggaaggacttggtgtttaccccttgtttacccctttccttggcttccttccatgcaggccaccctgtgaccccgtggtggccccctctggaaccaagagctgccgacttccagcagcacacacaggatcagtgctggggccatctgtgcactgaccaaagcctctgctggcctcaccagaccaaggccagtgagtgcttcagggagccttggatcctccaggctgccaacagaaacaccggccctctcggcagcagccccatccttccacccctgcactgggtcctgaaaagcccattttggggccgttgctatttagccaacctgccctcccttgctctcctgtgatttctcactattccggctgcagctcgctgggagaaacacttgagagtcttttgtgctccacacccatgtacttaaaataccaggcctataggtcatttcaatgagggaatttggctcataacacgtgtgccccgaggcacagatcctacttctgcagatgctggccaagaagggctgtgtcccagccgccatggggtggggccacagagagggcagggccacgtggagggcagagcatgtggctcctgtcaggtgcgcccgttgctgactgcagcccagtatcaaggctctgctgggtctcattggaagaatacaaaggacgtgtaaggcagttttcgtgctgtggaaaaatgtcacctacacctgtgaagaagtcatcactgtgtctgtaagataataagcaaatgtccttgtacccaaagctgtaaacaagagccctttgtgagggagaaccacatgactggccaaaacgccccacctactagtgtgtgctcggtggaaatgtcttgtgactgtgcttaaaatgaagggcatgattgggaggccaaggtgggcggatcacaatgtcaggagttcgagaccagcatggctgacatagtgaaaccccatctctactaaaaatacaaaaaattagctgggtgtggtggtatgcacatgtaatcccagctactcgggaggctgaggcaggagaatcgcttgaacccgggaggcagaggttgcagtgagccgagatcacgccattgcactccagcccaggagacagtgcaagactccatctcaaaaaaaaaaaaaaaaaaaaaagatgggcatgaaataatgagaattcagataatgaccattcatttcacaaattatcactttgattaagttttactcctgattatataggttagtctgtggtttaccagatggggtgtcatgagtgctcaactgccagaggcccaaacgcagctcagtaagaaaatgcttttgagctataacccaggttgagtaccattggtacattagaatcacagagtcagattttactttttggggcagtggtaggtgtggataaagtatctccagtccagatttcttgtactggtgctattgggtttgcgggtggagatttatgacctcagggataataaccggaagaacagtgagtagaaagctcagggatatgagttttgctgtatatcaaagctgtgtgactttgggaaaattacttaacctttctgggccttagctttgctacctattcatcaagaacaataaaatccatcttgtttatttcatgagattggtgtgaggaccaaatgaaatagtatatgggaaggtgtttaaaaagttgtaagttctacacgacttaaaaatgccagtattatgaatgcaaccattctttgttgtcatttgggtagtcgtggatagcgtggtggtaggagagccactatcggagcaagactgttccagagggtaaaacacacgcgtgcctgtagagcagttgtcactggtagagccatgatgggagctcttactacattgctatttgtactgagttaaatagtgttctccaaaaagtgtatgtccacctagaaccttaaaatatggcttaaggtctttacaggtgtaatcgagataaagtcatactggacttgggtgggccataagtccaatgactgatgtccttctaagaagagggaggggacacccagtaggaagacagtcatgtgaagatggaggcagaggctagagtgctgcagctgcaagtcaggaaacgccaagaaatgctggccaccatccgaagcgagaaagaggcaaggatcctccctagagccctcagggggagtgtggccctgctgccaccttgatttgggacttctgacttccagaattgtgaaagtcttaatttctattgttgtaagccacccagtttgtgataatttattacagcagccccaggaaacaaatacagtatttttatgaagtcactgaggtgctagagttgtaggcaacagaagaatcacacgtggacctgcccgcctgcacatggctatgggcatctcaggccagctgcattcttggaagatgaaatcagagagttgaaagggacattgcatgcatcccatgaacccccctcattttgctgatgaggaaactgagatctggagaggtaaaatcgtttgtattgcatccccaaacttgtaactctcttgctgaaagaaccacctcagtctctctctctctctctctcatacacccacatgcacccctagacctactcaggactgggacaatggcattatctattgttgtgtcctcaagggacttttttttttttaattttaaataccccctctctcctaaagccccttcccacttgcaccctttcccacctttctgtgagggctacatgggtatatagaaaagggtccccaccttctgggagactaggtctacacagccgcaaactgcattcagtatgacaccctaaataatcaaaggtgaaggatgatttatgaggcagcccaaacagccataaagcaaaatgtagtcatcaaggaaggctgcctggaaaacaagtgactgagtgactgcccgttgccagatgctgaagggcaggaagactcgggtgaagggtgcagcaaggagccttggattggcgaagtggctggaggaaggaagacctcagcatctcaatgccatggctcatgggtagaactcggagggtgcacactgggagtcaggtatgcggaggagagggggtgagtgagaaattacttggggcagggtcttattagtgagaagatcctaaaagcaggttctggagttcagtcttgatgatacaggtgataaccttcatgggttcttgacagagagggaacaggctgaccatgaggcttgtaggacaatctgttagtcagctctggaacatgtggatgtggctgctccccgtctgtggctgtcattgctcctggatctgttcttggaaagccagagactgcccagtgagatgggcagttgcccccaggacctgcctccctctgcggcagcatcttcctccacatcacatcacataccctgcttgctgggcctggccaaggcctcttctacccagtcctctccttcagctagatgccacggtaggaaagcatccagagtgtcgcctgataacatctgaacgatgtcctaaaactggcaaatccccaaaggccaacaagactcgtctctaggttctggggacaggccagttgatgggaaagatggatttggaggcagagtctcctggcatccctgatgctctgctccatggaagtcactccccagaagcatcctcacctcgtttattggacaggtcagctgagactttagttataaaggcacaatgggcagagcagccttcatcatctaattgttacttgctattgctctttttattatagactttaatacagatagaatccacatctttggggagtgttcggtggagatttctcacgattaggaatcgtggcttgctgtggccaaagattatattttcattgagcatttttctgtggccttcctttgtattaagacacgcatgacatttgtttttctgtggccttcctttgtattaagacatgtgtgacaattgaaaatattttcctttcatctgtctttgatttactttatgctacatgattaagaggagaaactatgttgattaaagaactactgtattgatgtaggaagattgaacatcagacttaatcaaatgttagggtcctattatagacccgtgagaaacagagaagagaaataaagcagacaacatacacacacacacacacacacacgcacagacacaccctgttgaataccgtgtgccagataactgttttaacagggttactcacggtaaatcatttaatctcccctaaaactctctaaggtaggaaaatttgcatgtaaccatcttcctggtaaggatactgaggaacatagaggtgtctagtgacttgccaaaggtcagctagccagatttatcttctgaatcactttaccaacaagaaatgtttttagattagtaaatctatgcaatgaagattttctcaccttttataaatatatgtaaaatgtgtaatggaaattttgtgcattttttattactagtacttattgaatctcagtctgtcagttacatatacttaagtccatttatgagtcatcaattttattctgactgatcccatgagtacctctaataacatctggcattttcaaataatatttaaaatcagccagacttcgtcttttaaaaatatagacagaatgattctaatttagcctgttttcaaacttagaaattctatctttcctgatcttcaaaggtacaaagtaagaagagaaagatggatatggtttcttctactcttatttgccctgaattataaataattgggaaagatgggagcagggaagttgggaaccagaagtggagagctgccaatctgactctatggtttccggaaatcctgacttaacagaaaataaattctaatctttcttgatcttgtattgtttattgatgattacattaaagccatataactatgtgaagtgttacacttaggcaactatcataggtgtgtattccagaattgaagcaaagccaaaattccgggagtgttgtcaaaactggtaacttgtgctgaagggctggacagcataaattaatgattggttattcaacagatatgttcaggccaccaacctcattctgttttgttctctatcgtgtccccacagggaaaagcttcactctgaccatcactgtcttcacaaacccaccgcaagtcgccacctaccacagagccatcaaaatcacagtggatgggccccgagaacctcgaagtaagtgcatccacttggggctggtacaccctccaggctggtacaccctccaggctggtatactcagggaccatgtctcagattccttgggttcaacctttcccccagggggatgtcaggcccccgtaaagccaaaaagttgcattgtcaatactctcgctactcaaagcttgtttctgtgcactgagctctttttgaagcatccttttagagggcaaaaggaaattaggctgactgaatcatatgttagaaccattcagggcagcatgaaactaaggactgcttcctcaatatacagtaaagttcaacaggatcagaaacaaatagtaaatggaagattggccaggcacagaggcagcccaaagaggtctgagggtcagagtggaccacaagggagtaattaccgtctatgctggccttttattaattcatgagggccagagatgaaaactatgaaaatgacccttttctttctatggcacagatcaaaatcttattacaggcatttttaagatagagagtgggagggtagaagaatgtctggggaaaaccagtaaatatagaaagatagtaccaaaaaataactcctgtgagggaagcttttaaaaaaatgagtgaggttgtttagtctgcagaaaagatgtcttcacagtgacttaatgactatctttgagtaaacaccagagtaacgctcttttccagaaccacacccttccccaggatctgaggctgggttacagttccaggtctgtggaactgcccagcacccccgcccagcatccagatgtctccaaaccgtatcaggtccctggtggaaaattaatatactctcttcttggagtgagggatattgaaaaacagggcttcctactgtccccaaaagccaagatgcagggaggtcaggttgtaaaatgaagtggttaagaatttgggctttatgggcaagccagtggaattcttaagccttcagtgagctacagagccttgctgaacctcactttcctcttctgtaaaatggggataataatgagagcttctttataagatcaagccaaatgatgctgtgtgcctgatgcagagaatgaaggcaggaaatgttagtgatccccagtagggcatccctgctttcatccctggctactgctccagtcccctctagatgaccttccctgcatggtggtttctaggtggggttttaaggtagttctctgcaggctatcctgtgatcacggcagcttttatggcagccttccctgtggtcctggccacaacctcatggcatctgggtcaccttctggaaccattccccaagctgcatcaactttcccaaagtccttgagtggatggagctctgcaaataatcaccatgcccaccaggggcaggccaccaggatatggtgttcctcgtctgctttttcccttccttccatttgctgtgctcggtgactccctccagatctgactgcatttttccccagagggccctctcagctttttctgatcgagactttctggccatgcctagacttgggagactgtgggacttgataacagaccctgattcttctttatgagtgaaaagcaggccatagacacagacaggaccacacaggtctaaggaatgactgtgagctcttcttaggtttccagagtaggaatgtcaacctggacattcctacgttaatgtaaccctgcattaaacagaacataaacaccaaagcaagtttgttctccacagaggaccaaagaggaagcaggcttgaattatggcaaggggcctggctgggagggaggcagttgttaggtataagaaaatcgactttgagggtgactaaacttagagaaatgctccttcaggaggctgtagaaccactgtatttagaactagaagcaacagccgtctctgggacagttgaaatgccgaccagcctgaagaagccgaagccaggtgaccctgggtataccctctacttctcttatttcctcatgcataaagaaggctgggttttgcctcactgccagcatttcctgtaacattcaaagaaataacaaagttattgagcttcagaaaacaaatggtggcgactctgacttttaagaattggcagtcagaggggaaaaaagatgtctatgcgattgtaacggtctggctgtatatacagtttactctgcccctgctgttttacaacttaagaaaacagttgttatatggagaagcaccctctgagcagacagaagggatttgcgccaaagaagcatccatttttacacagtcttccctgccaaatggaatttggggcctggggaaaaactaaatgcgtggaataagtataagtatgatatatagaggtgcaatagccccaggtagaaagtctcacattttacaagggacttctagaaaaaagccaagtgcatgcagactcccaggttgacttgggtaatgctgacttttctatttgccctgtgaagcaagaggggccatcactgctaattttagtatgctggtttcttatggtttgaacgtcttcattcagggtgggaactttctatagtaagctttgctcacagttgctttccagtgtaacataaagagaggacactgcatgtaaatcaggatgcccagatgttgccagatctctggatgaataagacctcccgagtcccctccatgattatggtgcaatgaattctgggaaatcctggcaaaatggccctggcattgccaaggtcaaattgaatcattttggaaaattctctagtttcataaaatcaaagacaatgagagctaggaggggcctgagaagagcctttaggatcatcaccccataggtaagggaaaatagccccagaaaaatgaaacggtttgcctagctttaaaagagatagttgatgatgaagcgttaacagaatgaggagttcctgatgtctacttctgtgctgtccttcatttatctacctgtccattcatctgttcatctctctatccataccatactgtctgtacatcatctatttctttcttatagactctttgacctggcctcggtatcctcacatttaaaatgaggagttggcttatatgattggctggcatatttggctcatctcgaagactgtctattatagaagggcaaatggtagtgcctcattgcaggtgtggagcctttgacttgaggtatgcgtgcaagcttaactaaataaagcagttatctggcatttggagggacaaactgccattcaacctgccattccgctgactaagttaaggactgagaatgagaagctgtgccacagctcgtctgtttttcatgccgacgggtaaacttgatgcatccctcccctcttccagggttttcagtggtgaagctgtagccaaaagtttacgccaaagggaatttaaagtgtttttcgtttcagatggtttcttgctcttttacagtaatggacctgccccttagaaaatcaaaacttgtttttctcatattccataggattttaagaaatatcttagagtaatatagaaattattaattgttgaaaaattaactttatcatggagcaagagcaccatcaaaaggtatcctctgcctggaatgggttcttaccagcaccaaggtgggctctgttttcggttagcacgtagagcacttagtagcttgttgatatactgagagtgtctcctccttaagcacaaaagatagagcgaaaggatttttcaagaaaaggatatttgagagttttttgtttgtttgtttgtttgtttttgagacagagtctcactctgttgcccaggctggggtgcagtggcacaatctcggctcactgcaacctctgccccactcccaggttcaagcgattctcccgcctcagcctctggaggagctgggactacagatgcccacaaccactcccagctaatttttgtatttttagtagagacggggtttcaccatgttggccagcctggtctcgaactcctgacctcaagtgatctgcccaccttggcttcccaaagtgctgggattgcaggcatgagctactacgaatggctgagagttgtttttttaatgtatgttttatatttctaggatctaatgaaaaactccagctctcagctcacaaatctgtaatttaggtgtctctatgctaatattgagatcccaaagcatcttctctacagagatttcattaaataatttcaatgcaggaattggttcaatgccatggaggaagatattttgccaaggagaggttgaggagagtgagcagtggggaccctaactgacccgtcttggggggctggtcctggtggtatggattgggcagcctttacctgtctggtcaggtgtttgttacgtctggaacattgagaaactaaattaaaaatcaaaaaggttaattaacgtattggccatttctgagataacttctgtctgtccccaggttaaaggagtctttcacgtgactgtgttctgcttgagctcttgatttttttgtttgtttgtttaattaaatatagttatttctattttaaaagtgaaagagctggctgtaattttggaaaggtgtaacccagcagatgccgggaagtacaaacctggagggaaggacaggcctctgcagctgcccccctcctcacaggcaaggatgaccatgtctagagctcacgggattccttttgggtggaggcagcgttgcctctgctctctgggcagcccgtccttgaggaccaggctgttaacgtagagtcttgtgatgtggtctgtttaagggtggggcttctagcatccatacatcaggtgacatctgggatactggcttagagggcagctagggagtaaggtaaaatgtgcagctttcttttttctttttttttttcttttttttttgaggtgaaatctcactctgttgcccatgctggagtgcagtggtgcgatcttggctcactgcaacctccgccttccaggttctagcgagtctcctgcctcagcctcctgagtagttgggattataggcatccaccaccatgcccggctaattttttaatttttttcatagagatggtaaggtggagccattacttacaaactgtagagtgcttcctgaggcactagctttctttctgtctgatttttgtttttagagggagttatagttaaaataggttgatcaaagggcctaatcttcactcagctactttttaaagtacttggttgagatcatgtcatatgagtataattcttctatgactttgagtgtgtatagcaaacctattatatatgtgaacatgagaaataggatctttatatatggagaatgtgcttcaagtgaagaagagaaatgcatgaaaagtacctatgggccaggcgcagtggctcccgcctgtaatcccagcactttgggaggccaatgcgggcggctcacttgaggtcaggagttggagaccagcctggccaacacaggaaaaccccatctctaccagaaaatacaaaaatcggcctggtgtggtggtacacgcctgtagtcccagctcctcaggaggctgaggcaggagaatcggttgaacccaggaggcggaagttgcagtgagccgagatggtgccactgtactccagcctgggtgacagagtgagaccttgtctcaaaaaaaaaaaaaaatgaaggaaggaagggaaggaagggaaggaaccaacctgtaaactggtggtgataatggacctaaaaataattgctcttaggattgagtaacacctagttcacattgttattttctcttaatcataaaaatactcgataatagcaatagctaacattaaatagtgttatttgcccaacactgttcacagtgcttcacgcatattaatttatataatcttcaaaagaacaggcagggaaattgaagaaaaaataaatcgtataccttgcccaaagtcacgcaactagtaagccagcatgtaaactaaggcgtccagatgctggcacgcaccgatgccagggtctgtttttaagaactgcactggccgctttttgagcttcatggtaatgtaattcctgtattttttattgggagagtttatcagtaaagttctgggtcacatacagttttcttcaagaaagcagagccctgttgctttggcattcatcattttttttgtactgacaggagggaatcagtgttttccccggcagggctgcaggaagtaccctcccctcccacacctccccagagttcataatacacagccatggccatgctggtcacaggtgccagcagttggttctgcttctgtcaccagggtccacttggggacctggcatgaagggggacctgaccccggggtgttgtacaacatagacctcttcttccggtgttggccttcacgaaagatgggtaaagtggagtgacctgcagagtagtggtccaagtctgggtccccctttaacaaagggtttcgtggagggcccgtgtgcacagcacgtagccgccggggggatgaaaagatgtgtcactctttgctcttgaatgattatgaaaatgtcagatggttttatggatctgtgatctcaggattgtaattaccaatccacaatcgcattgctcactgggaattgcttcaagcgtattttccaggtagtgaatgatgagctacttaattcctcttcccttgaattcatcagatttggacttggactttagttctttctagatgcaatcctgatccacacaggaattagaaagtaattcttcctcccctcccacctaaagcaggagcaaggcagaggctcaaagaggaggaaaatgctgtcgtgactcacatcccctcctccccactttgaaaggcatttcaggccaagctgaaagttctgggggaacttccccctggtacttttaattccttctgtgttaagctcctcaactacctgatgacttggcaaaggcagtttttaaagcattaataataatcgtgcctaaatgtttccagcgaattttagaatgtctttctgttgaatatttttagtagtatcaaaccagtccaagaagaagaattttacatgcatacagacttccttgaccctagagtggaggttaaggtctgaaagggcccctggggtgaatgggaacctaagaggaccgtgaagggaatgggcttctgtcccagaagcggcagtaacccacctggtgcagctctgagtgagctggcgtggcctgtgtattcttggtaacttttcctgtcttatacagaaaccactgaggttttttgtgtgtggttgttgttttgttttgttttgttttgttttgttttttgagacagagtcttgctctttcgcccaggctggagtgcagtggcgccatctcagctcactgcaacctccacctcctgggttcaagcaattttcctgcctcagcctcccgagtagctgggactacaggtgtgtgccaccacgcccggctaattttttgtatttttagtagagatggggtttcactgtgttagccaggatggtctccatctcctgacctcagctgatccacccgccttggcctcccaaagtgctgggattaaaggcatgagccactgtgcttggccaccactgagattttctaagatggcatttgtattgctatagaaagaaaacaaaataagagttccttccaggtaatgtgaaaacccaaagagatgatctaggcaccttctcaatccaatgtgggagcagagaagagggaagaaacttacaccattacattgaatttctctttccgtctggaccctcgcaaaaccatatcactaatttgaatgccacaccagtgaggtcaggatctaaactaatatattgcagtccttgttagaattcattgtatgacatgccataagaaaaaaaaaaccctgtctgcatttaggcttctgtttcttaagcttcaaacatgtaaaaagttttctggatcctgaatttagggacctgggttttcacactggtgccaccaggccagtgggtgtgaacttgagcaattatcttaaatactttcgtcttcattttcctctcctgttgaaccaggcaatgggacgagataatctctaaattagttctcatgcaaaaagggtaacaaaatatggtcagcaaaataaagccgtaagttcgttcccgtaaactggccccttagaggccgaggcctccaggccttccctgggcagtgccatcctaaatcacatcaggcaaatccacatgcactcaggtggtacatgagatagacgtcgtttttttgctgtaaagtttttaaagggctttctaatttgttctgaaattctctggctgtaagtggctgccctgccttctctgccaccaacatgtaatcaagactaggggttgaggtctccattttggcacttgctaacactatgagagccgattcctgggggagcagctggtctgactgagcctctccaaaacggggacagttggtagtaccaccgtcacatcactggaaggctgaatgcagcagcctctgtggcttagaaccatgcctggcacacaatacatactcaaaagaggacaggtataattcagatttagtcttgaaatccttctggaaatgagaaaactttaaccaaaaaagatctgtggctcctaaatttaaaaattcatgaagttgccataatggtacacttttttttttacatttaattaaacatttataaattttgatttatttttctggatttcgttttgtgttgagacccagtaaaatttcttttctagtatagcatgggccctggaaacactctgggcactgttcctaagtcactaacgggtgaaatggccttgcccccaaatgttgcactttgtgaaaaagtcagaaagaaaagtcacgtgtgggtgacatcaaacatcagtgcttaagatctaacacatgggtcctgttcagtagaggcatgacacagctgcagaagtctccacactgtcctagaaacgtgacgtgtaatgtagcaggtgtcttggggtcggaattcttgtactaggcaaatgcagtgtgtctcccaagcgtgcctgggatctctccccgcagccaagctttgcaagcacataaacatggccggccacccactgagtttcctaaatcagtgaccagcactggagacccttccatgtgtgcaaggcagctccgcctgctgcctgtgtcctttgggggtctgatggggcagccccagtctgagatggtcaggccttgtcattgggtgcacgtctcccatggggatggatggacccacagctttcagatggattgcggttggcagtcacagcatcccagcacattaaaatacatcaactcctgtgctttcaggtagatttagaatttttctcataccctagccactttccatttttcattttgaaaaatttctccttgagttttctcaaaggcttcagttttttttgttgttgttgttttttcctgtaagccatgtaactaggaaaggcattagtaagaatttgatacactgggtctcatggaactccactactaccaccaaaataataatagtaataataataataataattccagtttagcttaaataagtaaaagctacccccttacaccatatctgcatttaaattcatttgagctgataggcaatttctgtgttctcctgttcatcgcatattcttttcctttaaaggcaacttttagagaaggtttgcttttttttgctatcaaagtattaattatgaaaagttggcaatacagaaagggtaaattaggtataatctattaccgtacattatggctatattatcagacatatcacaagccagtgacatttagttggatgtgaaattccttttttatagtatgattgacacatggtatattttcatcaacttctatgtgtaaattatgccgtgtcactggtaaaatttgctgtcatgaatagccaaatattctggattcacattcataggtgaaagccaagctaatatatatatatataatatatattatatatatactatatattataatatatagtatatatataatatatatactatataatatattatatatagtataatatattatatatactatgtatatagtatatataatatattatatatactatatataatatatatagtatatataatatatatataatatatattatatattttatatataatatatattatatatatattatatatatatatatgtacccaaagcaaagttcttttctgtttgccttttcaaaaagtaacacaatggaatcaatctgccaactctcaagacccctagaaagttatttaaaggcagtacattggtttggtactttcatgatatacatatacttagtttccattaaagcaattattgacaaaaacccagactgctattgaaatctttcagtgtacttccatatactgaaatgtcgaacatttgatacttgtttgattttgtatttgtttttgttcaccatggcttaaaagtcatattctgattatttaaaataaagagtaaacatttgaaataagttcctagatactacatagatttatggccctttgaatattttcctggtaccaccttattttcacttacctttgaagtggttgtatgatatttccagttcattcatttgaaagagctaggagaaatatgcggagccacgtcccacgcgcctctcggacactactcgccaggcatagcccagtgtttcaaaagtgaaccagggggctgggcgcggtagctcacgcctgtaatcccagcactttggaagcccgaggtgggccgattacctgaggtcaggagttcgagaccagcctggccaacatggtgaaaccccgtctctactaaaaatacaaaaattagccgggcatggtggcaggcgcctataatcccagctactcgggatgctgaggcaggagaatcacttgaactcgagaggcagaggttgctgtgagccgagattgctccactgcactccagcctgggtgacagagtgagactctgtctcaaaaaataaagtgaaccagggtgctcaggtagcctcggtgagcgagaaaggagtttggagcttcaagtctaaaactgcgtttcacagttttcccatctgtagaatggactgcatgatacctctcttgctaggggatgtgaggattaaaagagatagcctgaaaggcgagctggagcagtggctgatggcgaagctccagagctggcttcctgattcagcctggcctccccttcgggatcagattaacctccccaccctcagcctccttgggtataaaaccaggagtatgatatccctctgttggggattattgtgcggattgaataaaataattcatgttagggcatagcaccgtgctgggcacagaagtgttccttaaatattagctgctattattaaagcacatgctctagacgggtaggccccttgaccatgtcccaaagaccttatgagaggaaacaaatggaattctgttcaagtgggggccaaatatttaccattgccaagtacttaaaaaaaaagaagaaaaaaaaaagcttggcagatttggccctcacaatacagtacaataagggctttttctcttttccttccatactacctattattaattccaattactgcatcactgaactggcttcaacaaatgtattcctcattgaaacataaccctgtcaaccatgttgccctacttccttgagggagaggtgatctttttccaattaaaggttttatcaaaatgcagttctgcttcttaacatgaagcacctatgctgttgtgtgacctgcaaagctctgagcatctagaagcttcccctgggtcatctataagatgggaataatactatgagttctgcctactgcacagggttcttgaggacacattgagataatatatatcaatgtgctttttaagtagtctgtcaattagataatataaatataattagataattaaaaaatagaaaatctattattgttttgcatgtactatattaaaatcttagggattttaaataaaattaattgatttattgaaagtagatattatctcgtcgtgtctttcaggattggtgagaagaaattaaagagaaaaaatttaaacatttaaatcagaccccactgtgaatccatacttttagaaattttacctttttccattcacatatcttaatgttttctctacctacaactagataccctttttaaatgttggaaacaaaagaagtaaccttggcaaatagttgagaactgagttttatatgaatatacttttctcttgcaagaccaaatacagtttttcttctaaaactctgttattccattttctttcaatgaaatgctcacagaaccagaaggcttgggaagaggctcagagcacctaagagttgctgagtccgtattccttttttcccctgtggctttttatatatgctgctcgcctgagatttctggatttgatttcagggaggtgaaatgttacacccctgagtctcagtgccagtttcccaggacgagtcaaaaactgcagctgcttggaggtgagaatcttccaaggctccagaggccagctcgctgtcctgttcatttgctgacatgctgccgggagcagcttcagagaaacccgttctattcttcgggtgattcagccagtctcaaaataaataggtagctgagtgcagggagaaagaactggaaaccactgaaatttgagtcttgagggctggtctgttctcgggagctgctctgttgaactctaaaaggaatcttgagccctgggcgagggagtggcctgacctggtggaaagactgcgggcctgcccgtggagtctatgtctggccctgctagctcagtcaatctcagcagctcatgtctcctcttagaccctcagattcctcatctacagaaggagaaagaagaggagattgaatgatttttaaggtctttatcagcttctaaaagtttgatttgatggttgtaggagcaattgttctttcaaagcaccatcttctaacctcaggaaggaaagcccaggggcccctgggatgtcctgccaaactgggaagacaaagattgtgactgagaaggtgggggcagggcaggagaagggggaagaagggagaatggatcaaccccaggccggggaaagagatgaatgaaggtccacgccagagtgacatgctctaagtaggggaaatcttcctaactagagttcccatgactttggcaacatttgaaaaaaaaaaaaaaaaaaaaagacatccttaaacccacaaagtactcaattgtccaagccccattatggccaacttcccaaagctggctggtcagagaccttggtgttaattcctcagccaactaaaaaaagatggtgtaagttctgttgacttaattgttggagtgtttctgagtggggccgcctccctcctctgcctcctcacagtattatgggctattctgcattacctgccctacctatcttcataatctagccgcaaacagctttggttgaccacaccacttccctattgaaagttaatactgtttgactcattctgtgttactaacctgaagccaaagaaaacaaggcagagaataactggcttgtgtggagtttggaaagctcttggaggccctgctttcaaaatcctatacagtagctttactatatctctccgctgcagctgctgagaaaatgaaggaagcagaagtggttaaaaaaaaaagttgggggtggggaagagactgggaagggagtggggcggggtccccctccggctgggaaaagacagggtaatctgcggcagtttatgagggctgtctccctgagctgaggtcttgctttcacacaccagagtgttcacacagaagagggactgttgaaggagttaaaaggagaggaaagttcaaaacagttgttgaaaaggcagctctcctattgcctgcgtaacacagaggagctgggaggctggtctcaccaggccaggcagccataggcagagactcaaggtagacaggccagggggaagttgtgtacctttcgaatcgggaaaggattgaggagggggaatgttgccggacagaaggctgtcctgggcgtccatccttgccctccatccctgtctccatccctggcaaggatggaaccttcccttccttcatttcctaactggctcaaatgtggtcaccaaggtgaataggaggcactagtgtcttggaataaacagaactttccctcccaatgttacctggcagacagtgggaccagcatcttcatcaccatgctgtgctctgtgggagtctaggcaaacagccacttgcccattcaggtaactttagaagaggtctccctcctcacagatgcccttctcagcaggtggctgcttctggcacgtggacaacagtgcatagaagtgagcctgatgcctgaatgaggctgtcatgacacaaacaaccggaagccttatttgtgagggagggtcaacgttctgttcaaaacaacttgctgcggttggcttttgtactagtgagtactcaggagctgtgagtggccagggtaccctgtccttctgtaccagccaggacctgctcagccatctgtccaagggctttgcaaggccagcctagaacctcagttggcgtctgtgacaggagagagcgtcagagtcagatgctgttcccctgctgttgggaaagtccccgaggcccagggggcagggcttttagaaataggagggaatttccttccctctttttagaagtacagaggaggagagatcatcctccacactgctggatgagcattccagaataaatctagtccaggaaaggggctcactcattcattcattcactcactcactcattcatttatttgtccagcatttatggaggcatcacccaaccttggaagggccctgcctttacctcggtcctgtccaaacatgctcagtgtctctgcccattatgtatgagatctgctgctgcgggaggggaactgagattcctgcagggaggttaggaggccagtgtggagagcctcagtgctggtaacatgctcacgcaagcagtgtgtgtgcgcctcctggatcttcttctcctggcccccaggtcttgcctgtctaccccaggactagccctgctgatgcctgaactccaaagccatgtcagaagctccaggcagcgttctgtgagtcagtgctcatatctccatagtgcgccacccgccaccaatactttctttctcttctgcaagtcgccttctctttagagtctgtccctgggcaggagctactctgatcaacaaatccatgtcactggtggttaccactctctggttacttttcagttacgctgtaactgggggtttccttgagataagaccttaacctagggagggttgctaatatttgggattataggctggtagaagaagaaaaaccttgaatttgggagctgtctgcacccttcttaagaaactgcctccacttcccccacagagggctacctctggtcaagagcaaaagccagcaggtggcttctctgccctgagctcaagttacctccttagtcaccagacagaaatggacagtgagccctggcgaccggggatggcagatttagattttgagtgctctgcttttaggagaggcccgagtctcatgtgagtgggcgaaaaactccactgctcgtggcaatgagccctggactcagggagcagagttttgtttgggtttttgtcccgtgagtcttgggcgcatggtgcaggggggctggggaggggcaggcctgtgtgcgtctctggcttgaagttgtattggttgttgatcttgccttggcgttggccagcctttcctgtccattgactgttgcttgctacacttgtcttggcccatgtcctgagggcgatcacagaacggtgtgtgtgtgtgagtggatgtatggatgtgtgatggatgtatatgtatgtatgtgtatatgtgtgtatgtcagtatgtgtgtatgtttgtatatatgtgtccccatgtctgtatatctgcctgtgtgtatatgcatgtgtgtccctgtgtgatatatgtatatgtgtgtgtgcgtctgtatatatgtgtctgtcctggtttgtgtctgtatgtgtatgtgtgtctgtgcatgtcttaatatatgtgtctgtgtgacgtatgtacatgtgtctgtgtgtatttatatgtgtgtatccccatgtgtgttttatatctgtgtgtgtgtccaggtgtctgtgtatgtgtgtgtctgtatgtgtttacatgcatgcctgtgtttgtgtgtatatgtccatgtgtgtctgtatgtgtgtttatacatgtgtgtccatgtgtatctatattttgttttgttttgttttttgagacagagtctcgctctgtcgctcaggctggagtgcactggcatgatcttggctcattgcaacttctgcctcctgggttctagcaattcttctgcctcagccacttacttgtaactgggactacaggcacgtgccaccatgcccggctactttttgcattttttagtagagatggggtttcaccatactggctaggctgctctcgaactcctgacctcatgatctgtccgcctcagcctcccaaagtgctgggattacaggcatgagccaccgcgcccagctgcatctgtatgtttttatgtgtatggctgtgtccgtgtgtatgtttgtccatgcatgtctgtatgtgtgtatgtgtgtgcatgtgtgccatctgtgtttttgtatgtctctctgtgtgtgcgtgtgagagggtactcactacaaagaaacaggagaagctggtggactttgcttatgtcagagtgccactctcaactcagcaaaagagcctttgacctattctttttgatttttcactatgaaaataaatgagttttcctgattgatttaatttttttttttttttttttttttggagaggtctccctctgtcacccagtctggagtgcagtggagcgatcttggcttactacagcctctacctcctgggttcaagagattctcctgcctcagtctcccaagtagctgggactacaggtgcgcgccaccatgcttggctaatttttttatatttttagtggagatggggtttcacaatgttggccaggctggtcttgaactcctgacctcaagtgacccgcctgtgtcggcctcccagagtgctgggatgagccatcaggcccggactgattcaacttctaatgagacaattctcatgaaactgctcagttatgatattgtattttttctcaacaagaagtttttctgtagttacatttcagctgaaaactttaattacaacttccttcacctgaaatgatttctgctttcccacaacctagtggagggtgattggacagcaccaatcatgaaggacctgagtactcattcattcattcagccaacattagtgagcctcctaggctccagttggttttataggtgctggagacatggctgtgcagaaaaaatacaaaatccctgtctttgtagactttacagtcccatgggtgcagacagaccctggataacattaacatgtgctatggagaaaacctaagccaaagggctagggactggctggatgtgggatagtctgcaacttaaaaggggatctccaggaactcctcagggagaagatgacatttcagcaaatacttgaagggtgggagggatcaggtccacagggatctcagggaagagcttcctgagcagaggaaacagtaagtgcaaaggccccagggcagtgacacaggggcaagagcaaggtggccactgctgccggagcaaagaggggagctcaacctatctgccttctagtttcaagtaggaggcatttgccttagaaaacaggcttaagaaaatgccacctgacctcaggtgacatgacctgtacttcatgtcacctgagaggccactgtaggaccatggttcgggaaggcccagagtaggaaagccccatacacaggtggacccagtgagtgcttgctttcctgttaccacccacaagagtacaaaagctctttccgaccaaaggctctgctattcctgctggtgattctctggggctaaagcatcacccctctagaaatcgctgagtgggtaaaagggattcctaggaagtggaggtatcctaggggacttgccaggattcatccacctctaagaggcttaggggcatgagctagaggaacaggggcctgcacagggagtgtgggcggggtgggtgacaggtactcacctaagacttatgtgcctactgccactgatggaaaaggtgggcattcagggcagatgtctcattgttttccaacccagacaagaagctgggaaatgagagcctggatgagtgttccgcagagtggctttcttcccaggtgcagcctctgacaacttcctagcaaattttaaggtgtgtttaatgtcccactccctctggactcagccttgggatggtagagggggaggggtgaaagcagaatggaatgtcccagtcagtagggtagcacgaaaggctctgtgaaggcttaagggagagaggagggcacctttgaatactgaagtccaaggtcactcataactaactgtccaaagggtcactgatgaaacagctggaggcagagggagagtgaattcttaggacacctcgtgcaaagctgctgacccccagcacacagaaagatagagcaggccaggtgggatcgcaggctgggcgacctggtggggatcaagacagagctctgagaccaacctgacagctagacttggcagtggctcccgcagccaggtgtctgcctgaaaaaagacaaaagggaaaactttgaaagtcgtaacctcattagaagttgttcaagaaagaccgtgcttagaaccagttgagtagataatggcagcagatgtaattgttgtggatgcttttagagtcccttggagtaatccttcttagtctcttaattccaggcttccagatacggagcctcagtgatgaagagacttgttcttgtccacagcaaaggttggtagaaaagcagatttagaatggagaattcttaacgcctactctagcattcacgtttccctgggaccatgttgtttctctagaggggaggaggattgtggcatctgcattaacacccggtcctgtgggcactcagagaacttaactgctgcatttgtggaacggaataaaggttccatgtaacccttccctgccattccccaaagtctttctatagatggcacagcagaaattacttcctacttgagaatctggggttcaccttagcaatcagactgattatcatgacagtgactctgacagaatgtgcccagttattgtaggagacagagacggtcacacaccggcctatctgcagggcagagtttgggcattttcagctgctctgtgtgtattgaagagttaaaaaaatgaaaagacggccaaatagttatcaccaaaaggaggccgtcagtcattgctcatgaacacagtctaaacacagttcaggcatatttagttcgcgtgtttctccccagcacacagcaaatcagaagcaggcaggagaagggaagtagtaatgcacattggaagcttgagtatcaggaggagctctccctctcatgcagatattcccagcgtgctccctgtatcggcagcctcagcatcacctgggaccttattagaactccaaattctcaggcccttcaccctagaccaacctaccaaactagaatgcccaggtaattccattgcccactcaagcaggtgaaacacagcctcacagcctgcaggtcacagtgtggctggggctgtcttctgattctacacacacactgggagcagaagtgagatggttgaggcagaatgcaaaagttcaagtgctttcgtgtctctgagatctaaaactatgaagcattgtgcacttctccaccctgttcgctttgagttcacagaaatgtgtatttctaggtgcactgagtgtacatcccgagtgtgtgtgtcggtgggtgttgaatttctaggcacactgagtgtacatcccgagtgtgtgtgtcggtgagtgttgaatttctaggtgcactgagtgtacatatctgagtgtgtgtgtccgtgggtgttgaatttctaggtgcactgagtgtacattccgagtgtgtgtgtcggtgggtgttgagagtgtgtgtgttttcagacctgccctcttcctgtaactggccgtgtgagattgggcaaatgacataacctctctgaacctcacttcccacacattagttaaaaaccaaggctgatttctgtggccattctccagttctgaagtactccaaccttgtggtgttgtcttagcttaacgatatgagaagaaattggggtgggggaaagtgaggctacccatagttacgtagcactggacaatatataagcatgcatatataatatgaattagaatgtatactgacatactatataccattatatagtttatattatatagtatatataatatacatgtggtatggtaaataatattgaagaatatttcccaacattaaattagccagcatatggttaggtttgcaattagggagatttattttaccatctgcaaggggcttcaggaagagtcacattcagtactgtcactttgaaatcctaatgaccctgcaacctaaaggttagactgtgataccaggaaaagtaagctgttctctacacacattgatttcttttccattgtcataaaacagtagcaaatcaaaggaagaaaaccccatatttttatatccagattcatgtagtgagtatccaattgactggccaacatcttctgaaatacagatatccttttaaaattgactatataaaattcttatatgcttttagaagaaccacaattttatacatgtatatacagagagaaatatatctttttggtattatgcttttgcatagatttggctcaacggctcatcatgacagtcttctgagtatataccttcctcatttttctgctaagaatctatcaagaaaactagtaaacccatatcggaaacatagactaatatgttgttgactgccagaaaattctttattctatctaaccaaaattttccaagaaacggtggcaatttaaccttatctggtttctttaatggaagatcatatattacatttatgttacttacagccacagatcacaatggtgtcttgaaaaaggcagctcggttatcaacgagatatgcatacctgctcagtttattttgtatggcagaaaagtgaaagctggtctcactatccgtcacaaaatatcataacatttaaggatggcctaatgagcagccaaccccgaaaacaataggaatgcctttggaatgaagtaaaattttgcaaacggcattgacttatttttattatatacaattttttccccttttttggatttttatgactctgcatacataataaaattccaagcaagtactttcatttttttcaaaaatgagaaaatggtactagaagaatttaggacctttttcaactctgcttaagattaagatgtcccagggtgaaatcttgatgtgcccactactttaaagcaccgccctgtaaacattcacagttgattccaaacatgctgaagaagccaagctgccagcatgcaggtgttcagagctgcatcctggttctacccaagggcttgacccagggtcgaattccctgttgccctctaaagcccggtactcagtgagaaagaagaaaagtgaattggatagtagacattttccatactcctctatttaacattcggggggcaaatgagccttttaactgaacacagatacaggaaactgaagacataaagtattcattttccccagcttgaaagtttatatcggaagttcctatatttcatgcaaaatattgctatttggcacatgaggtctgatggtttcagaaagtaagaattagatgttccttcgatctagcttgtaagtgcatccaaaccacaccctgaatatgataatgcttctcatttcccctgtgccttggtgtcacagctctccagcaccattgtgagcctgagggtcaagacccctaccaaggcaataacgttcctactgactcccaggaacacacgtggggagagtggaatgggctcttccccaatcctccagcattaaactcagccctgagactcccagggcttagaaaacagcttagagtgaagaattgttttctctgagagttatgcctgaacacttctgctaaagcagacagtcatcagttaatctctataaatgactacaattttggcaggtatcagctggtatagaaattgctcacaagttaaagctctcatttctaagtatatagtaatgagggggactaattaaaataaaaaacaaagaaacaaacaaacaaaaaatacctcacgttgtgcctgaccacaggactggcttacctggaatgatgattcctgttgggtgtctccgtggcacaggtccccacgcttgctggctaagagagacacaactgccaagagctgtttttccaagctgtggctgtagactctaccacgtcaagtgctgtgtattcagaatgacctcgctcacatcactctcctgggtcacccactgtccttgacacagtgttcttcaaaaatgccactaagtgcctgaggaatgtgaagttttgaaatgagcacaaaacctgccggcagcctttgccgactggcattatttctgaggcagatagagctctccacaatcattgttcctgccttcttctttaccccaactcgtaatgccaggcattagactgtggtaggaggttaaagggctgagttattatgttttgaatggttgttccattggaattgtttgtttttctgcaagaaaactgcagatttttcagtttgatcatcaggaagccaaggatctatggcagagataagaggagggaggagctaaggaaggcttcatccagaggcactgagtcacaccatggctgaccaacacagagcgctctagaaaaaagacattttcatacttctgagggaaagggatgatgggggttgctgcaagacctggccccatggcctttcatccacaaagccggtgcttaaaatacgcagccaagaacaggcctcccacatgcatgctgagcctgcgtgactcaggctgtttgcgttcaagtctcctgttgtgggctggagcgctgaatcagagtccagatttgccttggtgacacatgacaagaggggccattgcatttgaactacataaatattatgcttaagtgtttttcctcattttggagccaaacaggtctcgttaatgataaaatcactgcaatatagtgggccctttttttctggtctggaatttgagacaatgtcaactgtgccaaggggcctggcagcaggaagaaatggccagccatggagatttgcagccatcatgcaagttataccatttaattttataattgtagccattgggagctggactacagtgcacttctcgtggtctgctcttaccccaggctgcgggagtggaatcaagggggcctctttctagtctaggattgggtcagggcatgtgaaatagcactttatgggggcagcgggcaggctgtttctcagtctggctttggggacatttggcaatagggaacagaggttgtgcaatcgatcaaggactctttattggaaccataaggctgaggaagcagcaggaggccattgtctttaaaagagaaatgaatggcccaggcctcctgtggctacctccctaccttggagcctcagctttgcacgacaggactggctctggtttaaggacattttgagaaaaccgtaggccccagtcccccatgagtggcctctgcttgctgcttcctggtgacggttgttttggtgaagagcatgatgaggacacttgctatctatatagacactgaggggcccaccatcccaccctatatagacactgaggggcccatcatcccatcccaccagtcctgagccccctggggaagctcaccagataggctgtagctacctctgggctccagtgggcctattctgctgggaatattggacaagacacaggcgaggccttcctgtcaactcctccttaggggtacatgggggagtcggcttcagggaagaaggaatgcttgtgaaaagcctgtgaggagagggagagggagaggggctgaggggctgaggatgccctgcgtgtacctggaaatgggacctccccagaggctgtgggtttgcagccacgcctcatttcctcttggaaggggccctaccactaagctgcggggcccactttgccgcctctaaaacgtgccagtggctgggtttgcagtaaggaacagccgttctgatgcccctgggaggccacctttcctggctgccacagcatagcccctggcatgtggccatgtgccaacaattaatgcgcctctttccctcccggcatcaccaccaccgccaagttctgtatctcagtgagttgtgcccattggaagtgggtgtagagggttggggagggtgccaaggcccagactgggggagcactctgtggccgaggcggtgaaagggggcccattctgctgagaggacagtggccccaaattcagctggcatatctctagcgagtctatgttggggtgaggggagagagaggggaaagacaagaaaagccccagttttaggaaatccacaatactttttctgatctcttccctccctccttccctccccccatcccctcccctccctgctccccacaataggacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcagggtaagtaccagatggagcccactgcccgcctctcctgcacctgggccaccacccacaactggcccccatgtgcacacaccttcccagaccaactggggtttccccttgatgctcagagaaaggcctcgaaccaacagcaccacctgggagctgttggaaatgcagagtcttgggccccacccaccccagacccaccgagtcagatctgcattgtaaccagatccccacaaggaaaagcactgctacagaggatacgaggagctctgggtatggatatccatattggatagatagctctcttgaattttttaagagttagctttggctatgctatttttttacctacccattaggcttgaagacacacacgcagacacacacacacacacacgtcaagcaaagtgaagatgggatgtttcaagttctcgctattgccagattatttgtgggttttgtatctagtgtttttttattattaagaaatagttgaaatgtatggatgtcatcacatcaagggtgttatttgcaaatcaatagagaatgcaggtccccccagcccatggggctagctggcaattactaaagcgctgtaagatgcaataattgcctaaggcccactgtgccaaattagataatacaagaagttcatttacactgtagaccagtgacgtcaatgactgtttgctctgtgataccgtttcaaaaatccaaaatgcagacttttctctgtgccatgcaggatgcagctgtgtgtgatatggtttacagtaatatttctttctcaaagtagcaggcttgttaaggaaaagataagcaacacatctggggaaaagggcaggtggccagcaatcgatgtggtagctctttgcccctctcggacagcaggaattagcttccccaggcattttctgtatgtgagttgtattgtgggatgtacaaatatcatctgttcctttgggtttccaggccagtagctctctattttgggttcaaacatgggttctcaggccgggcgcggtggctcacacgtgtaatcccagcactttgggaggccaaggcgggcggatcacgaggtcaggagatggagaccatcctggctaacatggtgaaaccccaactctactaaaaatacaaaaaattaggcaggcatggtggcgggtgcctgtagtcccagctactcaggaggctgaggcaggagaatggtgtgaacccgggaggttggaggttgcagtaagccgagattgcaccactgcactccagcctgggcaacagagcgagactccatctcaaaaaacaaacaaacaaacaaacaaaaacatgggttctcaaaaggcatgcccactgtctcccatggagcttgacagcccatgccattagctctcactgttaggtttctggggaaggttcttctacttgattggaaaatttccaaataaatctttccagaagatactatgcacacagctaagtggcctgtctgtggagtaacccttttgtaaacaaacagaaacctaaagcttgatgttttggggggctgcctgtcatctataggttcatttaggtgtatttaggaagaggatccatgaaaccactggtttcctgttacataataatcattaataatgatttaaaatgtgtacattgattttttttaaattccaaaatacaagcgtatatggtaaattaagtcaaatggtatgttcagtgagcgagatgggcttggggcaaaacaatactttgcttccaaagaggatacaactctcaaggagattctttcatcttgcctttaaggtcatttaaactaattcacataatcttcagaaaactaattcacatcatctattcatgtgtaaaatcaaaaggaagactgttttcttagtctctcgttgcctaactggccatttatactactaggttgattaagggatttgcctttttctgctgatatgggaacaaaaagtcttaagcatttttaaaggcaatggaaaattcagccacatgggggaaaattgatattgtcaccattgagttgctctgtttcttggtgaagagtgaatctaatctgatttccttcttcatcagatatgcctctttaacaacaaaaacaaaaaaatggggggaagttgcacattgagttctcatcctctgaagctcctgggcaaaagcattattgtggaccgtgtgatgggcattcgtcagctctttggagacctatatgcttagtagagtatcaggtttaacactaagcatcgccccttttttgttcctcttgaaaacttttacttctgcaacatttaagaaatcataactcgcttttagagttcctacgggcttggttgctactctaaagaatgtgtgaactatattgctggtgttctttctttccaaaatatgaatttgatattcagtacttcacttgtaaaattttaggaacaacttttaaaaaataagtatccagaatattttcatgtgaaacaacttttccttttccttttgttctttctttcctataagaaaacgctgttttacgctaatcatgttttgagtagacccttgggctttttctcttgaaattggaaagttaacaggtataatatgcaagtcttgttcagccaagaccttcagtttgttcttgacagtaggaaaatgcttattttccaggctcagccctgaaatttctatgttatatttacgaagatactttaagaaatacagcatgtgtttctggctttctttgaaatggcagtggtagttttcagaaaaatatccaatttgtcagagtagttccacagtggtgctgtccagatgcatgaatgtttttcagctttacagaaatgtcagtaaccgggggtttggcgagcttgccgggatttatagaaaggctcaggaaccctaccttgctaggactttgtcagaagggttatgccagctcctctgactctgtcagcaagaaaatactgatatagaatagcaccaatacttacctagaatcacatgtgctggagggtcactcaaaatagacatctcaaattatctgaagcacggtacagattgagagggggcaagttgtcatgccactaaaccactgtttatttgttggggtcttaactattaaagggctgaggtttatttcaacttcctattttaccaggtcttaaactggtaaagccattttgtcatgaaatagaatagaaagccattttgtcatgagtagacccttgggctacacgtttctcccagtcaggacaccatcattaacttctacgatcgagtcttagaattcttttttaatttatttcaaaagatagaacagggcagattctagagctagtggtaccgatgcctgttcagtcacaactcccacctagagatgggtttgggcaacccgagtgagtgattttaaaatttcacccctgattgaccaaatatgatgtatcacatttaaggtgtcgtaatttcctcctttctgggaatatgaggatggagtaatagatgctggtacagaaaactgaaacctagataaactaggaagcccattttgttgttcttctgcatgctggttgtcataagcatgtaggaagaagatttaactctttaactggaccagttgtgagctattttgacgtgggtcagacatttgtacatattattccattccctcaacaatcctgtggtatcatttatagacagagaaatcgaaattcagaggttaaaaattgcccagtatctcaaagattgtaagtgatgaacttggacgcaaacccagaccttccttgctacaaagccagtgcaagtgggatggccgttccctgggcgtgcactcttgggtcaaggatcgatttactacagggctgaccagtgtcgagaagaatcccaatcaccaaaggagggatggaaaaagtgttgggctatccactcacttggcattcttgtattgaacatgttctattataattagatgttgataataagaagaattttggggccaggctgtgtggtgggcaccttaataaactgtctcctttggtacatgtgcatttgtttataaagtttgggagaaaagaaaactcagaataatgaatctctaaataagagtgaaagagggggtatatgagcagggagaaggcttaccagccactctgtttactttattggggccattgccttcctacttttgaagttcattgggaccaagtgcttatcatccaaacccagtcaacatctaatccacttttatgagtatgcgtgcctcactttgagtgttccatatggccaagaggggtccctgacctctcaaatcatctcttgatttttagtattccaagtaacttctgtcttgctaattattttcccccaaaattaaagttacttaggaaggactatattctggtgctgctgtctgcaaaactctgagatactgaaatgaccctgtttctcagttgtatagagttatttaagtccgtctgattctctctttatcatctggatagacaaaaggaagaaaacctttccaccttcctgtaggagaaggagataaatcctctttccagccttggaggtaaaatatccaactgcattgcattgctttcctttctctctccctctccttccctctcttccttactcttctagcaatttgaagtttgaaaacaaagggagtagggactatttgattaccttgaaagtggaggctacaatcaaacaccagaaatcctcatatgtgaatctataaatggtcatttaatggttacacaaagtaacatattcagaatgtgagaaattaatttatataataggctataaacatgacaggtgaatgatttcatttaaaaatagcttttaacaaggtgtagtagggtatgagagcctttccaggtctatagcattataatcttaccccgacaacaagcctgaatcaggtgttcacaggaataaataaaaataattaaaggaaagaagggagagagagagaagaaatgaaaaccagtgggatgactgcagagattcactgcagggcttgatcttagtgatgaaatatttcttctgtagactgcatatgttctgaactttccccttatgcttgtaaatatgtaggccagcacacccatgcactaaaaggtttcatttggaagattaatagtttcagcaaagttgtagttggagcatgtatttgatattgatggctacatatcagaaggcttgagctgggaatctaatagccaagaaagatagcagatcatagtggctaagaaagaatgagggctcaacaggcagactaccttagtttctaccacattcactataggacttttggcaagttacttaaccttttaaagccttagttttcttatctgcaaaagacgagtaataattatactagcagatcctaggaccactgtgaaacataaagcagtggacattagagccagcccatggttaacactcaaaaactgttagctgttatgatcaacatcaataatatcaagttgtcgtagtcttatatattatagactgggtaatatataaagaaaagtttattcggctcatggctatggaggctgggaagtccaagagcaaggtgccatcatctgctgagagtcatcccatggcagataggtggaagggcagagagcatctgtcagagagctcacttttatgacaaagccacctccatgataactaacttactccctcaatggtagcatgaattcatttgtgaggatggagcccttatgactcaatcacctcccaaaggccccacctctcaacattgccatgatggcaaccaggtttccaacatatgaacttttgagaagacacattcaaaccatagcattccacctctgacctccccaaattcatgtgattctcattttaaaaatacatttattccatcccagtggtccccaaagtcttaactctttccagcattaactcaaaagtcgaaagtccaaagtcttgtctaaaccagatatgggtgagatgcaaggaaacatttaaagcaaattccattagctttgtgaaatcaaaaacaagtctactataatacttccaaaatataatggtgggacagacacaaggtagaaattcctactccaaaagagaaaaacaggcaagaaaataggggtaactggtcccatataagttcaaaatccaacagggtaaacaatattaagtcttaaaactggagaataatctcctttgactccatgttctgccttctggatacaatggggctaagactaggcccccaaggccttgggcagccctgcccctacagttttgctgggctcagcccaaacttcacctctctcacgttgaagtcttgtgtctgcagcattaccaggctagagttgcacactggtggctctgcagttctgggttctcagggatagccccaattctgtgtctccattaggcacagccttagtggggactctttgtggcagcttcaacctcacatttctgttcaacattgccctgctaggtactgtctgcagtggtattcccctgtggtaggtcttggcctgagcttctaggcagtctgtggcatccttcgtaatctaggtggaggaagccatgcttccacagcatgtattctgcatgcctacggaattagcaccacatagagaccatcaaggcatactgcttgtgcccttcagaatggcagcctaggtatacctaggcccactgaagccacagctggggtggccaaggtgtgctgcaccaggatgcaggaagcagagactagaggcagccctgggcagtgagcccatgaagggtgccccaggcctgtcccctaaaatcattctaccctcctagagctctgggcctatgatgggaggagcaacttgaagatctctgaaatgcttttcggggtctttctcccattgttttgatgaacagaatctggcttcctcgcattcatactaatctctttggcaaatggttgcttggccacacccttagtactctcttccaaatacactttcactctttacatggccaggctgcgaattttccaaatctttccactctgcttctcttttaattgcaaatttcatctttaagtcattcttttgctatcacatctcactatatgtagttaaaagtagccacacagcagcctcaatgctttgctgcttaagtatttcttccacaaatatcctagttcatccctcttaagttctgcattccattaagtcctaggacacagacacaatttcacccagctctttgcaaccttatattttataaatatggcctttactccagtttccaataccttgttcctcatttctatctgcagcctcatcagaatggcctttaccagcattctaccagcactctggtcacatacacttaagtaatcacttaagtaatctctacgaagatttagacttcccctagttctaaggtcttctttcagagccctcaccagaattgcccctaatggcagaaccgttcttggcaatgcaggcttttttctagcctgctcctccaaacttgttcagccttcacggttatacagttccaaagccacttacacactttcaggtatttgttgtagtaacaaccccacatcttggtaccaactttctgtcttagttcttttgttaaatgcctgagactgggtaatttataaagaaaataaatttaattcacagctgggcacagtggctcatgcctgtaatcccaccactttgggaggccaaggcaggcagatcacttgaggtcgggagttcgagagcaggctggccaacatggtgaaacccccatctctactaaaaatacaaaaaaaaaaaattagctgggcatggtggcacacacctgagtcctagttacccgggaggctgaggcaggagaatcgcttgagccggggaggtggaggttgcagtgagctgagatcatgttactgcactccagcctgggtgacagagtgagattctgtctcaaaaaaaaaaaaaaaaaaaaagaaagaaagaaaacaaaagaaatttatttcatatggttctggaggcagggaagtccaagagcatggtgctggcatctggtggggtccttgctgcattaacccaaggcagaaagcaaggggcacaagaaagcatgtgcaagagagcttgcttttataacaaaggcacttcaccaataacccactcacatgattatggcattaatccatttatgagggcagaatcctcatgacccgtttgctccctgcaaaggcctcatcaacaccaccacagtgggatctaagtttccaacatgtgaacttttgagggacataatcaaaccacagcacaagtatattagtttcctgtggctgttttaacaaataaccacaaacttggtggcttaaaacaacagaaatgtattctctcttagttctggaggccagaagtccaaaatcaaagtgttggcaagaccatacattctctgaagcctctaggggaggatacttccttatctcttccagccactggtggcattccttggcttgtgactgtatcagactgtatcattccaacttcttcttccctctttatatggcctcctttgtgtcatctcttttgtctaaggatacatgttactatatttagacccacccaggtaattcatgatgaactcaaaatccttcacttaattatagcttcaaaggcccttttccaaataaggtcacattcacagttctgggggtgaggaaatggttctggagccaccgttcaaactgctgtatctttgtacaaaagacaggggacatcagaccattgaccaggcacagcaggtgagtccagagataactctcccaagtccatcccccagaacaaacatggtagacaggtaaatgtgaactgaacatctcatgcacaaatgccccaatcgtgttactataacctcagtccatcatttgtttgaacgcaacatcatagtatttttatttcccagccagaaaaatgtatgattttttttagatgagatcagatatttccttaatattttctagagcacctataccgatggaatcagaggtcctgacagtgatagagaaagagctctcttccctgtgtcccgggagcagtgccagatggggaaacaggaggcccaggtgcctcttgtcctagcctccaaaagctcatgacagcttagatggtaggaacagaaaaatgggaacaaaagatgacatgatgaccaaagccagacagttgggatggactcaagaatttgacctcccaaagccaggcatgtcactgttgttttgaagcaagctgccttttaaaaaagtgacttgattgccaggcattgttgactacacacccatttctaaaggatggtgatttacaaatcgcctgaagatagtctttcaaatttggacatttaaaaaagaaacttttactgtagtcatgaagtagtatcaaagtttaccacaagtttgtattgagagaagaacaaacaatatatgctaatatgaaaaacagctctacttagaaagctactgcttgggttttcttattaggcatagttctccagactgagttggttttactcatctacatgatttttccttgccttatggaacagaaattcaggcccactcgaattcagttattttagggctctttaaaatccagtatttgtgatttaaatgatgcggagggactttcattacctgtgtctttgcttatttctctctggccctcagaacaccccaccctgacctttaggggaaattgacagaggcagagggtttcacctgcctcaattgtcaccagccctgttacattcttccttccaagccttagcctcacagggaccttctcattattgaacaattgccttcaaagcagtagaatagcccaattgttatggagattaaagataccgattgcaaaactcctgtaaataaaatcttcactgacaaacccagtttcttttcataggcttttcttctgtaatctctttctggcagaacatctcatgttttgatgttagagattcagttaccaaccacagtaaataaagcaaaataataatagaaaaatagtatagaactcaccctaaaaacaaacattggccaaccatgtttattttttgtctctctttgcactcctgagaattgataggggaagaatgtaccacctctaattcaggtgatttctgattagcaagctatggaaagtcttcaggttgagttttagccagttcacgctcccctaaatggcatggaatagactattttctgttttaagaaaaaatagaacaatggcactaaatgcttgactgaatgtttgactaaatgttgactgaatcatggataggaaagattgggcagaaaagacagccactgcctccagacacaggatgccacaatcctgggcaccatcattattccatacaaccttagggtcatttttagggtttagaactttctcaatagggtttcaagattttgaaaagtgtcttccaattctgatctccgtagatcctgttatgggaattaacctttttggaaggggattcttgttcttaaagatgaaattccctactttctttcctggagggaatcagtatgggcagagggaagaggagatggcgattctgacctgtgtgtctcatgtcacctaacacctatggggtggcatgaaacttgagctttaaaacacaccaggggccaggcacagtggctcatgctggtaatcccagcactttgggagaccgaggtgggtggatcacctgaggtcaggagttcgagaccagcctgccaacatggcaaaaccccgtctctactaaaaatacaaaaatcagctgggtgtggtggcgggcacctgtaatcccagctacttgggaggctgaggcaggagaatcgcttgaacctgggaggcagaggttgcagtgagccgagatcaggccattgtactctagcctgggtgacaagagtgaaactccatctgaaaaaaaaaaaaaaaaaaaaaaaaaaaaaacccaccaggaatggaaatggtgcttaattcctctaccgtcttggttcttccacacaatctgaactgggtcactgaatcttagcctccgtaagtcaacatcatcagttccgtttaataagacttgggccactataatgtccagctcaatcctcctggaagtatggaggacactgcaggatccttcagttgatgtcataaaagcaaagcatccctagggaagatctgtgagtcaagcctcaaggccctcgctgagtcagcgctaacttgagtatcaggagctcacccgtctgggacggttaagtctcccagccctgtaaattgccagttcctgctatggatgatgtcctctttaccttacggctttatgtgttcaacctgagtcattctaaagccagatccaagacccagagagcttatgctgtgccagttcctctttatatcactggaaggactacatatgtccagttgctttgggatttttttaaagaacatctcaagataaaaagggaggaagaaataatgtgactagggattgcacttcctggagttgcaggtcacatgagggacacgaacatggtggtttgattaagtctcgcgggattataacactgttgtggccactctcactccattagtgcatctctccgcacatatcagatagcaaattatataatgataaagttattaaaatatctgtaaaagtcagcacaagctcaagggctcgacttggcctttctgcccactaagtggtttatttagctctctcatctcaaggccggttaatcttcatctatactttgttgtaaatcacccgctatgtggaacagccataactgcctgagttttaagatgcgcttctgttggtcgtccaacaaggctggtatcttaaagatgaatgcagaagcttttgaagcatgagactcacccacttccccgttttaaaatgatagcctttgtttgtgattgtgtctatacctgggttatcacagagcagttatgacagcaagattatgacaaggacattgcctggttcacatgtttactgaagggagtaataaaataatgatagctcgtatttatagaacagaccaatgttgctggttcattgaatccccaccaccagtcacctgtaggtgcatgacatggttagggggaagcattgcccggaaggtcctgcctgtggtgtctggtttgttttcacgtgacccagcactgtttcctttaccaccaagtcccagtccctcatctatcatgtaagtgattaaccaggttgtcttcaacactaacattctgtcattctggatactgcagttcccgtgaattaatggtcacccctaactaacattctcaggaaaaccagtagggttgccccagagcccctcactctgctgcttatttggaaggagcctttatagttctgctgtgtgagaggctctgagccaccatatgttcctaaatgagagaagccgttgcccagacatggatctgtttaatttaatatgatttaccacaaattacgaagcatgacttcaaaattgaatttgtgcaaaattactgatggccaattcagtggaagggaagggaaatcttgttattcctattccagaatctcttcctgatttcctcatttgattctttcacgccttggggtaggggaggggaatgcattcgcggctctataaagaattgtccttattttcgaactttctccctggtcacacatggctccctcagaggaagacacagcaccctggagatgttaaggcagaagtcagttcttctgtccatccctctccccagccaggatagagctatcttttccatctcatcctcagaagagactcagaagaaagatgacagccctcagaatgcacgttatgaggaaggcagaatgtgggtctgtaattcctccgtgtcccttctccccctctgcaaaccgtcgtaacaataatagttcctaacacatgggacaattgtgaggattaaatgagttagcctgcagaaatcacttgatgcacagcacatgggaagcattgtgtgtatttattaatccttcacaaagtctttgagatatatttttatcaaatatttagcatggatcccggtacactttcaatacttaataaatggtcaatgttattctttttcactattattgctatttatgtgctcttattggcggcattgttgtatcaccagttagttgtacccatcggtcctctccaagtcacacagctactctgcgataattcccccggtgtctccttattcctcgggagccccagagtggataaaggtattggtggttttagtggtattttcatttgagttttgtttccttggataaacccaaacaggagaccttcccataaccactgttccacaagaccaaatggtaaactgttaaagttgaaaggaccttaaacttctttgctcaaagccctatattttactcatgagacactcgaggcccagggagtttcagtgattttccgaactagaggcagacctaacatccaggttttctggctcctggcccagtgctcttcccattggctggttcgggtctgcctcagaggtagcctcagaacagtctctagggttggtgtggatcattcacttgggcactgaaccatgctgtacgtcacactgcctttttctggaaatacaccatctcagggagatgctaggtcccatggttgggttcagtatcatgtgctgcttctgagtctccatttttaaaaggttgaattcgtgctaaggaggagtgatgcttttttttttttgagacggtgtttcactcttgtcacccaggctcactgcaacctctacctcccgggttcaggggattctcctgcctcagcctcccgagtagccgggattacagagtcgggattacagagtctgccaccacccccagctaatatatatatttgtatttttagtacagatggggtttcagcatgttggccaggctcgtctcgaactcctgaccacaggtgatccgcccgcctcggcctcccaaagtgctgagattacaggcatgagccaccatgcctggctggaggagggattcttaaagcatgcaaggaagggaagtcctcctcaaagccacacctaccctcctcagccccactcagcaaggaagggaaatcctcctcaaagccacgcccattctactcagccccacccagcaaggaagggatatcctcctcaaagccatgcccaccctccgcagccccagccggcaccccagccctgctccctgttggggacaaccagctacaggagaccgacaggtcacttcctgagcacaaagcccacgtgggtagcaggcaagggtgaaccctgacctgtcccattacttgcatgaattggatgcattcaacaaatgtgaatggtcagcctctttggtgtttttaatgaagcagctacaaaaggatttcttttaaccaagtttcaccgtcctgtgtgattttgagtaaataccatcctgtgccgattcctcccacaagcccggccctttaagcctgcttgggggctgtggcttgggctggcgggccagaagcaggatggcaaacaggtgtgcgagtgtgacagggcagaggctggagccacagctgtgggaatacgaggctttggcaggccgaggccaggaggggcgggaggctggtgctgactgatggtcctgtcatcccggttcaggatgccactgccaaacttcatgccaattgctcccaacagagtacacggctatgagagggagagagctgggaccagatgaaggcatccctgtgacggccacgtccttgtccatgaattcagggtcagggtgacgaatggcagggccaaaagctaccctggaatgtcacaggaatttgcagagaccaaatgcccttctttcagaggcaccagagtgggggctcccgcattgacgggtggcttctgggccccctcccttcactaagacttggtgacttggtaatcctccctcctcaatgaaacttatctaagaattgattaggaagagggactggagcatggcagtaactagcagtgcagacctgtcatctccatcttcccctcccatagcgtgtggctcttgccatgtcatgaccacactcccgggggctcgagctctgggcttgcctcagcagtctgagaaccacaagtttctaaagaacaggtatgaggaggagagacttttcttgctcaaagacatggatccactcagaaacagcattcaatggtgctgtgagtttcctcccaagtgtaatgacctcctctgacttgggcacttcttacagtgactttgaacttctgagcattagagatgagtgaatcgcagaaaactagaccccttgttagatggatgagcccagagaggttaagagacttgcccagggtcacacagataccacccatatcagagcgctcagctttcctttcccctcctccccagcttggacacattcctaggatttggatgtagcaatgtgaaccgtcctgagcagtcccttcaaaacagcacttaggcgaaagaggggctgttggaacaagacaggacaaacacccgtgtgcctctgcacgctgctccacccagtttctcatctttatattacagaaaaagagtctcaaataacccaaacaggcagggtatgatctgcagacagtctgcaggcatctgcccaagaagctgccggtcggctggtccatcctcctctgatttatgttgtgtgtgttaagccttaaattgttgagtctctggctggctgcagtggtattactggagggctggtgcatgttttcggctcacagagctggctccggtactggaggtgttggccccgaatcaagtccaatctcacacctgtctgagacaatgagggccttgttagacacatctccagtcgaggaggtgcaggctgcttatttttcacattcagaaccagaaggaggggggtctgggacaagggggatgggagaagccaaggggagacgggaaatgctggggtcagctgcctctcgggccctttccctctccttctccctcctcccttcccccgctcttatttaataaacttctccttacttttggaaattaaaaaacaaacaaacaatactaacagttgccctcttatgaaggataatttcctactgcagaacaaggagctcgtggcctgttgtaggataaattcccagtcatcatgggagtggagcagcccaggggaggagtggggtgaataggcaggggcgcagcccccaccccaccccagcactgaaacttgagctctttgcacactgagggcgcctgtcagtgagaggttttctcttctggttttccctccactgctgacatttcagtgacagccgcagaaagtagaggggactttgtccccagctccatattattcattgatgaaaccgcaaactgttctgtcctggttcagccttcctgtcccctgtgatcagagcagacagagcaggccaccaggacttacgtctgcagacactttgcaaatccagttctcaagaggccctgacatgaggcggccccgggcaggagtccttctgggtacaggctggcacccctcaagggtgatgatcgctctgaaggatcattacttagtcaaagccaccctgaaatgactttctattgcaggaccacacgacgtggaggcccatagtgtaggagtcaggaaaagagcttcccagagttatcaaaaaccactctttactgcgagagccaacagtaaggagcctgtgtagaagagctaagaaaatctcacacatgtagtggccatgtcttgggggcttgagtaactcgacaaatctcccagctctgtttgtgatcaggtaggctcttacctgagccgggaggcatttaggtgccagcagtcactcaaacaaggaatgggcagccctatccttctcatccatacacaacttatttaagcactaagccccattgctgactcctaatttggcctcagcgacacaacagggaaaatccatatgctgtttatttcatttgagactgaggacttaccagagatgaggttgcgccagtctgtttcttgtagtataaatcatttgtagctcagccacccttgtatctctgtatgtacatcagttgacaatcccagagaaacaaaaggacaacttttcagaggcagcagagtgacagacggtgaatagcaatgagcataggcaacctggacttctggctacactccagcctgagtttgaatcccctctatgtgaccttgagtgacgtgtgaagacccaatgtgctcactgttgatactttggccttcagagagtccagggactgcactgcataggttcccttagccctgcactcctggtagaacctgtctgaatatgtcacctttggaggaaagtggccgaagaagcaggtgttgctatttcaggtcagctgatgccagggaggcctgatacctatggagaccatggaaccaccagtttcctgtctccttctctagccatgcctccctgccttgttctgggccacaaggtgctccattcttccgaagctcattcttgctctgaaatgaccaaaaagtcaagccaacgaacaggagggaggctggacactgaggtgggtgaatgctgcagatcttcctgcttgatctctgaacacccatgaccagtcctgcccacaagctttggtccatgctggatgcctacccagaaagttccttcctctcctccccaccacatccccgaatcctgccattcttcagggcacctcacctgccccatctcctccagaacatctttgtcctcactgaggcccagactgactcccttcccgactcctgactgatctgttggtctctgtcactttggcatttccccacacattgccttctgctgttaccagataggctgcatgtttgagtgacgcttcaccaactgtcatggctatgattttccaccatctgtgctgtaagacagtaaaaactcaaccaccaccaccgagatgccatccaggcaggcaaccctgagcgtgcccccacccgctacacactcttctccccagagcacatcagggttctgagatcaacaagttggaaggagacttccaggtgggcaggaacgctctctccttcccaggacccccacgaacctagcccagagctgcagagaaaggggtgcatgagtcgttgaggaaggatttttccttgctcctgggacagcaagtcaaaactgtttgttttaggttttaagttaatttcagaatatcctgccctaaacaatttctttccttacatagcaccaactctctgctggggccctttggctgtttcctttctccattctttccttctcctttcccagatcccagctgggaacctggggggagagcctggctggcaccacctgccctttcttgggccatttcccttcttgtttgtgatgaggaggagcctaggaagtctccatgcttcttggctttctggccctcatcactttcacagccttctgctaactaagctagtgagcccccctgccctttcccattccctctctgaggccaaactctctcatcccagcttctttcttttcatcttccttcctctaaagactgctcagcctcatcggaggctgccttctgaatcctgaccctgctttccacattttgtaagacatctcggccccagagtaagagtgcatgatttacctaccacttccttggatcccaacccctactcactgctagctcctggcagtggcgttcttcctccttccttggtgtgcagatgtgcccctgtgtggcctccttctctaaaagcattctagattgttcttggttccagcacttctgaaacccatccttccaagtttactctttttcttgctatccctcgtattttcccactcctcatggaagcttctttcccacacccaccctgtgccctatggcgggggcttcaggacccccaaccccagccctggagcgtttcagtgctgccatcctgctggcttcacttggtgcttcctccacagcaactacaaaagccaaggaaccttccccagtccctcccctccccagcattctcctagcagaattacattttaattttcagctgaatggatgaagaaccattccaacacctctgtgtcacccacagttgtctaaaacacacaaacaaaaaaaagtctgggtcagcagaggggagaccatggtcactctccttgtcaaccttccctttgcccattctttgttttctcttccctccacctctgttcctctgaaacctcttttgttcaaatcaaggggaaggtaattcagaggtgctgttgagactggtttgctttttaattttttttttcaaagaagacgggaagttcctgttttttggaaaggttgttcatttccaaagaagttacacagccagtcagctataggatgattcctggctgcattttttcggggtagtacacaatacaaaaaaataagtcaatgagagagagagagtcagtcagtgaacacaaagggagatgttataataggcttttgttggtacttgcattttcttgttgaaaaacagagcaaagaccccgaggtgctgaggtgtggacagaagcctgatgttatcaggcccccagaaatcctgcctgcagtccagtggcaggcaggatccagaactggaaaagacggaggcaactggtcctgctcagcacaaacggtgcttttagtctttcgtaaacagcctgtgccccagggctcaaatccttcaaaagtttgcctgggtaattgcatttcattgctgtctggcatgtgctcatcagtctaatctggaggttcagacagccaggccaaagcttgcgagactggaggagagcgagcctgtgaatttaatccacttgaaagacagaataatacaagtgcatctaactcattattttaagtgatgctagtcgaaaaggggatggtgctttccataaaagcatttaaaatcagcacgctgcagttgcagccacttggcagtttaaggccattagaagaaaaggcgcacacaggtgacagtgtgatccctgtcgccgtctgcttgtccctgaaagccttcctcctccccacgaccacctcaaaacacagaaggcaaaaggaatggtaacttccatccctaattttgactttgggttatttgtacatttacagcaacagacaccaacttttatttgagatttggggtcattttggcatcgtttcagggtggagagaagacataaatgaagttaggacttcccagtccatctcaccaagctcaggatctcacagagctataagcaggcaaaggtgttccccaccagaaccatctggacaatgtgctttccagtgacttctttttttttgaggtttagctaggtctttttgttctgtcagtacatggtaactagattgatgggagggttatagtttctaactatcatgtagttaaagcagtagtctacaaagagccagaaggtctgtccctgctctgttgctatctgctgtggagaatagggggagtcccttcaccattccgcactgcagctttctctgagatggggctggcatggttgtctctgctgtctcggaggttgctttctgctctatcattccataagacattagaatgaaaccttaagtaatgttgacggtgatttgcgtcattatctagttacatgtgactcatgcccaggaagcccaggagaggcaagtgctagcctgtaccctcccagatggcaaagccgacggtcagctcaggagcagtcttgttggtagttcacacctgcagctcacccagggctcaacatgccagctctaagtctgggtgccaggccatgagactgagagagcagtcgccttaaaccttacatggggatggagtttccccctgggtgcatcatgactgcagccacccaggattctcacaagggctccagaaagtgctcaccacacacctcatctcctcatacccctcagttcatttgtactgtgcccaggggacaatgctgtgttagctttccccgatcctgaagagcacctctagaagtcacatcttccgtcttgtcatcatggtagctgaaaccattgtggcagtgtgtgctttccctgagcaaggttttctttgacactttagggcacgcttgatcttgtgggcaggatcattctctgttgtaggggccatcctgtgcattgtaggatgttgagcagcattcctggcctccacgtactagatgacagtagcactcccccttcctcagttgtggcaaccaaaaatgtctccagacattgccagaaatcccctggaggagaaatcacccgtttgatgatcgctatttaagagtaattgggaaattcacaaggatcttctagtcaatatacacaggatctcaatgcctgaaaaaaatgtgagttacttagctatctaaacttggtagtaagtcaattttgacccttcagttctgtaggtcctagcattcctgtcttccataggtcatccctcttgttgagcaagagtttcatagttgtctgctatctcaacctctacatttaatttttttaaaaaaaattactccattttagcccaagtatatggcttctatgagaaagccttccttggccttgtaaatcaaagcagttctctggagggaggtttcccactgctgggctgagtatcatctttctcagggtgacctcatctattgaagtatgaaggttgtatttgaaatgccatttactttctctaagtcaataaacgaagctgtggatctgtagatcatcagaggtctgcttattaccaagcggttttgtgtgtgtcattttttaaatcgagatctgtgttggagtttaaaagaattctggcagatttccatttgcctttctgaatcagagtttggggtgagcgagtgtagattgcccctagatgaatctgactttattagtttgtgtcctttgttcagagcaccagggatgagcttatgaaagcacaaatggctcttatcttcaagtgtttcctttatgctgcaaattccacctcaccaacctgtgttattaacccactgcaatcccaattagttcacatcaaggtcaactctttggggtgtgcaaaatggctgcaaacttaagtgaacaaattccccttgtgtagctctcacatgaaggtgggggagaagactgcagcaggggaacttagaagaaagagggagttttctgataccatagaagaaagtgatagtgattccccttggctcacaagccaaagaaatccaattattccaaataattcaaaacttgcataggaacttgtcaccaaatgagggaacattttagcctcttattcactctgttgcttggtggcaaatatttaagaaatttcaaaaaatagagaggtgcaagagagctatttctcaggggcatggaggtttcttgggggcatttctcgggggtatagagggctgtttcttggaggctatttctgtgcatggagaagccttgagtttcagaggtataataaacactactcctccagaaatatgtctgtgaaaaataagctggagcgggtgggtctgcaggacactgtgtttaggaatgaaggctgcctgtcctgccatctctcaggagctcccatcagaacagacagtaaagacaggaatggcatgtctccagttgtggggcaaggcccctcctagtgtgaagaaaatatacttcctggatctatcattatctctagcatatcagaggggggaataaaaacaactggggtggcaaggccctgctgaaagagaaactcattgttctgcacattcagagacttcctagttgtaaagccgttcagagctcttggaggtgaaggggcagccagggaatcacatagagtgaaagacctgtgtgcagcggccaggtcagagggcgtgtagaagacgacatgaagcattcccacagggcagttccctgaggttctgtcctccagctcttgctgcaaggaattctagaagccttggcctgatgtgtgggaaaggaaaacaaggtgaagaggatgcaggtaggaaaagaagagctgtgacaaggtagtcagatgggaggactgcatgagaaaaacagaggaagagagcacagaagcagccctttgatttcactcgcgtttattgaaggggacgaggcacttccacttggggaattctacttccctttgtcaggatatccttcaaattgggagcatggaatggaagctcttaaagaaagaacggttgccattcattgtgggtcacacttcacaagacaaagagcagtgaatcctcgatttgtaaaatgcagctttcagaatctgtgttgtggctggcacggtgcaacactgctgtgaggccctgacgcagctgtgttctgcagggtggctatggtgctccttgtgaaggaggaggctgctgctctgcaggaggaagggcttatgttgcatcctagcggtgcatgctaccccgctggaatagtgcaccttggaactctggctgcctaaggaaggtctcatttctggtggctttgtgagaccaagcctctccctcttctgttacctggagcaacaaccagctaagccaacagtactctccagacactgttatcctttcctggaagggcaggggagagaagactgtttcctgccttcaaggtgccagctactgcattgacaatatcgggcagaggggcacatttcaccctcccaggaatctaagggacagatgcaataacatctccttatggggggaaactgagtctccaaggcattaagttacttgcttcagcacactgtgagtgaggggccaagctagggtctctgtccttacctctcagactgcagaactatgcccttattgtatccttactgaagcccttttggcttttagagagacagctctgggatgaggttcccaaatcctgaaaatgtttggggccagaacaaacaaaagcatctttatgttaagccatatttcatgtttattgttttgaattctccttttcccccattcatatgagtttttcttctgattttattagaatgccatgcctcagagtttgctgcttaaaaccagaatccctggcataaaatccaataagcctgccttagggcccatgtcatatggaagcagaagacaacagagactgcttgctgggcttcaagccactctagaatttttcaaacagttctaacattttacaacatcaaaaaagtgccaaagtaaaaactaaggctgcagctaggagaatgcccactgagaaacccgtggttgggtttgtgtagagaggaaggcttttgagatcactgctccatgccccctcggcctctcccaccagaggtctggctcagggacagcacttgggcacagagagctggggcagtggcagagatggatggggtagtcaccagaggaagcccaggctgcaaactggcatgacacacacctgtgtggaacagatctccatctgagctgggctcaaaagcatcgtattctccaatatcgacaactcataggttagggggttcatcattttgtagcctctgcagtcccagacgtaaagtcacttctttttttttcttgcgtgctgacaccctaaggcattacatggaccctggcaaatctcagccatgttacttaacatgatctgccccagcgacagctcttaactgtatctgtttagccagagatatcacaggtgcctctctaggaaatcccaccggcccctcatcagcacagtggagattggctgtaaagcacggccttccatgcccagcctggactgcaggttggagatgacagtctcccaacccaggccttccaagcatagactatcaagcgtgcacaatcctcttgatatcaggtgccacctcaatggagtgttcttcagaaaattctgtttctttagctgtgtgcagtcctgggagatgctgtgcctcttctgcttgaagcttcccagctcccacttgaggtgtcagtgatttgttttactggagtgagtatcctcattctccaccaagggtccagtctcaggatggaggctgcttgagatatcccagccctcaacacaatatttctggctcatgtttttcaaggaactaagcggggcaaaggtgccagaggagtagaagggagcagaaagttgtctttaccctcctggagaagaaggacatggaggagtggaaggaaataaatagggtggccatagaagaatctaaacatccatgatgtgctggtgttgcaggaatgtacccaacctgtctgtagagctccttcaggcctggaaagttgtatacggggggcagaggtgcagaaagtgcacagtgcagaagatccttatggaaaagatgtctgcaacaaatgtttatttaacaaagtacagagaaagaatctgtctgcaagggaggaggcagcagaaaccagaaggtgccttctgttccctctgaactatggtccctccagctgtgtgcactgaaggccactctccctctgcctcagggacacgatgccaactgagaatgagacatgttctaaaaacacccatcttttctggaagctagtgacctatccttgaaccctccctccaaaagcactctgcctaaatacgtagccctttcccagacgtgtctcagactcatctggctgagggtagcagcctcgtggtgcagggtgaactgtttcccctgggaaccgtctgacagtgctaatgaggaattgcattttgcgtttatagagcacctttcatctgtggatctcaaagctgccccacaaacattaattaactctcacacctgtgaggcaagtgagcctggttacccccatttttagaggtgaggaaacagaggtttgaaaagaaaaggactccagggtgaaccagcagggttgggggcggcctgatgtgaggaaccagcattcttgattcacagggccctgaccacaaagccacaaagcttccccggcgaggtgatgaatacgggtcccggaagcagggagtggtggagaggcggacacagggctcccttcttccttcccgcaggcagcctgccacctcccaggctggcaggtcggcagtgaggatgggatccctcaaaacctgaggcctttaaaacagcatacccaggcagggttctgccccggcttggtctgtctgcttctcttcaaagtaattgctggaacaacgaatgcatctgagctacacatgactaaccaagatgtctgcagccggccagagacgaacggttggcaaatcctggagctgtttcacaacctcccttttttccaggatccagagctggtgctgactgactcatgttatcatgggatttcaatgatatagcaacagtgtgctgagccggtgtctgctacctgggggtacctgtagtaggaataggtgactgctcttcttacttgtgctgtgccggagctttgctccctgctgcagaggccagaggaaacactgcttctcaaagacagtggaactttcagggaaatgtccctttcagagcagagtcacccacccccagggactctgaaaggcccctgacatcacacacctctgacagatgtgatgctgggaagcatctggggtcaccccctttgtctgcaaggggagcctaggcctttcttcccaggggtcccagacagtgagatgcaaaccaccactggggctcgccctaacacatcaccctggaaactgactcacatctctgagtcctgagtcacatcctgttgtgtgttctgaggtctccaagagggcattacaccagctccccatgactgaggtgaatctggagggaaccctgggaacgtccctaccttcctccaggatgaaggagggaaaaaattcctccagggaaataaccagggctgcccctagggtttatatgttcaccaagctgatttgcctttttcaaaaatagatggtagaaccctgtggtctatgtgacttttatttttaaatagctctgagagatgactgaaagacctggcgttttaaagatgtcagccacacaatcaaggaaggggctttctaactataaccttctccaagcccaggatgaagggtgccaccgctcaaggggtgctgttggaaacccagcttctgagggtgggtgtttaaaagaccctagagtggacagtcagaggagggccgggaggggtctctatccatcttctcccagcgcctgtggggagcacgaggacaaagagggatgttttgaacttttcaaagaacaagatattttgttctattgattttgtctattattttcctgtacttaatttcactggttcctagtctaatttttattatttcttctcttctgcttgcttgaggtctgtattgctattttctccagtctcctgaggtggaagcttcagtgactgattctggatctttcttttctaatatatgtattcaatgctataaatttccctctaagtactgttctatctgcatccaaaaattgtaataagttgtattttcatttagttcaaaacattttttaatttctcttgagactttttatttgactcatgtctaatgtagaagtatgttgtttaatctccaaatatttggagattttccagttatctattattggctttttaatttaaatccatgtggtctgagaaaatactttgtatgctttctatacttttaaggatcttaaagtgtgttttgtggcccagaatatggcttatcttggtgaatcttccatgtgagctgaagaatgtgtattctgctgttgttagagtattccataaatgttaattagatcaagttgactggtagtgccgtttaggtcaactgtgtcttaattttctgcctgcttgatgtatcaattactgaaagagggttgttgaagtctccaattgtaatagcgtatttacctatttctccgtgtagttctatcagtttttgcctcatgttttttgacactcagtttttaggtggacatatattaaagatgctgtcttcttagagaattcacccacattatcatcatgtaattcccttctttatccctgaaaattgtccttcctctgaagtcagctttgtataaaattaacatcgctgctctggctttctttcaatcagtgttagcatggtgtacctttttccatccctttacttgtaatctgtataaatatttttatttaaaataggtcccttgtagacaatatgtagttgggtcttgtctttaatccacactgccaatctctgtctttaaattggtgcatttagagtattcatatttaacctaagtattaatataactgcagtagtatcaatcatatttataacttttatatttgttgcacctgattcttccccccacacctctttttctaccttttataggtttaactgaacattttatatgattccattttatctcctctgttagcatattaatcattctttttaaaaatgtttttagttactgccctaaagtttgaaaagtacatgtataactaatctacatctagcatcaaataactaccacttcttccttcctgtttatatcattactgccttttatttcatttatccacatgctataatcactcaatactttgttactattattgtaaacagttatctttcagatcagttaagaaaaataaaacttaattttaccttaatatagtacttttctaatgctcttccttttttatgcagttctttttgacatttctcatagggcaggtcagctggcaatgaattattccagttttgtttgtcagaaaatatccttatttctttgaatttgaaggataattttgctgaatgcagaataatagtttggtagcttttttgttgcaacacttcatgtattctcctttctttgtgtttgcatggtttctgaagagaaagataatgtaattcttatcctttttcctctatggataaggtgttggcttttccccctctctagcttctttcaagattttctcttctctttggttttttgcagtttaaatatgatatgcctgggtgtagatttggtatttattatgcttggtgttctctgagctttctggatctgtggtttggtatctgtcattaattttggaaaattcatagccattaatacttcaagtatttcttccactgttttctttttcttctccatctggtattccaattacacattacatcttttgaaactttctcacagttcttggatgttctttctttttcctctttatctttttgtttggtaagtttctgtatcttcaagttcattggttctttgctttgtcatgttctgtctactaagtaagccattcctcatttctgttagggtgcttttggtttttagaatttgcttttgagtgttaagagtttcaggctgggcacggtggctcatgcctgtaatcccagcactttggaaggccgaagtgggtggatcacctggggtcaggagttcgagaccaacctagccaacatggtgaaaccctgtctctaccaaaaattacaaaaaaaaagaaaaaatagctgggcgtggtggcaggtgcctgtaatcccagctactcgggaggctgaggaggagaatcacttgaacccaggaggcggaggttgcagtaagccaagattgcgccactgcactccagtgtgggcgacagagcgagacactgtctcaaaaaaaaaaaaaaaaaagtttccatctccctgcctacatcatccatctcttcttgcaccttgtcttctttttccactagagccattaacatgttaatcattgttaaattccctgtcttgtaattccaaaatctgtgtcacatctgggtctggttctgatgcttgctttatctcttcagactgtgtttttttcttgcctttcttgtaattttttattgaaagtttaacatgatttatcaggcaataggaacttagtaggcctttagcgtgagttattattctcatgtacccaagagttgggctgtatttaatgttttcagaaggtaccagagacttcaaattcctctagcgtccttgtttttgtctcccatgtcatctgtgagcttctctatgaactcctccttagtcagtatgttgaagctctttcagccataacccactgttataataatatattggatcctgtgagaatctggtggagttcctgaatgaaaaacccacaacagtgcacttcctcctgaaactgtagcccctaggagtgtcttattcgcacactagtctgtactgagcctctagcaatctgtcaaaatcaccattaagtgttctcatcagtttatgaattcagaaattctgctcccagcaagcagacctcactatgattctctatatttgcctgcttctcaaaatttggggttgcagtttgccctgcaacttcagctttccattggacttaagaaaagtcatggattttcagtttgttcagcattttttcttataaaaacaagagtgatgactctcaagctctttaaattttggaactgaaactagaagcaacaggacattctgacatgaattatttaaaagggtcattgttgactctagagacattttaatattgctgcatcaaaagataaaagcattctcctttcttcttgtgtgatatatgccgtgtacacctctgagctcaccactaacctcaactctaccttatccctaacttcccatttcaaatggaagggaatggggatcaaggagtagaaggcctgttttacccattattgatgattaaaaagctgaaaataacccatcacaaaatggcctcagtaaagtggctgcatcagacatcatttagcctggaaaaccagtatgcataaaggctcaaatttaaatttttgaatccagtgttttttatttattattatttttttttttctgagacggagtctggctctgtcacctaggctggagtgcagtggcacgatcttggctcactgcaagctccacctcctgggttcatgccattctcctgcctcagcctcccgagtagctgggactacaggcgcccgccaccatgcccggctaattttttgtatttttagtagagacagggtttcaccgtgttagcgaggatggtctcgatctcctaacctcatgatccacccgcctcggcctcccaaagtgctgggattacaggtatgagccactgcgcccggccctgaatccagtattttttaatagaaacatgagttggttgagatactgagttcctgccttctccatcctaatcccaaatttccaatctttggaaatttgcccctttaccatttaatctcctgagcccagctcctctccagcctgaagagtgtgtctgtcaagactgtagctgtgaacaaaacactattacttgagccttatcctggagcaaatgtgtgtggtctcaccaatgaacatcagataagtcccttggcatggatttcttttcctttttagtaatacaatcataaaggttattcagacttattgagcatttactatggccagaaattgtgatacttgctttccatatagtttatctcacttactcctattaccctttgaagtcagaattctaactatgaatcagagaaaataagtgacctgcctaaggtcatccagttggtttatggtgaaggcaggatgcaaactgaaatttgtctgtgatttgagttcggtgctttccctagtctcctcctctcagaggcagaacataagcatgtaatagataccactagggttcttgtttctaccttgggaacagctgtttgcaagtccaaattaggcagctaatctagcagttagcccagatacagcccttgggcaccctagtagctgtaacttccagaaggcaggaaccttccattcactagtgagtccccaaaacagtggcccaagtgaagcaaaaatgtttgttggaaatatgagtgaatgaaaaagtaatttcatgaacacatgaatgaataaatgaatgaagcaacacccagtatgatgattaatgccacaggaagatgcctttccaagcatcacaagatcctgggatcttcactgactgtaagtgcctgtggggcagggaccatgttggtcttattcatcactctcctgccaggtaaattagcacattcctggcacactgtaaatgttcaataagcttttgttcttttagatggattgacttatcagaggcaactctttcaagaacaagtagccctgtgctctggagaatgatttacagtggttctcttcctcagcctggggccttttctggataactcccatcgtactctcctctacttcctcttcctagaatacacaaatttattattacaggcaccactcttcaccccacatctgattcttccctgactctgcttaatgtacaagtaaagcaaagaaatactgtgtaggacctattggaattagaatcctgctctgtcaccattggaaaggatttagggatcacctccttcggaggtgagaataagaaagtgtcagtgagtaatccaatgtcacccagttgctcaccagacagaaagaccaagagttcacctctcctgcctattagtccagtgctcgggtggcccatgagttcatgttggccctgtcagaccaaagacagtaatgaatattaaacccagaatgcaccatattatcaggccttttttgtttttgttttctattagtaacacaggtagaagaggaaacaactaaaaccccaacattagaggctcaccatccccaccttctggcccaccactggcaatgaacccaagcacaggtcactgtggtctcatgaaagaaaactgatgtgggggttgggtgggcttcagggtgttgactgccatcttcccctccagcacctgaaaagctaagttatggtgtgaagtcagaaaatgtggaatctgcaagcctgtctttaaaaaacaaaaaaactcatagaacttggactttaatcataaagatcattttaccaaagcatattttttaaaggctgtgaaatattatgcaacgtttgcatggtttaattatgagtttagaaaagcctagcacgactttttcactacagtaaaacatgacggagcatgaatcatggcatagtactttatgcttagtgtggctttagacatggggttagaggtgtgaggctgtctacacaacaaggcgtgaattactgtactgcagttcacaccccggggggctttatgacagttctgaaacctcttttgtttgcttttaaaatgattaaagtattggagtactatatattcacttagtaaatgtgtgtatctagtatatacgcatgtcttatacaaaatatctaagtatatgatttttttttcacttggagcaaaatacttgcagtagcatggggatattgaaccgtctgctatttctgtttgcctttagtcattggaaacactgttagctgtaagattacacaggagcttcagccaaggttgaacatttattttctgctgagtttaaaatggaccagctccttttgttccttgccagctctttaaatcctctaaaatttggaataaaatgaagacctttctttaatattagatttcaaagattccaagttaaactatttgcctgggaactaccaggttttttaaacttaaaaaatcagttattttcactcacacacaaaaaagaaagaaatgaatcagtatgagggagggagggaggctgtcaggagaatactggggaggaagacttgggtctccaaatgtctgattctgttatccactgtggcagcttcaaagagataaacagaaaggcaaacttgaactgctggaaatgaaaagcccctggaggaagcagatctgaatattttataatgagcagaaatagctcatttctttatgtcctgacctatacaaaacttatacccagtattttcctaaagaagtctgctcttcctacactgctacctgcaggatcatgaagctctggctatgaagacccttgggagttacggtagttcactgttatctttgtccacaaagttgggacataaagagaaaattaatgtttaactccaaagaaatgtaaaactgtcttctagtgggacagtgtccaatttaagtttccttacacatttgcctaagaatagcgttggttttcctccccttttcatctgcaaacagtatgatgcttttgaaaattaagactcctttgaacgctggagtcaaattgacaaaatccactttgtctaaatcttttgaagtcagacttttgtctcttctctatcccaggcctcttataatggcaatctataaaatacctgctaaaaactctgacttttaaaagttgcaaactcgaagtcctgaaaaggaacagaaggcttgggttgatagggccagttctactgctgggtttgtgaactagtcattagacctcattgccggtttcccagccagaccttctttcctgtcatccttgggagagaattcgccttactataaaacatttaccagcccatggaatactttttgccaaaggtaaaggtataaaaaaaaagcccaaaactctacgttcttaccgaacacagacaggtgatcccctgagtttataaaatgtttctgatgatgataattgtaattattggcaaagctgaaatcatgtcagcagtcatatgatacttgaagttctcaagtgctgcagttcaacagtctggacattaatacttctaccttgaaagtgtaatccattcctctcatcattgttagcatgattaaataaaacctttggaaggaatagttatcaggtgaaaatctccaagaatcagtctcttttgggggaaaataatccaacagaggcagatacttggacttgagtaggcttattaaaccctggtacataggccacatacatgtatgtgacatatttgaacaagggccactcatttcttattaaaagacattttttaaatcccaccccactttacatataattgacctttctgattctcttcagatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaagtaagccacttgaaaacacattctttgcagctgagctggggtggaaggtccaggagactagaggtgcatgaaggagttggcagaacattattgagtaaaacatggtttaaaggtgacctatctctactctgagtcccatgcccatgcactgattttcttggatacataagaggcagagattgtggatgtgaaggcagaagtggcttggagaagtaggttccttagacatctaaagttgttcacatttggcaagaaaggatggtgactgaagggttaagaacaatataaaaagccaaagttttcaacttttaggactcattattccaaatgaattctggactaatgggactggtccatgcggtggtggtaaattttcacagatcacatggacagcacacgggagtacatgtggaatgggaaataaatacagccgccccttggtatccatggaggactggttccaggaccccccatggataccaaaacccatggatgctcaagtccctcatataaaatggtatatttatatataacatatatatcctcccatgtatttaaatcatccctagattactcgtaatacctaataaaatgtaaatgctatgtaaatacttgttatactgcattgtttagggaatgacaagaagaaaagtctgtatatgtctaatacagacacaaccatccttttttttaataatatttttgatctacagttggttaaacaggtgcagaacccacggatatagagaaccgactgtataccccaaattagacattccaactaagcgctgttcatacagaggccagaggaacagcgtgaaaaactcaggtgtcatggttagcataattgttgttaatatgagctcattaagtattagtcatttaacctatgagccctttgggcttggcactcacctttgctcgtgggcagggaaatcagagttacagagaaaaattcctttgttgaaggcaaaagaagaaacttagtgtttggggctttgaaattggagctgcaccaaactgtgaaaatacttcagagaacttcagtgttatgatgcctgcaaacacactcgcatgtgtgttgggggaacggggcgggtcttgcttttcagctcttgggatcaaattatagcagattagggggcaggcacaggggcagtggagtcatgtctgccattttaaatgttgtgtaatgttgtgttttccagacagttgtgattacttcaggtttcaccagatgccttagctgctgttcagagcttcacagaatgccttctaagagcttcacaacggcagtactattgacatttggggccaaataattctttgttggggggggtctgtcctgagcatcggagaatatttagcagcatccttggcctctagatgccaatagcatccccctcaccccagttaggacaataaaaaatgtttccagacattgccaaatttcccaaggggcaaaactgtccccaggtgagaaccactgccttccagtgttcttgggtggtacagtaaaataggaaaaccaacttaagtgcttggttttcacattacttttggccattaatgccaatattttcatggtacattctgctccaaggcattgagagtagcacaggtatcttggcatcttgtttagcttgtggtttctagaagcttatccctcaagaacaaaggcacttgtcagcttttactgattgttctcagggcacccctctgcacaccggctacggtcttcacctgaaataatgcctgttctccttcaaatgttcctgctatgggtctatcctttggaatttattacataagtcttttgacttggtcatcacccaagatcagcaccttatagtccaagaaccctaggggccaactcctccagctgactggtgttcagatggtagggtgactttttaaataaaaggaatgagtaacatgtgcactccaaagtcccatatcacagttacatttgtgaatatcctggacttcaatcacccaaggagtaagagagaacattttatggcatgggagtgtgaagtagataaaaaccatgcctcatttcagaacccaagaatgattcttttctttttggagggaggacagaattccagatgagctttcacagtggcatagaacagtatgggagactgctcttcaatttggcagaactccctctgagaaatcaagcctggagcacaggcctgaaaagtgttgtcataaacctggaggcaggaggggggtggaatacataaaaggaaagtggctgcctggccgacagctttgagaacctgacactgctctgtggctgctttgccttttaatccagcccgacagctttgtgctctgcccctcttcccggccccagccccacctgggcttccttctgcgctggggacttggactctgtctgtctctctctctctatcctttgcagacagactccacaccttgtctgaaaagagttgtcatctagaggtttacttttttttttctttttcaaaaaaaattaatgtttagctgccaacctgggcgacagacagcatgcattaatctgagtcatgcaaaagctccttttaaggcagccattacctgctcaggttgtttaatcctctgggggcagtaggaggggccctgtagcgaggctgctttcatccatgtcaagctggagagcgaagacttgagctgtcatggcaaatatttagccccatcaatgggaaaacacttccaaccaaaatacctggacctcctaagccccagatttcctactcttaaaaactctctgtgaatatcaggggatcccaactccccccacacttctgctgaatcaggggacaccaggccagccaaaaggacagaagagctacagctggatgggtgaactgcgcagactgatgggtttgaataagggatctgagacaagacacaaagatgaaaaccaacatttgaatatagcatttgaatctgagcatatctagaaggcctaagatattgtattatcaaaatgtgtgtaaaaaagatagtttgaccaaatggatggtcttttgtagtatgacgttgctcatgtgtacatagaagaaggatcacaggcagcattgcagctctttcttttggatgttctcctcacaagtgaaagaactattttcccccaacagctgagaccataacatcattccagtacttatgtccatgacaaatcacggactcactctggattccagtaacttggtaccatcaccacattaccatgtagtagttggaacctactggcagagcatgtccagacattgctgtaaaacagggtgacctttcgttcattttccagtggattcacctttttgtctcagggcaaatgaagcaagaggaataatgggcagagtcatttatttgtgtccagagtattgcatcagatgacaacaaactgactgtatttgcctaatgcttttcctcctgtcccagcttctccgtagactctataaatctaaatggaaaaatggagtaaagcttcctgttaactctcaaacatgtcacagctctccatgtcagcaaaaacaagtgacacagggcttgctcacagatggccccaaagagcgggcagggatgaaccctgtggaatgaggtgtggcctggctcgagaatgactagagtgtggccaaggaagggcagcctcagaaccactgtccgtttacaacgttttccctgcccacatgtctgcctggctttgaaaagattaacaggagtgtttgtttgaaagtcagactcctggtttcctcattagtgaagggatctgctacagacttgggctgtttctataaactttaattacctctgatgaggagtgtatcccctcatcacattcaccccaaaggtacagaggagttcatttttaaaaatgtgttagagcaataaaaggccattagagggagggaggatggggtgtggaagagacgagagagcgagcgagagagagagaaaacacactagctctccctgctggaataataggcttgaaatatgaggaagttgatcaactgccgctgccttccaaaaacagattaatccaccttggtagctttcctttcagagcaagcttttggctctgtcgactttctctatcagcctgaactcaaaaggacacaggccacatgccatctgagcttaagagttattttgtgtgttgatctgagaacttcacattttaaaacaatgaattcatgtttctactgtttgttgctgtctgtggatttgctgatataaagaggagagtcctagcctggtcatttaatgaataattctaaggaacctgaacttctccagggtgcccttctacatctgcagtggtggttctcagctggggtgactttgcttccgtcaccccacccgcaggatatctggcaatgtctggagacattctgagttgtcacaagaggggcgggcgatgctactaacacctaatgggtaaagcagagatgctgccacacatcctacgatgaacgagacagccccctccaccccagcaaatcatgatctggcccaaaatgtcaacagtgtcaacagttgagaaactctgatctacagatatagggaaccctgcctaatacacaaatcctccgtagttcccaagggcggcctgtaggtaagaaaaatgcagagagagccagtgaaccacaggacagccctaaagccagttggtgaaactgtaaatccataatcctaacaaaataatgtacagtcgtaacaaagtgagttttagagacaaagctttacaatttctggtaaaatttccacatgtgcaaaaaacagagtagataaatcaaggtcctacatctacttgtgttaacaaactagtgaagtgcataatagagaataccaggtgaactcaaggcagtactgtttctaaaattgtggaactagtatgaaagtagatatggagaggaggagtggtaatggtattccctgacattcgctcagcagttgctactgagccatgcattcgcttaaatactaggaaattatcaatttttcaactgtcgaaggcctataaaaatggcaattttctatcattcaacctaaatactatgtgtaatgtattattatatattaatattgttaggatatatattatgtataacatattgtgttagtagtaacatatttgtgcatcctttacattagtgtcaaattatcatctgctatattaatatcacagattaatttatattattggtatattaatatattgatcaaatagagggtcagcaaacttttttctgtaaggggccagagaataaatattttagggctgggcacggtggttcatgcctgtaatcccagcactttgggaggctgaggcaggtggatcacttgaggtcaggaattcgagacctgcctagccaacgtggtgaaatctcatctccactaaaaatacaaaaattggccaggcctggtggcgggcgcctgtaatcccagctactcgggaggctgaggcagtagaattgcttgagcccaggaggtggtgggtgcagtgagccgagatcacaccactgcactccagccttggtgacagagcgagactttgtctccaaaaaaaaaaaaaagaataaatatttgctctgtggctcctgcagtccctatactgaccacctgactttacagtagtggctctaaagcaaccacaggcagtacatgaaagaatgagtgaggatgtgttccgaagtatggatggacactgaagtttgaatttcctgtcattttaacaggtcaggaagtattcttttttggatttttttttcaaccatttaaaaaatgtaaaatgcattcttacctcctgggacatgcaaaaatgccagatttggctggcaggctgcagtttgccaaccctaggattatatcaacattttatatacgttatacatattatagtatatactattgcacattatatctatactatacatattatgctatactacatcatttcatatatcatgtcatattacattacatgatattctatattaccgtattatattactgtatattataccatcctcctgggcagtagcagcctcctgatccccgtcctcctgggcatagcatcctgggtgacctcatctttttgggtggcagattctgggtagaaaccctctccctaggcagcagcatcctcagtagcccccatcctcccaggtggtagcaatcctgtgtggttccaatcttcctgggcggtaaattctgatagaaacccatctccctggacagtagcatcctgggtgtcccccgtcctcctaggcggtagcatcctgggtggtctccatcctcccaggtggtgtcatcctgggtggtctccgtcctctcaggaggtggcatcctgagtggtccccgacctcctgggcatagcatcatgggtagtccccatcctcttgggaggtgacatgctgggtgatcctcgtcatctcaggaggtggcatcctgggtggtccctgtccccctgggtatagcatcctgggtaatcctcgtcctcttgggagtagcatcccgggtggtccccgtcctccccagcagtagcatcctgggtggcttcccatcctcctaggcggtatcatcctgggtagccccctggggcagagggaagagctgtggcctccgcaacctcctactcacttccgctccgttctcttgcccgccctgcagcggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccccgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgacttaactttttaaccaagttgtttattccaaagagtgtggaattttggttggggtggggggagaggagggatgcaactcgccctgtttggcatctaattcttatttttaatttttccgcaccttatcaattgcaaaatgcgtatttgcatttgggtggtttttatttttatatacgtttatataaatatatataaattgagcttgcttctttcttgctttgaccatggaaagaaatatgattcccttttctttaagttttatttaacttttcttttggacttttgggtagttgtttttttttgttttgttttgtttttttgagaaacagctacagctttgggtcatttttaactactgtattcccacaaggaatccccagatatttatgtatcttgatgttcagacatttatgtgttgataattttttaattatttaaatgtacttatattaagaaaaatatcaagtactacattttcttttgttcttgatagtagccaaagttaaatgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagatgctgtgtaacagaacacagccaaagtaaactgtgtaggggagccacatttacataggaaccaaatcaatgaatttaggggttacgattatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcaggcagcaaaaacagctggacttatttaaaacaacttgtttttgagttttcttatatatatattgattatttgttttacacacatgcagtagcactttggtaagagttaaagagtaaagcagcttatgttgtcaggtcgttcttatctagagaagagctatagcagatctcggacaaactcagaatatattcactttcatttttgacaggattccctccacaactcagtttcatatattattccgtattacatttttgcagctaaattaccataaaatgtcagcaaatgtaaaaatttaatttctgaaaagcaccattagcccatttcccccaaattaaacgtaaatgttttttttcagcacatgttaccatgtctgacctgcaaaaatgctggagaaaaatgaaggaaaaaattatgtttttcagtttaattctgttaactgaagatattccaactcaaaaccagcctcatgctctgattagataatcttttacattgaacctttactctcaaagccatgtgtggagggggcttgtcactattgtaggctcactggattggtcatttagagtttcacagactcttaccagcatatatagtatttaattgtttcaaaaaaaatcaaactgtagttgttttggcgataggtctcacgcaacacatttttgtatgtgtgtgtgtgtgcgtgtgtgtgtgtgtgtgtgaaaaattgcattcattgacttcaggtagattaaggtatctttttattcattgccctcaggaaagttaaggtatcaatgagacccttaagccaatcatgtaataactgcatgtgtctggtccaggagaagtattgaataagccatttctactgcttactcatgtccctatttatgatttcaacatggatacatatttcagttctttctttttctcactatctgaaaatacatttccctccctctcttccccccaatatctccctttttttctctcttcctctatcttccaaaccccactttctccctcctccttttcctgtgttctcttaagcagatagcacatacccccacccagtaccaaatttcagaacacaagaaggtccagttcttcccccttcacataaaggaacatggtttgtcagcctttctcctgtttatgggtttcttccagcagaacagagacattgccaaccatattggatctgcttgctgtccaaaccagcaaactttcctgggcaaatcacaatcagtgagtaaatagacagcctttctgctgccttgggtttctgtgcagataaacagaaatgctctgattagaaaggaaatgaatggttccactcaaatgtcctgcaatttaggattgcagatttctgccttgaaatacctgtttctttgggacattccgtcctgatgatttttatttttgttggtttttatttttggggggaatgacatgtttgggtcttttatacatgaaaatttgtttgacaataatctcacaaaacatattttacatctgaacaaaatgcctttttgtttaccgtagcgtatacatttgttttgggatttttgtgtgtttgttgggaattttgtttttagccaggtcagtattgatgaggctgatcatttggctctttttttccttccagaagagttgcatcaacaaagttaattgtatttatgtatgtaaatagattttaagcttcattataaaatattgttaatgcctataactttttttcaatttttttgtgtgtgtttctaaggactttttcttaggtttgctaaatactgtagggaaaaaaatgcttctttctactttgtttattttagactttaaaatgagctacttcttattcacttttgtaaacagctaatagcatggttccaattttttttaagttcactttttttgttctaggggaaatgaatgtgcaaaaaaagaaaaagaactgttggttatttgtgttattctggatgtataaaaatcaatggaaaaaaataaactttcaaattgaaatgacggtataacacatctactgaaaaagcaacgggaaatgtggtcctatttaagccagcccccacctagggtctatttgtgtggcagttattgggtttggtcacaaaacatcctgaaaattcgtgcgtgggcttctttctccctggtacaaacgtatggaatgcttcttaaaggggaactgtcaagctggtgtcttcagccagatgacatgagagaatatcccagaaccctctctccaaggtgtttctagatagcacaggagagcaggcactgcactgtccacagtccacggtacacagtcgggtgggccgcctcccctctcctgggagcattcgtcgtgcccagcctgagcagggcagctggactgctgctgttcaggagccaccagagccttcctctctttgtaccacagtttcttctgtaaatccagtgttacaatcagtgtgaatggcaaataaacagtttgacaagtacatacaccat

SEQ ID NO: 37209 - DNA, 7200 bp, Homo sapiens
gttttggcgtctgtttgctgcggtaggaacatggcggatcggctcacgcagcttcaggacgctgtgaattcggtgaggaatttcattcgattagcctctgtctttctctttcttgaggtaaagcaagggaggaaaggggcccaagaggcaaaacttgaaagtggggagcggactgagagacagggcttcggcataaagcgctctctcgggaggcgccaccgcgaactcggaggtttgaggccggctgccgggcggtgcttgaaggtgcgggagggagcagactctttcgcttgaggagaccgggaagatcgttcttgtccgggtgaggccgccaggacttgtgggctgcgcggtcctgtcgtgttccctgaggacagttttattttcttgtcagtggtgcttacgggttctctttcttttgggggttgggaggagaagcaggagcttttttctttcctcatcaattttaatccaccaagggagatctcatgctctggatgactgggtttttgtaatgaaatgtcagccgagagtattccttcaccagcgctttcaggttggtgcgggagcgatgctgaggtgaggtgagagattttctttcatcttagctcgttcctttgggcccagagtatccttccatctcttgcctcttggccatccctcagaatacatcagtttggggacatctttatgataggaaatcttctaatcctcgtatgtctttccgcttatttgagtcttttttcttttctttttttttttttttttactttggagacagtgcctttcgcccaggctggagtgcagtggcgcgatctctgctcactgcatcctccgcctcccgggttcaagcgattctcctgtctgagccaaagtagctgggattacaggcgccctccaccacgcccggctaatgtttgtatttttagtagagacggggtttcaccatgttgtccaggctggtctcaaactcccggcctcaagcgatcctcccgcctcggcctcccatagtgctgggattacaggtgtgagccaccgtgcccggcctacaagtcctttttaatgtctcccccaaattctactctctattaaaggccaagtctagtaagtagctccccagctttgttccttctggttatttttcctccacactatgcctgagtggaaagtagaagcaaagccagaggatgcgcagtcatgggcccctaatgaaggggtcatgttctgagaaatgcatggttttggcgataacttttttttttgttttaataagtagaagtacaatgtaaaataacgataaaacagtaatacataaaccagtaacaaagtcatttagtatcattatcaagtgtcatggactgcacataattgtatgtgctatgctttcatacactggcagtgtggtaggttgatttacagcagcatcaccacaagcactaaggaacgcattgcgctacagcgttagtactgctacgatgtcactaggcaataagaatttttcagctttattataaccataggggactgacataatatgtgcatcccgttgaccaagacgtcagtgggtattcccatgcggcaatgggtgtacttattaccattacgagttagattgttttctgctaaatagttttccattgatagttatgtttctcattgtctgattgtgatttaatgtcctagataaggggctagagagaaaacatgctgataggaaaacctaagtacctggtttccttgccagttttttttttcctcactgtaagctaataacttggcatttttcttaatacatcagaatttgtacacttgaagagtgtgaatctacttgtgataaaactgatctaccctgggtgaataacactagtttttaagctgagaggaccagcctctaagtgttgaattcaccaagataaattctaccctgcagggacttgcctgggctgccagccagccttcctcagggaactactcctttgaggttttacgaaatcaaattgtaatgatgctgctggatagaaatcttattttagggaaaattttgcatattcatacatgtcttgtaactagaaggataataaggacagagtgaatatggccttaactccaggttaggcataatgataattggattttggagaaaagcctttaggataactagtatgagtgcctactgtgtgtaagcaccatcatgtttacaaagagatactcctaaaggaggttaaaaaatgtcaaatactcaggagacatttaagtgatggaaaaacagtatgtggttagggagttataatgaattgagtattttcagcttcaggttctgatgtaaattggaatatggagtgatgtgaaccaaaatagggggaatcttcttagcatttatcctaatcagaattatttgtataacttttaacatttgttctaccctctgaaaaccgtgagtgcagaagctatgtcgcattcactatgtctctgtagtgtttatatgcagtactttagttattttccataaatttttgttgactaaatggatcttaaaagcttttgaaggatggaaaagatagacactgtgttgaatatttttttgtgtgtgtttcctctattacaacaatgctataataggagaatgtatccaatttaaaaatgaaaaatgctgcttggattaatagagctaggatcaggatctaggtttgtatagcatctgagcacttattgctccattacaattagcaaaacctgggcaaagccatttagtcataagtgactttatgactagttagataaatatgaaggagtagtggaaaacgagtcagtagagttgacttagattattgaaagcttcaaaacagcctgagttggagatttatcttgaagacagtggtggagtaagcttaaatgttttgatcaggttaaaataaataacctggtgaactggaaaacaacaagaagactattgtaataattctggtgtgagataattggttgaactaagcaacagtgatagaaggaaaagagaaagatttgtagtattagcagaatatgaagatcaaaggaaagtaagaatctgaagttagattggttgactaggagactttcaatacaaattaaatattaaaaagaggaaacagttgcctttgagttctgtcattgaaacaatggcagagaaacccagtggaaatacttattagaaataggaggtttgagaggtcaagactaggtgagagaaattggtagggaagataggtgtatttaatttggagatggtaaggaattgctattcccaatctttaaaagtacttaaggaatacttttagagtacaagagtttacaaattgagtcttgaacaaatacatttctgcttacttaaggtgcttttctgagcagcctcttcctcactatttctttacacttgtaactactccagtctcagaaaaggaatcatatactttgtgcatgagaaataaatttttattaaacatggtgccatagatatttacaagtcaaatttgctcttttccatcactatccccaaaaagtctttacttgtggcttacaataagtattggccaatattctcttatcattttactatcacaagaaaagaaagattattttgtatttcaactgtttcaactagatttatatcaaatttaactttacctagattgataccaaacttagtttctttgcagaattaaaacgtttaatcaacattaataataactggcttattttatcaacaatcactcctttctgttttattcccttgctcagagattatcattacagaaacttattgttgttgccattaccaataaagtccttaaaactgataagtcctttctaaccttgatatgttttctttggcctaagcttgcagatcagttttgtaatgccattggagtattgcagcaatgtggtcctcctgcctctttcaataatattcagacagcaattaacaaagaccagccagctaaccctacagaaggtaaacaggttttcttagcttctcttagtttgactctcacattttttgtaatcctttaaaattagatttcttgagaaattcagcttattttatttctaaaattattgttgtttgagaatattacaagttttgtttgttgtaaaaaatttacagtcaattcacctaacatctcataattctggttcatgtcagataatagattgttactcctttagaggagaatttgtattaatttagctgagtgagggaccttaacaaggaaggcatcccatttataaatttctttattcaggtgaccactatattgtcataataaatgaaattacatacattatgcttaattcccaatttgagctaaatgtgtaacaggattggtgtatattttaatcattagaatcttctttttttttttgagacggagtctcgctctgtcacctaggctggagtgcagtgatgcaatcttggctcactgcaactttcgcctcccgggttcaaggaattctcctgcctcagcctcctgagtagctgggattacaggctcatgccaccacgtctggctaatttttgtatttttagtagagatggggtttcaccatgttggtcaggctggtctcaaactcctgacctcgtgatccgcctgccttggcctcccaaagtgctgggattacaggcgtgagccaccacgcctggccgaatcattagaatcttagggcagaaaaagctatatgaagtttctggtttcattaacttaaaatttgtttctgaaaacttgaggttttctaatatcctaatctagcagtatctttctctagagtatgcccagctttttgcagcactgattgcacgaacagcaaaagacattgatgttttgatagattccttacccagtgaagaatctacagctgctttacaggtaagcctctattcctttgagaattttaccagtaatagagaattttgaattaaaggaggtagatttagtaccttttgtctgtgtccatttgtgctgctataacaacatacctgagacagtaatttataaagaacagaaatttattttctcacagttctggagtctgggaagtccaagatcaaggcatttattactcactgtgcatgagtaatgaatttttattaaacatggtgccatgtttagggccatgttgagggccttcttcctgtttcctcacatggctgaaggcagaagggcaaaagagcaagagctccctcttcaacctcaagccatattttaagggtactaattccatctatgagatctctgccttcatgacttaatatcctcttaaaggccccttccctcttaataccatcacattggggattagattttaatgtatgaattttggaggggatgcattcaaatcatagcaccttttgttataatattcaaatttccattataaggaaacctcttattttcctcaattttgtctcttttcctagtgaagaatgagaggagggtggcattctacaattggagtagaataatggtgtctaaacgtaatgtgtaagggagtcacttaaagatatctagagatctctaattgaaaagtcattctttttaataattcacatggggaaaattcttaaaagttgtctgatttttagaatttctttactgaaaaacatatcacaatgattgcaaagtcatccagatttaaaaataagtacatctgtgacagcttctctttctaaactctaaagattttaaaatttgtgtcttataaaggctgctagcttgtataagctagaagaagaaaaccatgaagctgctacatgtctggaggatgttgtttatcgaggagacatgcttctggagaagatacaaagcgcacttgctgatattgcacagtcacagctgaagacaagaagtggtacccatagccagtctcttccagactcatagcatcagtggataccatgtggctgagaaaagaactgtttgagtgccattaagaattctgcatcagacttagatacaagccttaccaacaattacagaaacattaaacactatgacacattacctttttagctatttttaatagtcttctattttcactcttgataagcttataaaatcatgattgaatcagctttaaagcatcataccatcattttttaactgagtgaaattattaaggcatgtaatacattaatgaacataatataaggaaacatatgtaaaattctgttatgacataatttatgtctccattttgttgtattggccagtacttttacaaatcaaaacatctctcaagccaaaggagaagacagtaagaacagacataagggacattttagtttgggctagtgtcctgcctcttagaggtggcattgtgtaaatctgagctttgagcaagaaagttttggaaattgtgttgcttttaagaaatagagttagtgtggctggataagaaagtcacatttatgcaaatgtttcttctgctagaacctcatacctgttctagttcatctccacgtttattttaccaagagatcctctgtcaagagaatttcctggctgttgtgaaagaatttttctacatcctgaactatttttcctatttcttttcaccttgctttttttcatccttaatttgcttgtcatcacaatgaagtatgttttttgaatcatcaattctttctcattctccatttatctgaaggttcttttgcccttattaacctctcaacttttattgctgtattctagtcagaccagaacatacttccactacatcagttacttggcatcatttcacctcagtttattattgccaaataataatttgtgtcagcattttcaactatggttattcatccaacccttggatctctttgagtctactgataatctccactggaaaggtggaattgaaatgtggtccacattttaactagctatttcctggggctgtatttttcagaatatgctgagctacatttgctgcaatctgttgctattcagagtttaagtttcaggagaaaacaggaacaatagaacactctgcctgttatttttgttgtaatcaagcttttccacagttcttgaaaagtactatgtttcaaatttcaggaacaccagcgttagctgtaaaagttgcagcaatttattggctagtcatagaaaatttttgaacttttaactgtattttaattgatgtttattaaaaacactttgctatcag

SEQ ID NO: 37210 - DNA, 14863 bp, Homo sapiens
gagcccggggtgctggagggaggcggcaggcccgggtcaggggcctcgagatcgggcttggggtgagacctgtgcgccgtcaccacgggcggggcggggcctgggtccaccggggttctgaggggagactgaggtcctgagccgacagcctcagctccctgccaggccagacccggcagacagatgagggcccaggaggcctggcgggcctgggggcgctacggtgggagaggaagccaggggtacctgcctctgccttccagggccaccgttggccccagctgtgccttgactacgtaacatcttgtcctcacagcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggaggtaagtaccccaccacctccacctgccgggacacctcacccccagcccactggctccctgcatcccagttgcatccacaggcactgaatgctttgggtcggtccccaaactctcagagccccagtttcctctttcgtaaaacagcaattaataaccaccattgtaggactgttgagttaattagcaggaacatataggatgcacttgattacagagctggtgcacattaaagctaaaaaatggttgctgccgggcgtggtggctcacacctgtaatctcagcactttgggaggccaaggcaggaggatcgcttgagcccagaagttcaaggccagcctgagtgacttagggagactccagctcttaaaatacatatatatatatatagcagctattagtgtggggttaggacagaaatcagtgacaggcaggcagtgatccgaaaaggaaaaggggcctgcctaaggccacaccttcctggtgtttctttccttagaatgtgggggctggaagcctccttggtgccctgccccaggctacatgctttccctgggattaggccttccagctcccagatgtgttctttcttgccctgtggctcgtacccacagcaggactgtcctggcacagtggccaggggcagatgacctcaaggggcagacagtcctcccagacagcagggctgtgtggggtgagaagcacaggctccaagatggaaggatggacactggggttctatgtccatttctcagtaggctctagcacccctgtgcccagcactggccttggcacctggaacaacaacagatatcttctgaacacaaaaaccaggtcaagctgggtggggtggcacatgtctgtagtcccagcaactcaggaggctggcttgagcccaggaattcaagaccagcctgggcaacatagccagaccccatctctaaaaatagaaaactaggtcatgtcactctggcactgcagcttaaaagacctcctccccattttcaggattaagaaggcttaagaggcctctttcccctcgctctcttacggataaacacccacactcgattctctcagattggaccccatagcttgctttctttttttctgtttgttttgttttgttttgagacagggtctcgctctatcacccaggagggagtacagaggtgcgatctcagctcactgcagcccggaacttctgggcttaagtgatcctcccacgtaactgggaatacaggtgtgtggaccacacccagttaatttattttttactttttctttttttttttttttttttcctgagacggagtctcactctgctgcccaggctggggtgcagtggtgcaatctcggctcactgcaacctctgcctcctgggttcaagcagttctcctgcctcagcctccagagtagctgggactacaggcgcgtgtcaccatgccgggctaatttcttgtatttttattagagatggggtttcaccgtgttagccagggtggtctccatttcctgacctcgtaatccacccgcctcagcctcccaacagtgttgggattacaggcgtgagccaccatgcccagcatttttcacattttcatgagatgagggcaggggcggggtctccttttgttgcccaggcaggcctcaaactcctgggctcaaacgatcctcctgcctcagcctccagaacagctgggaccacaggtgcatgccaccacaccagctcattttttattttttgtagaggtggggtcttgctttgttgcccagtcttgtctcgaattcctgggcccaagcaatcctctcaccttggcctcccagactgttgagattactggcgtgagccaccatgctcagcctccacagctttctttaacttcctgagcttgcacttggccatttttctgctcacaaacttcccctgctctctgccccccacacacactcagcattcactcgcgccacacagtgagtgctcaccgtgtgacacaggctgttccagttgctagggggcctcggtgaacccaagcgtcaggaatccttgcccttgtggagcttaccttctagtgagctggtggggccatgagcaaacaagcacaaaagcatcctatcatgcgtgagaagatttgtatgggggcagcatgtaaaagagttaagagaggccgggcgcggtggctcacgcctgtaattccaacactttgggaggcctaggtgggcgtatcacaaggtgaagagatggagaccatcctggccaacatggtgaaaccccatctctaccaaaaatacaaaaattagctgggcatggtggcgcgcacctatagtcccagctactcgggaggctgaggcaggagaatcgcttgaacccgggaggcggaggttgcagtgagccaagatcgtgccactgcactccagcctggcgacagagtgagactcatctcaaaaaaaagagttaagagaatccggagtcacaggggcggggggagtgatggtagcagaggtggtcagcactcaccttggtgagaagcaccactggagccaaggccacagggatgatgggaagagagttccaggcagagagaagggcagatggtaaggcctcgagggcaacacctgctcctggctagggtgggcctaggggagggggtttaggaaagggtatttggagacctaaagttgaaggtcattctaaggactctggcattgcctttgagtaaaaacctggaaaggatttgagcagaggcagcatggtcagatttagacattcagagagtcaccagggaggtggtgagaagtagctgatccctggatttatttttaaagcagaactggcaggatctgctgatggactggatgtggggtgcgagggaaagagaggagtcaggatgatgccaaggaattttaaaaaaactattaggctgggcgcggtggctcacgcctataatcccagcactttggtagttcgaggtgggcagatcatgaggtcaggagatagagaccattctggctaacacggtgaaccccgtctccactaaaaatacaaaaaattctctgggcgtggtggtgggcgcctgtagtcccagctactctggaggctgaggcaggagaatggcgtgagcccgggaggcggagcttgcagtgagcagagattgcaccactgcactccagcctgggtgacagagcaagattccgtctcaaaaaaaaaattattattggccgggcgtggtggctcacacctgtaatcccagcacatcgggaggctgaggcaggcagatcacttgaggtcaggagttcaagaacagcctggccaacttggtgaaatcctgtctctactacaaatacacaaattagctggatgtggtggtgggcgcctgtaatcccagctacctgagaggctgaggcaggagaatcacttgaacccaggaggtggaggtcgcagtgagctgaaatcctgccactgcactccagcctgggtgacagagcaagagtccgtctcaaaaaacaaaaaataaataaaaataaaataaattaggccaggcgcggtggctcacgcctgtaatcccagcactttgggaggccgaggcgggcggatcacgaggtcaggagatcaagaccatcctggctaacacggtgaaaccccgtctctactaaaaatacaaaaaattagccgggcgtggtggtgggtgcctatagtcccagctactcgggaggctgaggcaggagaatggcatgaacccgggaggcagagcttgcagtgagccgagatggtgccactgcactccagcctgggcgacagagcaagactccgtctcaaaaaaaaaaattattattattattattattattattttattttatttttgacatggagtcttgctctgtcgcccaggctggagtgcagtggcaccatctcagctcactgcaagctctgcctcccgggttcacgccattctcctgcctcagcctccagagtagctcggactacagcctcccgccaccatgcccagctaatttttttgtgtgtttttagtagagatggggtttcaccatgttagccaggatggtctcgatctcctgaccttgtgatccgcccgccttggcctcccaaagtgctgggattacaggcgtgagccaccgcgcctggccaaattattattaattttagagacaaggtcttgctatgttggccaggctggtcttgagctcctggccccaagtgatcctcccaccttggcctcacaaagtgctgggattacaggcatgagccacagtgcccagccaacaccaaggaatctggcttgagcacccggtaggatgaagttgcttttaatggagaagaaacactgaagggtgagggaggatctggaggctaccctagagggtgggatagagggggattttttttttttttttttttttgagatagagtcttactctgtcacccaggctggagtgcagtggcacgatctcggctcactgcaacttccacctcctgggttcatgccattctcctgcctgagcctccccagtagctgggattacaggcatgcaccatgcccagctaatttttgtgtttttagtggagacgggggtttcaccatgttggccaggctggtctcgaattcctgacctcgtgatccacccgcctcagcctcccaaaatgctgggattacaggcatgagccaccgcgtctggccgctagaggtggcttttaagcatctggtgggatttttagcagggtgctagtgggagctggcagggacttggagtctgaaccagagttgtgcttgtctcagtccagttaggggtaggggcttcaggtgtgtgcaaaggaaggaatggtagatgtggggtccaagctggctgagcttcagggaagggagcaagccctgggaagccgcagcatcgttggagttggggtcccgggggcatgatccacacaggttgggtcagctggtgggaagcttgggatggagttatttgatggtgacaaggcctaggttatgtccctgggaatgagtctgaggggagagtgggacaagatcatggtagaaggagtagcaaggtacagaaaggagacagggtgctggtggagtggcagaggacaggagtaacattctgcacaggccagggacgacacctccccccagccccagctgcagacccgtaggaaagagggctgcgggagaagacagctgccaggtgaggacagagctggatttcttaaccttttgatttagttttcagtgtctccaaaagcaagtggtttcccagaaaagatcagcaagtgccagtgccccgccagagccacggggcctctgccctctctacctgcgcagagcaactcacacttggttcggtcactcctcatagtccctgccaccaggcccccctgctggatggctgaggtgtccccagggcagggactgcagccaccttgtgctgtgacagcccacacagcccagtgtctgaaacaggtgtggacagtggagaggcagaaagaagcagcccagtgctagcccctgggccagactgcagggttcaaacgtggctctacccttcctagcaggttgagcttgagcaggttaattaactccatctgcctgagtttcctcatctgtaaacgggaatagaactagtcccacctcgcagggctgtggcgaggacctgatgagttaatataggaaaagtgcttggaaacagtgcctggcgcagaggaggggctaagtgtttgcggctcttattattagaactgccattgttattatttatgtatatatatatttatatataaatatatatatataatttttttttccaagatggagcctcactctgtcgcccaggctggagtgcagtggtgcaatctcgcctcgcagcaacctctacctcccaggttcaagtgattttcttgcctttatgtacattcttggctttatatatttataaagcctcaaatttctgggctccagccatcctcccacctcagcttcctaagtagctgggactacaggcgcacgccaccatgcctggctaatttttttattttaatttttgtagagacaagggtctttctgtgttgctcaggctggtctcgaactcctggcctcaagcagtccttttgccttggcctcccaaagtgttgggattacaggcatgagccaccacattgggcctatatttttaagttatggacaaaaatccaaagaactatattttgtaacgtgaacattctatgaaattcaaatttcaaggtccctaaagaaagtgttagtggaacacagcaaggtgcagtgtattcatttacacattgattatggtttcctttcagctctggccacaaaggtgagtggttgtcacagagaccacgtggcccactgaaccccctttatagaaaacattttcagctaacttaggaaaagggaaaagaaagtgaacaaacatttgccagccagcctttcatacctgtaatcccagcactctgggaggccaaggcaggaggatcacttgagctcaggagttcgagaccagcctgggcaagatggcaagacacttctctaaaaattttttaaattaaaaaattagccgggcatggtgatgcctgtagtccaagctactcaggaggctgaggtgggaagatcgattgcgcctaggattttgaggctgcagtaagctgagatcgtgccaccccactccagtctgggtgacagagagagaccctgtcgctgttttttaaaaacaaaaaggaaacatttgccaactttagagtactttctgattttatgagctctgagcaaggttgggggtgttctctgcaggcctgaaggggcttctgtaccggaaggctatagtcaaggctgaggcctacaggtgccggaggcggacaggctgcgagtgtctgcccagggtggggtggcagcactggccactgtgctggccactgacgtcagcctcccccggcagcagattgtgtgtggtcggcatgtggtaggggcaggatccaaacccagcccttgcctgatggcagagcttcactgctccaaacggtctggaacaccactgttttaattaagtgtgcaattcagtgtgcaagtgtcttgtaattaagtgtgcctctgtttcctcatctataaaacagggagaacttcgtattctccttcttgggaatctgaggactctgaaaatcccagtgcagggatgctcgcggaagcatcagcagggatgtccgccccagccgctgactcagaagcccaacacgcagagaatgtaaagctagaggtgccatgctggggcctggggcacttctagccacagccactaccctccacttccacacccagctccgggccaggctctaggcggatggcaagagtgggcaggcctgggcacccacccacgttcacacccaaggaggagccacaccccttcccttccccagagaagggagagtctggcccaggccctgccccagccctctccttcccccagggaattcacagacactcccccagggtttttccctgtaaatagaacactttttaaaaattcaatttagggctgggcaccgtggctcacgcctgtaatcccagcactttggggggccgaggcacttggattgcctgaggtcaggagttaaagaccagcccgaccaacatggtgaaaccccgtctctactaaaaatacaaaaattagctgggcatggtggcgggcacctgtaatcccagctacccaggaggctgaggcaggagaatcatttgaacctggtgagcagaggttgcagtgagccaagatcacatcactgtactccagcctgggtgacaaagcaagactccctctaaaaaaaaaaaaatacatatatatatatatacacacacacacacacaaatatatacacacacacacacataaatatatgtatatttgtatttacatatatataattcaatttacacaaatgggtatcatcttgataacaactagcttggctaagtccacgaatttggtgaaaaactcccaccccataggacaggttcctggcagaactggtgctagcagaaggcccaaaggggccttccccagcctaggcctccaaggcagcccaaggtacagctggaaggagcctggggcatgacagctaagcacacagcccctgaagccacattggttgggttgggatcccagctctgctacctactagatcagtgaccttgggcaagttacctatgctctctgccttagtttcttcctctgtaaaatggcaaccatgaggaacctccctgatagggtgtggcaaggatcaaatgaatgaatacacagggagggcttccgaccatccaccatacctgcccagtgtcttctgcttgttctgatccctgggcaaggggcagtgcccaggccaagtgcctgggtgcaagtcactcaccttccacctgtggggccttgtgtccggcaagcgtagtggtcctgtggccccactcagagctagtggaggagaacagctgccgtttcctgcgtatttaggtggctaagcaggctgtcccagccacacggcctcaggcaagttcttaacctctgcctctgtttcctcatctgtacaacagggagagctggatattcacctggctgggactctcagaggcctcaggctatgaggggccggtagggggctttcctgctctcatttgttgtcatggcgatcctggcagatggggaactgcccccatttcacagaagacactggggccccaaagggttggagaatgggctaaggtcagagcaggaatgtggccagggcctggcccacctagctgacccctgctccacagtcaccgcaccacagaactggaaattactctgcagacaggcctgttccgtcagtgccccttctgttcccggctctcctgcccctatccgaaatccttcagcctcccaaggtgctgggattataggcatgagccgccacgcctggctgtcatctgtaatctttactcctgacctagtatgcctctccccactgccacctcactcctccagggtcttgaggtatccccacctgacctgggggcagctctgggctttggtgatgctcagaatgcccaggcactctgatcacagcctatcttaccctaggcctttccggattccgtcctctcgttcccttactcgctttttttttttttttttttttttgagacaaagtctcactctgtctcccagactgccagactggagtgcaatggtgagatctcagctcactgcaacctccgcctcccaggttcaagtgattcttgtgccttaacctccctagtagctgggactacaggcccacaccaccatgcctggctagtttctttttttttttgagacagagtctcactctgccacccaggctggagtgcagtggtgcaatctcggctcactgcaacctctgcctcctgggttcaagtgattctcccgcctcagcctcctgagtagctgggattacaggctcgcgccaccacacctggctaatttttgtgtttttagtagagacagggtttcaccatgtgggtcaggctggtctcgaactcctgacctcgtgatccacctgccttgggctcccaaagtgctgggattacaggcgtgagccaccacacctggcctttttttgtatttttagtagagatgggtttttgccatgttgggtcaggctgatctcgaactcctggcctcaagtgatccacctgccttggcctcccaaagtgttgggattactggcgtgagccactgcgcctacttgctttttttttttttctcgaggtagagtttcactctgtcacccaggctggagtgcagtggcgtgatctcagctcactgcaagctccgcctcccgggttcacgccattgtcctgcctcaccctcccgagtagctggaactaaggcgccagccaccatgcccagctaattttttgtacttttagtacagatggggtttcaccgtgttaggatggtctcgatctcctgacctcgtgatgcgcctgcctcggcctcccaaagtgttgggattaaaggcgtaagccaccgcacccggccacctacttgctttcttagtcatgtgtctcatttatgtgtcctagctgggacccctggaggccctgcactggcccacaggccaggtcctcaggtcctctgaggggagaagagacattccaatggttatcccccgccttcagttcctggcctgtaatttacctcctccaaagagcctccctgacagacatatcttgccataaacacccagcatgtttccctacctgcctctctttttttttttttttttttttttttgagatgggtgcagtggcgtgatcttggctcactgtaacctctgctgcccaggttcaagcgattcttctgcttcagcctcccgagtagctgggattacaggtgcctgccaccgcgcctggctaatttttttgtatttttagtagagacggggttttaccatcttggtcagtctggtcttaaactcctgacctcgtgatctccccaacctcggcctcccaaagtgctgggattacaggcgtgagccactgcgcccagccccccacctgcttctcactctgtcattgcactctgagtgtttgctcaggggagtggttctaagtctttatcggtctgggtagaggagtggagttggcaggagttgggagatggcacagagcacagttcaaatagaccatagtaggcgggcctctgaataataacccatagtgcacttgcagcctacaaagcactttcttttttcttttgttattattattattatttgagacagagtctcgctctgccacccaggctggagtgcagtggcacaatctcggctcactgcaacctccacccactgggttaaagcagttctcctgcttcagcctcctgagtggctgggactacaggcgtgaaccaccacacctaactaatttttgtatttttagtagagacggagtttcaccagagtttgaggccaggctggtctcgaacttctgacctcaggtgatccacctgccttggcctcccaaagtgctgggattactggcgtgagccaccacgtctggccttcttttattaattttttaaattaatagagatggggttttgcaatgttgcctaggctggtctcgaactcctgaactcaagcaatccacctgcctcagcctcccaaagtgctgggattacaggcgtgaggaatcacgcccagccacaaagcactttcacattttttaattttatgtgatgttcacacagccactgggagtcagggctaggattatcccctcataaaggtgaggacacaggctaagagagtcgaaggctggctagacaaggggagagacacagagctccgctgatcatcactggactctggattccaccaaacctttggaaccttccagcctcaggcctccacagcttcacagaaactgggcaagtcttaactctctaagcttctgtcttctcacctaagcatgtttggtactcacctcccagggtggttaggaggataataagggaatgtctcggcctacacgtaagtgcaccatcaatggtacctaaaaacgtcaacagttccagacactgtctccagagaaggctctgtgggggatgcggacatgtagcggccaagttcttgttctccaggggctctgcaggtcccttgcagaggaggcattcaatcctgccggctgtggcaggacactttcctatccaagggattggcttcctccgatgtagaacagacactatgaaatagctaccaacccaggggttgccaggaggccccatgaaggtcttgcactaataatacttcttgctttttttttttttcttttgagaaaaaaagcctgtcgcccaggctggagtgcagtggcgtgatctcggctcactgcgacctctccctcctgggttcaaacgattcttctgcctcagcctcccgagtaactgggactataggcacgtgccactatgcccagctaatttttgtgttttgagtagagacagggtttcaccatgttggccaggatggtctcgatctcctgaccttgtgatgtaactagtatttcttatgcccttattttgtgctaggcacagggcctcacccattattggcactcggtaaggattcgtgggattaatgagaagttaacctaaatcttcaccaaaggcccctgagcttcccctcgattcacatacaagggactggggctctgagaggtgggctgtgatgcgcccctggaagacccacgagtgggcctgcagagctgatggggagggttcaggcagggccaggggcttagaggagctgagattaacgtcgcccccctacccactgaccctctgcaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaaggtgagcgccagtccccagcgtgccaggacctgaagtaccaggccgccccccgccggtctgtccctgccttgtcccaaggcacgcccggatctggagtcccacgacccctccccaaagccgtcctgttccttcctagctccagagcattctgggatttgtagtcacaagacttccccgcccccactccccagctcttcccccgcctggtgtgtgtgtgtgtgtgtgtgtgtgagtcacagggcatgctgggatctgtagtctagatcccactccaggcgtgtgtgtgtgtgtgtgtgtgtgtgtgtgtgtgtgtgtgagagtcacagggcatgctgggatctgtagtctagatcccactccaggcgtgtgtgtgtgtgtgtgtgtgtgtgtgtgtgtgtgtgtgtgagtcacagggcatgctgggatctgtagtctagatcccactccaggtgtgtgtgtgtgtgtgtgtgtgtgtgagagagtcacagggcatgctgggatctgtagtctagatcccactccaggtgtgtgtgtgtgtgtgtgtgtgtgtgtcagtcacagggcatgctgggatctgtagtctagatcccactccaggcgtgtgtgtgtgtgtgtgtgtgtgtgtgtgtgtgtgtgtcacagggcatgctgggatctgtagtctagatcccactccaggcgtgtgtgtgtgtgtgtgtgtgtgtgtgtgtgtctcacagggcatgctgggatctgtagtctagatcccactccaggccaaagctcctgggttccccgaattcttggaagaccaggcatgctggtatttgtgctccttgctggcacctgtgcgctctgtcgcccaggctggagtgcagtggtgcgatcacggctcactgcagcctggaactcctggcctcaaaggatcctcccgcttcaacctcccaaagtgctgggattacaggcgctcaccatcgctcccggccctttgattctcgaattgcggtctcatcttctgggtgctaggtctccagctctggcctttccatttagggccctaggcatcctctcttcccgtctccggcacggagttcctgggatctaaccagttcccattcctgggggcccatgcgtcctcgcgagcgtccctgaccgcccggcgtggagcctcctgggagttgtggccttcattatctcccccccgatctcacttagaggaaggctcacggaagtggagagcctggctcgagctgccatggtaatctaactcatgtaacccttttctccctccaccagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacagccgccggaagtggctccgtggccccgccctcaggctccgggctttcccccaggcgcctgcgctaagtcgcgagccaggtttaaccgttgcgtcaccgggacccgagcccccgcgatgccctgggggccgtgctcactaccaaatgttaataaagcccgcgtctgtgccgcc

SEQ ID NO: 37211 - DNA, 5499 bp, Homo sapiens
agatcacaccagacaattataaaagaagagctggtcctgaagctcacaaccgtaacagccaccagacaagcttcagtggccggcccttcacatccagacttgcctgagaggacccacctctgagtgtccagtggtcagttgccccaggatggggaccacagccagagcagccttggtcttgacctatttggctgttgcttctgctgcctctgagggaggtgagttgggggatcagcacttaggagggggtctgggcttgcatggcaggggtctgggtccaggcatcccagacggctcatcactagcagagtgattctccgtttggctttccttttctgagcaggcccaaagtgggcctaggccagtggagcctttaaccaaggaggcagagagcaggggcacagaaggagaggggttcctagaaactgctgccaagaaacacagaatcccagtcaaatagacaactgagtggggggtgggttcacagagtgagggtctcctgctgatgaggatgtagggaggtggctggtgggagaggcaagggagggaaaaggggcccccaggctgctcaaaaccggattgctggcccagcaagcctcgactgactccctgtctgattagaggagttgaggggtgtccatccacagacccaccctccatccagcacaaacacattctttatctgctttgatgcctgaacaaaacaggaacccctcaatgctatgggtggaaactaagaaaaaaaggaaaagaaaaggaaaaaaaccacccagggcactcctgcaggaagctgctgaggatgtcagcaaatctgtccacttctctgtgaagccccatgccatcattcttcccagctcctggtcttttgtgtctgcagatcacctacaagtgacccttccctgtgcctgtcccagtcccccaggccctaaattgagacctaaactaaggcggagctgagactggctgaaggggaagcactcaaccttcaggaagcctccttaaccaaaggcctaaagatgtttcaagggcctggagtaggagggtgggtggaggaggtggattgggtaggctccaaccagctcaaggtccagactttttcctctgaaagctagagacgcatcccagcagagactggggaggacaacccacagccctgagggaaagactggcagaggaaatgagggcctccctccccaatcccgtatgccatactccctttaggcccaacctctgagccagtagaggtggagctatcagaccgccacaggctttctcagaacccagctggtcatgtctaggtgtgttggggctgggagaggattaggggacacggggcaggtgaatacagaggggcatctcgtgtcttgcttgtctgtcctacactcttgatctccacagcctccccatcccttgctgaagtccagggaaggccctcccagtggcccctgacttgcccttcttccctccaggcttcacggctacaggacagaggcagctgaggccagagcactttcaagaaggtaagagtttgggggagcagcatgggattgggactccaggaggcactgtgggctctgatgtctcccctcttgcttctagttggctacgcagctcccccctccccacccctatcccgaagcctccccatggatcaccctgactcctctcagcatggccctccctttgagggacagagtcaaggtaaggtcaccatcccatgccctcctcagtgaccctccaggtttctaatctggcctatatcccacttttcaggtggaaaggagggaagaggccctcgcccccactcccagccctggctaggagaaagggtgggctgctcacacattcccccttctatagtgcagccccctccctctcaggaggccacccctctccaacaggaaaagctgctacctgcccaactccctgctgaaaaggaaggtgagcgcttgcccaccctccctcacctctatcccactatggatcctgttgacaccaggctgatccctgctccttggtgccctcacccctatcttgcagtgggtccccctctccctcaggaagctgtccccctccaaaaagagctgccctctctccagcaccccaatgaacagaaggaaggtaagcagctccctctcttctttacccacctttacctcatggccttcccccagagcatgggcttcggggcagacaagacggtgggctctgccactcaccagttgtataaccttgggtaagttacatacttctccaagcctttgtttcttcatctgtaaaattgaggatatacctgttttagaaagttatgtgattagatgtgcaaaaatagcatctattttcacttgcttctctgctgagttcttctttgtgcatgtaaactagccaggctttctctgctagagatggccatcccaacatggcttttgcttactccttctacccagtagacccacctcttccatatcaggaggagataatcatccattccatgccgagagagggtgagtgacagctttggtctgtccatcctcctgccttagtgctcaggaccctggggagaggagcaggaagcccgagccttgagaagcaggaggaggtgggggcaggctgtgagctgacacctttcacacctcgcttctcttttcctttcagttattttaaaaggaagagccacaaattgttctttctcatttccactatatcctcccaaccctttctcctccaccccagattctttcaatcctcccagctcatccagcctttgtgggttccttcacatgtccccgcttcccactgttttccccattccaggaacgccagctccatttggggaccagagccatccagaacctgagtcctggaatgcagcccagcactgccaacaggaccggtcccaagggggctggggccaccggctggatggcttcccccctgggcggccttctccagacaatctgaaccaaatctgccttcctaaccgtcagcatgtggtatatggtccctggaacctaccacagtccagctactcccacctcactcgccagggtgagaccctcaatttcctggagattggatattcccgctgctgccactgccgcagccacacaaaccgcctagagtgtgccaaacttgtggtaaggttgggttcttgatgccggggggtgtcctttaaccccagacagtatgtgtgttttaagggttagagcactaggcctgggtctggaggaacctcaggtcccgttcactggccctaccctgggcctccccaatgtgccaggggagcagaggacaaccactgtctcttctttatctgcctgcccagtgtcctttcctggagcctgggaggaaggcaggaatgtggaaagtgggctgatcctcccctcttgctctagtgggaggaagcaatgagccgattctgtgaggccgagttctcggtcaagacccgaccccactggtgctgcacgcggcagggggaggctcggttctcctgcttccaggaggaagctccccagccacactaccagctccgggcctgccccagccatcagcctgatatttcctcgggtcttgagctgcctttccctcctggggtgcccacattggacaatatcaagaacatctgccacctgaggcgcttccgctctgtgccacgcaacctgccagctactgaccccctacaaagggagctgctggcactgatccagctggagagggagttccagcgctgctgccgccaggggaacaatcacacctgtacatggaaggccgtaagtgggcgtcccagcctccctgagagcctgtttgcctgcctgcccatcttcgacctctgatcctgccagtccatccatccatgtaccccccctgctgtgagtgcgtccacccgttcatctgcttgtggctgtccgtccatccattgtgtttgtcacctgagtttgttcatcttgagcttcgtactacacttctggcctcctccactcatgatccacacacgcatctgtctaccatccatccatccgtccagctctggcctcacctgaccttctccatccactgttccagctcatctcccggcaccagcttggaacctcatccaggcttccacccgtccaccttcccaagcccacacatcaacagttgcctcctaaccctctacttttttgccattccctttgggcctctcgggctgggagcccctcatctagttgccagggacgataagggaagtcgatggtcaggagagaaggggccaagtgtccagcttctgacttccctctctctggtccacagtgggaggatacccttgacaaatactgtgaccgggagtatgctgtgaagacccaccaccacttgtgttgccgccaccctcccagccctactcgggatgagtgctttgcccgtcgggctccttaccccaactatgaccgggacatcttgaccattgacatcggtcgagtcacccccaacctcatgggccacctctgtggaaaccaaagagttctcaccaagcagtaagttgcctagtccttccccactctcttcctttcccgaaaacttccttttgggacacctttgggaaaagcaaaatcatgatatcccaaccccatctgatgccagaagatgcccaaagaccctaacccctgcccctttcacaccaacatagtaaacatattcctgggctgatccacaacatgactgcccgctgctgtgacctgccatttccagaacaggcctgctgtgcagaggaggaggtgagtgtgtggagtctagtctccagaggaatgcaggggaggggagggaaagagctagaactgcaggccaccccttctctttagtacctcaaaccagcctttggttataatgactagtgggggaggtgtttttttcttggttccagaaaagtcttcactctgacctggcctgctccccatctctaagttcctattatgccttctccgggccacaagcttctggcatttccagatgtacacatttgtcagtcacaaggaatccagctgtgcaaggcagtcttgtactctctctgggccccaggaggggaacgagggagagagcagtagaagctgatgaaagggggactttggcacccaagtatctacatctgtccttggaccacctccccaccccatcatctgttttacttttctcattcatcagaaattaaccttcatcaatgatctgtgtggtccccgacgtaacatctggcgagaccctgccctctgctgttacctgagtcctggggatgaacaggtcaactgcttcaacatcaattatctgaggaacgtggctctagtgtctggagacactgagaacgccaagggccagggggagcagggctcaactggaggaacaaatatcagctccacctctgagcccaaggaagaatgagtcaccccagagccctagagggtcagatggggggaaccccaccctgccccacccatctgaacactcattacactaaacacctcttggatttgg

SEQ ID NO: 37212 - DNA, 38694 bp, Homo sapiens; identical to SEQ ID NO: 36951

SEQ ID NO: 37213 - DNA, 10746 bp, Homo sapiens
ggcggcggcgcccctcggggaagatggcgccctcggggctgaaggcggtggtgggggaaagtgagtgcctctccggggccgggctctggcgtccggtgtgggacgggggtcggggacgcacgggctctgggatcctgggtttcatggcggctgggagttgggggccgggctgggcgtccgagcacctgaccctcgagggggcgggcggggacgggttcccagctggacgcccctgctctccggtgccagaacagaacaaaattggggggccggactccggggacccaaaggggacgggtagagtgtggcggaggctggggcccggactcctgggcctcctagggtgcctgccgggggaggagggcacagctggatgcccacactctaggatctcttaagccgggcaaagttcaggggctggattcttggggcctcctagggctctggtcagcgaccctaggtgctgtgagcgctcaggggacgtgtccaggccccacaggggtggtgtaggggatgtcttcctccttgccccatttccaggagcgccttgcagctggaggacgcaggcgtccaggcctcaccggccccggttcttgggggaagggtggagggcgcctcttcctccaccccggggagttccggcctcagctgctccttccgccctggccgtcttgataacagtggacatgacacagtggacgtggctgggcggggccaccccgttacttctctccactctctcctctaggcagggcggtctgtagctcaaacccctttaattgggggagattagaaaaaagtgattccattttacagatgaggaaactgagaccggaggtcagtgggatagcctcagctaggcatgcctcagagctgggaaccaggggtcctacattttagaccaggttggggggactggctgaaaccctcacagcaggaatacttgaggtagcaggtggggaagccgagagcctggcgctagaggcagatagagctgtagatgatcccggttctcctcttttcattcacctaaaacatgtttatcgagtggcaccttttgccccagcactctgccacttagacactcaggatgcgtaggtgagttacatgttgcctaagaatctgtttccctgtctgtaaattgggggtgaccccagaagccaatttgcagaactgggggctaaaaataaatgattcctgtgccgtgtctcacacctgtaatcccagcactttgggaggccgaggcaggaggactgcttgaggccaaaagtttgagaccagcttgggcaacatagcgagaccccatctatacagaaataaaaataaattagctgtgggtggtacatgcacctgtagtcccagctactcgggaggctgaggcaagaggatcgctggagcccaggagttggaggccgcagtgagttatgatcacaccactgcactttagcctaggtgacagagtgagatcctcctctcttaaaaaaaaaaaaaaagtaaatgggaattaagatgggggttcagccccaaggctgagaaggcttggggcagtggtgggaccagagaaccagcattctgacccctcccctcccttccctgcagaaattctgagcggagttattcggagtgtcaagaaggatggggagtggaaggtaggggtgaggcagatggctgggtacccagaggcagctcatcatcaggcctatggggaagaccctgaatgtgggacccccaagaactgcctgtccacatgggtggagttgggtgaatgggttctgggtcctcccacccagccagcccttgaaactgcccctcccactgccttggccccttctggggccagctgtggcctcttccgcctgctcctccatccatctgtccatccatctggacaggtgcttatcatggatcacccaagcatgcgcatcttgtcttcctgctgcaaaatgtcagatatcctggctgagggcatcaccagtgagtgaacgcgtccccagtgagatgggacctgagcgtgggaacccctgactgtgcccctctcccagggttcagcccttgagtgtaggatcccctcaaatcgtccagaactcccaagtacgcagctccctgcacggacagcccggatcatgtgaccaaatccattcttaaaccttgcaagctgactgcgggagcccatggattgcaggcctcccctgcagcactccctggctgcagccccttcctgaccgtgcagctccctcgtggagccctgtgtgggactcccagggtggactctggatgtggggtcccaagaatgcagagccttctatgggtgaccccaggtggtgtcccagtcactttgccattgagggataggtgctgagggagcctgtcctctcagaacctcagtctccctgtctgtaaatttggggaacccagttggctgcacaacccctgcagaaccctgtcgtgtggctcttagctggtggtccctaagtgggtttctcctgcagtccctcctaagcatccacccctcctccccaagcctccaaccccccacacctgagactccccacgtggccctgcctggatgccacccacctgtgtcccttcctctgttcctactagttgttgaagacatcaacaaacggcgggaacccattcccagtctggaggccatttatttgctgagccccacggagaaggtgcctacatgagtgagcgtgtgtgtatgcgcgtgcatgcgtgtacatgtgcatgtgtgtgtatgtctgcatgcatgtgattgcatgtgtgcatgtgtatacgtgtgcatgtgtccatgtgtatgtgtgtgcatgtgtgtgcatgtgtgtgtgcatctgtgtatgcatgtgtgtgcgtgtttgcatgtgtgtctatgtatgtgtctgtgtgcatgtgcatgtgtgtgcgtctgtgtgtgcatttgtgtgtatgtgtgtatgcgtgtgtgtctgtgggtctgtgtgtgcatttgtgtctgtgcatgtgtgtatgcgtgtgtatgtatgtgtgtgtgcatctgtgtgcatctgtatgtgtgtgtgtgcgtctgtctgtgtgcatgtgtgtatgcgtgtgtatgtatgtgtctgcgtctgtgtgtgcgtctgtgtgtatctgtgtgtgcatgtgtgtatgcgtgtatatgtatgtgcatctgtgtgcatgtgtctatgtatgtgtgtgcatctgtgtgtgcgtgtgtatgcgtgtgtgtatgcgtctgtgcatgtgtgtatgcgtgtgtgtgcgcatcagtgtctgcatgtgtgtatatgtgtgtatgtatgtgtgcgcgcgcatctgtgtgtgtgcatgtgtgtatgtatgtgtgtgcatctctgtgtgtgcatgtgtgtatgtgtgtgtgcatctgtgtgtgtgtgcatgtgtgcatgcgtgtgtatgtgtgtgtgcgtgcgtgcatctgtgtgtgtgcgcgtgtgcccatgtgggtgcgacactagtgtgcatttgcacatatacatgtccccgtccgtccatgtttgcacatggtggcagatggggggtggctgggaggcctaggcagccaatgagcctaggtgtgcaggctcaggcccagagagtgatccaccttccccagtcggttcaggccctgatcaaagacttccaggggaccccgactttcacctacaaagcggcccatatcttcttcaccgacagtgagtgaggagagcctagggtgttggtgggtggggcaaggaggtgtgggggctgctctggcctgatgccccactcctgcctcaccccagcctgccccgagcccctgttcagtgagctaggccgctctcgtctggcaaaggtggtgaagacgttgaaggagattcaccttgccttcctcccctacgaggcccaggtacggcccgggctcatcctgggcagggggtgggggtttgtgaccaaatgtcccctgttccctcagaaacagacactgaggctgggcgcagtggctcatacctgtaatcccagcgctgtgggaggccagggcaggaggatcacttggggccaggagtttgagaccagcctgggtacagagcaagaccccgtctcttaaaaaaagaaaaagaaagaaattagcttggcgtggtggcgtgcacctgtagtcctagctactcatggggctggggtgggagagtcgcttgagcccgggaggtcgaggctgcagtgagctatgattgcactgctgccctccagcctgggcgacagagcgagatcctgtctcaaaaacatacataaagtaaaattttaaaaaggggaggtacccacagagtccaaggagctcttgccttgagttctatcccactaggcccttgcagggggcagcgtagagcgcaccgcggggttgtccagccagcttaagggacacgggctggggtatttatccactgactcctgcaggcatgggtttagggttgacctgggcctgcctccaattcggcaaagcaggcttcagggaccagggacggctcccaggaggtgcaggtggcggcagcgggaagcggggcaggtgtgcacctgcagcggcaaccctggtgcttctgtcccctcctcgcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagtggggaccccacccagccccaccccgatgccgacccccccttaaccgcgtgcaacacctaacctttaacctctcttgtgaccccagccccggccctaccctggcccctgactctcaccttcaaacccatccttgaccccatcccctgatgatgtcccccgtgtctgacctccccgccaggggcccagaggacacagcccagttggcccacgccgtcctggccaagctgaacgccttcaaggcagacactcccagtctgggcgaggtgagggggcgtgcttgggaggtgaggggcagccccaaccggctcagggtcagtgcctcattcctgccctaaaccccaccccagggcccagagaaaacccgctcccagctgctgataatggaccgggcagctgaccccgtgtccccactactgcatgagctcacgttccaggccatggcgtatgatctgctggacatagagcaggacacatacaggtctgcagacttggaacccgtccccacccttgccactgacctggttccccagtcctcagctcccctgacccccaggctccctccttcctccccaggtatgagaccaccgggctgagcgaggcgcgggagaaggccgtcttgctggacgaggacgatgacttgtgggtggagcttcgccacatgcatatcgcagatgtgtccaagtgcgtgcacacggggaccggatcccccccccaccgcccactgtgggcctggtagcggccttgggatccctggctgctgccaagtctttggccctcatgagcacccctcgtgtgactccagactggcctccaatttcaccccacctctccctgtcccccctgagtgggctcacccatggcctgtggctcctctcccctcactctcacccccgcccaccctcatggccaggaaggtcacggagctcctgaggaccttctgtgagagcaagaggctgaccacggacaaggtaggggcggacccaggtcaccaaaggcgctggtggaaggaagcccccctccccatgggcgcagggccacagcctggatttcgagcctggactgagacccaggtgggcactgcctggcttcgccccccaatccctaccctcttccccctacttccccaggcgaacatcaaagacctatcccagatcctgaaaaagatgccgcagtaccagaaggagctgaataaggtgtgctcgggtgggcagggagcggggacacctcggcccctcaaccccatgctctgtctgcgttctgccttgactcagcctttgttatcccccaacccccaccctgcaccctgcagtattctacgcacctgcatctagcagatgattgtatgaagcacttcaagggctcggtggagaagctgtgtagtgtggagcaggtggggcagggcttgcggggggcaggggtgatggtcctgccaaggcggggtattggggaggggctgaactgtagagatggggggttctgggggaggggcagggcttgtggagaggtggaggggccttggagagaggtgggacctggtggggaaggagtgggtcttgtggagaaacggtcctaggatgagggtgtggcctgtgcataggtggatggggcttggagaggtcagacttgggtgaggggcagagccttggacaggtggtcccaggacaggaatgtggcctattcataggtgggtgggaccttggagaggtaggcagggccttggagaggtgcgacctgggagaggaatggagccttggagaggtgggacctgggtgaggggcagagccttggagaggtgggacctgggagaggaatggagccttggagaggtgggccctgggagaggggcggagccttggagaggtgggacctgggtgaggggcggagccttggagaggtgggacctgggtgaggggtggaaccttggagaggtgggacctggatgaggggtggaaccttggaggggtgggacctgggagaggggtggagccttaagagaggtgggacctgggagaggggcggagccttggagaggtgggacctgagtgaggggtggggccttggagaggtaggagctgggagacaggtagagccatggagaggtgggatctgggtgaggcacggggccttggagaggtgggacctgggtgaggggtggaacctcggagaggtgggacctgggtgaggggtggagccttggagaggtgggacctgggtgaggggtggagccttggagagctgggacctgggtgaggggtggagccttggagaggtgggacttgggtgaggggtggagccttggagaggtgggacctgggtgaggggtggagcctcggagaggtgggacctgggtgaggtgtggaacctcggagaggtgggacctgggtgaggggtggaacctcggagaggtgggacctgggtgaggggtggagcctcggagagctgggacctgggtgaggggtggagccttggagagctgggacctgggtgaggggtggagccttggagaggtagtctcaggatagtggtgtgacctgtgtgtaggtgggtggggcactggaaaggtgggacctgggtgaggagcagggcctgtggagagactgtccctggacaggggtgggaccttgagagacctggtgctgagatgaggtaggacccaaatgtcctcttgccgaggatcctggggatgtccttggcccgcctctcccatccccttccctgacacatagcggccggtggacggctgaccccatgcccgcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgggtgggggctgcagggagttggaacgtccccatttgccagcgtctcccacgatcctgggaactgctgaaccccacagctctccttgggtcatttgcactcaccgggctcaccaacccccacagctacccctctggacccgggaaccctcctccattggcttggggattcctccactgaggtgagggctccctgctaacgtagaaaccctcacatctgtgattcctatagatgtggggctccctcagctcatctggaggagcccctgatctaccccctccaggtttcccactcttgctcacactagcacagggtactgaggccctccccactgcaaggttctctcatcagagtcctgggagctcctcagcccaccccaaactcccctaaacctgggagctcacctggccgccgcctccaccctgcccattcccgtcccccaggtgtgagtgaggagaacctggccaagctgatccagcatgccaatgtacaggcgcacagcagcctcatccgtaacctggagcagctgggaggcactgtcaccaaccccggggtacgccaggagcgggcatggggggaccctgggagagggtgcggatcacagccggggctctgcaaggcagagggccattggtgcacaggcacggtgtggttcctggcgtggtgtggttgctgggaggccaaaagcagtgtttcgggtctggtctggggcccagaggacactggggcctctcccagtcccagcttacacaataggcaggggaagtgagacatggtcgctgccaggctggtcctggcagtggtgcagttgggagcgggtggtctgagtgctagaggcagggagtagggtccccagcatgggggctacaccacattgtctatctgggctcccaggggtctctgagggtcccccgcacccatccagcacccacacacagccatgtgtgtgcttgactcttgggtcagcctctcctgtctctctctggccctgtgcgtccccctccagggtgccctcaccccgtccccatctctcccccatccctcatccatctcgctgtgcactgtttctccatatctctctctctcacccttctctctgccttcccctttctctctgttctctgtcttgctcccctcccctctccgtcccccttctgtccccatcttcctctctctgtttcctgcttcatctcttgtctctctctttgccttcatactttgtctcactgcttcttatctctttgcctatctctgcctctgtctttgtctttctctggctcgctctctctccctttggctttctctctccgtctctctctggctcactgtttctctctctcgctttcttgctgtctctcgctctctctcgctctctgttccacttccccatctttgcctgccatcccccaccctaccagccacaccaggcgcagcccctctgtgaccagcctccttcccctcaatccccctgctgccctccctgccctgcctgtagggctcggggacctccagccggctggagccgagagaacgcatggagcccacctatcagctgtcccgctggaccccggtcatcaaggatgtaatggaggtactgggtggcaggtcagggtgggggccagccctccgcatcggctggcggctcagcctccctcctgctgaggtgctaagcctcagggcttaggggaaaatgctcattgctggcattcccttggcaccgatctgctctgctgaggggggcacgccaagcccgcagctgaggaattggggtgacagcggggcctgtgctggggagcctcacttcctccccacctgccggctgcctccgctatatctctctagtctgttcccctgtcccgcaggagtgcccctgagccccagccctggccttcccaggatcccagggcagcaccatccaatggcaatgggcctggggcggcttcctggcttcctccttgtccctctaagagccccggcccctctttctgcgtgggggccagagacctgggcctcctcatccccatggaccttgaatacctggacttctggggctctgaggggctgagagcccagacactgggttccccaaagggctgggggtattgactgatggtccccaagggcctggaggcccagactactgggttgccgaggaactgtgggtttagacttctgggtacccaaggagttatggaattagattcgtgggtccccagtgagttatggatctagatttctaggtccccaatggactagaggcctagactcctgggtcccccagaggcaggaggtggagatgctggttcctgtctgccaggatcttggcccctgaataccccgtggggggcactcctgaccccggaccccatgcctggggttcctcccctaacctgcctctcggccgccaggacgccgtggaggaccggctggacaggaacctgtggcccttcgtatccgaccccgcccccacggccagctcccaggccgctgtcaggtgaggccccggggccgcccccgcccacgcctgggtctgtgttaggtgggcggcctggcggcggtgagggcctcctgcctggactttctgcccctgccctgcacagtgcccgcttcggtcactggcacaagaacaaggctggcatagaagcccgggcgggcccccggctcatcgtgtatgtcatgggcggtgtggccatgtcagagatgagggccgcctacgaggtgaccagggccaccgagggcaagtgggaggtgctcattggtaagtcaccaggactgggaccctggggtctggggcttgggttcccggggcctgggcttgtaccttctaggtgtctggactccagagtccttggagtcagggacctggtttgctgagggacagggacagccccacaccagccgggaccgggagcctgtcaaagacgaaggcagcgccccccaacatcttccccaaacctctgcccctgcacaggctcctcacacatcctcaccccgacccgcttcctggatgacctgaaggcactggacaagaagctggaggacattgccctgccctgacccctggccccgccccctacccctccctttccagagaaataaactcttcccgtcgctctgcc

SEQ ID NO: 37214 - DNA, 53842 bp, Homo sapiens
ctgggcgggtcatgcgccctggccttcgcgcatctcccaggttagctgcgtgtccgggtgctaggctgcagacccgccgccatgacgctgcgcgcggccgtcttcgaccttgacggggtgctggcgctgccagcggtgttcggcgtcctcggccgcacggaggaggccctggcgctgcccaggtaagggggcccagcgccgccgccgcagtgggtcggggcctcaggaggcagaccgcgctgggcttgcagcccagctttcagattgctcctgtgccggagccctgcgaatcatgcgaatcatgaaactgaagacctggccctgaagtcccagtgcatatgaggagatccgttgtctttctaaatgttcataattaaacgttgccaaggtctccaaaattgctttctgtgaacttttccaaaagggagaggagttactcatggagctttgtgcttctgctgcctcctgtctaatggggtggcgcttaaagatgcgagccgagattcaggagagaagaaagttctctccccaggtgtgggttgcatgcttacttgtgtaatagcaaactgcagcaaccgcccaaagccacatcactgggaaatggtagatggggtgtgcagagtgagagctcagggacttgggaaaacacctgttctactacatgaaaaaaccaccccaccagaatctgaagctatttatacaatatggtttcagctatggaaaaaaggtacatgcagaaaagtgcctgaaagaaataggccaaagtacatcaaatgagattaggaataatgtaatgattttctttctctctctcttttttttgtgttttttttttttgtagtttccaacttctaaatttataaacaatgtattattcccacattcagaaaggagagaagtatacttatttataaagtgaaaaagaaggccaggcatggaagccattgttcatatcctccttttacatatgaggaaactgaggcacagaaagaaaccagctgtccaaatcacatagctgttaaagagcagagccagaaatccaaccccagtagtccatgtccggagcctttgcttttaatatagtaaggaagatgagatggcaagtagcttgagggaaaggcatgtaatctctgtgctttgggaagctaaggtgggaggatcacttgaggctgagagttcaagaccagcctgggtgaaagagcaagaccctgtctctccaaaaataaaaataaaattagctagacattagtgcatgcatgtagccccagctacttgggaggctaaggcagaaggattgcctgagcccaggagttggaggctatagttgtgtccagagttggttcctgtcggtgggttcgtggtcttgctgacttcaagaatggagctgtggaccttcgcagtgagtgttacactcgtaaagatggcgcagacccaaagagtgagtgatagcaaggtttatcgtgaacagcgaaagcacaaagcttccacagcatggaaggggaccccagcaggttgccgctactggctggggtggccagcttttattcccttattgtcctctcccatgttccatttctgtcctatcagagtgcccttttttcaatcctccccgtgattggctacttttagaatgctgctgattgtgcgttttacagagcgctgattggtgcattttacaattctcttgtaagacaggaaagttccccaagtccccactcgacctaggaagtccagctggcctcacctctcaatcctccctcataacaggacaccccacctgctactgggaactgggtgatgaccactctagctacttcctgctggataggggcaaagaaggggccctgccgttgtagtgtcctccagaggggaactctctaggccagtcaaagggccagtgggtcagtctagcagtcctcggtagaagttgtgagttaagctcatttggggttccatttgtaagaccatctgtagcttgatggccttgatcctggaggaaacaaatttgaggaggaggttaaaaatacagggactgaaggtgagtaatagcaagatggctgtcacgggacctagaaaggggagaagccaagtcacccaactccagaggttggtataagaatttgaaaggtgttgtctggtttcagaagccttttcctgtaaatgccaggcagcatcctgtactatccctgactggttagtttaaaaacaacactcctcccctaagaaggtgcaaagtcctcctttctcagcagtgaggaggtctagaccttagcggttttggagagtcactgttgccaaatagtctatttgggattgtagagtaaggatagatttatttattgcaaactgtctgagaaatcctttgagagtgtatggtagtaggataatgaagtagttaaactggctattctggttcctgtagcagtgggcattcctagccctataagtaggggtattagttgtatggtcctgggctgacagacttgagctttgaggggcactgatagggtctgatttcctgtggcattgttagtgttgggacttaggagaaggtgcaggtgcctgtccagctggtgggaggcagatataggttgaagttccacataagaagaatatgccttggctgggtagaataaactggttgtgtatgttaaaaaggtgtgtgagtttgttttcattttcccacactcctagagtacttgccaaggtagctctggtgagcagctggaaagggtgttgggagcagactgagtggctccctgtgctctattttcccattggagaaaaaaccgttttgtatctactaggaaccatccaagagagtaattgaaagaggggataagaagacatacactagtggtgggggcgctgctgcagggggtccaggggtgaatggtcatgcagggagtatgtttgccattacaaaacccagactgtttgttaaacagggaggaggtgatgattttggggggccctgagaagcagacaagccatctgaatggaggtgtttgggtgactcaggagttactatgatcagttggggcttgaagttatagggtgtaattacactgatgggatagtaggtgccccaggggcaggcctgataacaggttgtgttggatgcataaaagggcttggaaagttaagatggtattcggtattcgtggtcacaaggtcttgtatgggcttttcctgaggattgtggcctccaggcacagtgaaggtgatattgtatctctagtgccctggaaactccctgagttaccatggctttaaaagccagaccattgtcactttgtaagctttggggaagcccaaatctaggaattacttcatgaattaggactttaaccacttcttgagccttctctgtcttgcaggacaaggcttcatccaatttgcaaaggtatcaacacagaccaacaagtattgaaatccccttgacttaggcatatgggcgaagtctaactgccagtcttctcctagatagtgccctattctttgttcccccagaggggccttatgatggaccaagggattattcctttggcacacctcacaggctttgactacttgttggatggtctgaaggagatttggccctgtaaatagggatttggccatttgatgagtgttctcaatacccatatgaaaagtttggtggagggtcttaagtattttccactggctggcttcgggcatgagtacctttccctcttctgttgttaaccacctggaggggagaaaactatgcccccatgaaagtcctcattctgtttcggttggggaatactggggcttaatctcttggagagggttgttccataccaagggtccttccgtaggtatttctaatgggaggttccacctggcagcaattttggcctcagtgtctgcctaatggttttcttctgccttttctccttcaccttttgatggctttggcagtgtaagactgccacctctttgggtttttgcactgcgtgcaataactccatgatttccttgtggtatttaatgggggttcccctggaggttaggaaccccctttccatattgcagcattgggcatgtaggattagataagcatacttgttatctgtatacacatttatttttttttctttcccagttctaaggctcaggtaagcaccactagttctgctaactgggtgcaggtccctggggaaagaggcttactttcaagtactgttacatcactaactatggtataacctgcccttcatatcccattctccacaaatgaacttccattggtatataggttaaggtcaggattagctaaggggacttctaagagatcatctcgggcagcataagtctgggctacaatttgttggcattcatgctcgattggttccccatcctctgagagaaaagtggcagggttcagggccacacacaagcgcctggtatctaagcaggcagttgtctgacagccataaatttcctttggcacctagtatgccatttacatcattagtagtccagacagtgagatcctttctttgtattattttgatagcctccgatactaagatggccactgctgcaactacccataaacagtaaggccagccttttgccactacatcagtttccttacttaggtatgccactggttgtggggttgtcccacgagtctgagtaaggactccaagagctattcctgctctctctgtgatgtataaagagaagtcttgtcctttgggaaggcttaaagctggagcttgtactagggcctgctttaaggttttggaggctgtttctgcctctggttcccattctactagattagtgtttgccctctgggtctccttgattagagcatagagtggcctggccatctcgctgtatctggggatccatagtcggcaaaagctggtgatcccaaggaacccccacaactgttttaatgtcttagggcaaggacaagccagtataggctgtattcattctttgcttagagccctggttcctctggctaagattaggcctagatatttgacttgtaggcagagctgggccttcagtttagatgccatgtacccttgattagctagaaagttcaagagagctagagtagcctgctggcatgaggcttttgaactggtaaccataagtaaatcatccacatactgaaggaccagagtgcctgtacttgagaagtggcctagatcttgggccagtgcctgaccaaacagatgaaggctatccctaaacccttgaggcaagaccatccacgaaagttgggacgtgtggtctgtgggatcctcaaaggcaaagagaaccttggagtcagagtgcaggagaatgcagaggaaggcatccttgaggtccagaacaatgaaccattctgcttcctctggtatttgagagagcagggtataggggttgggtatagctggatatagaggaattactgcctcactgatgagtctaaaatcttgtactagtctccactgaacgttcggtttttgtactcctggaattggggtgttgcagggactgctgcattttcttactaagccttgaacttttaaatgtctaaaaatatcatgtaatcctttatgagcttcaggccttaagggatattgcctttgataaggaaaagtggtggggtctttaacctgatttggactgggcaggcattttttgcccttccgaattgtcctttcaatgcccagacttcagggttgattccctcctcaagtaggggacaacaaatgggtaacttgttccccatatttatagagataatatctctagctttggctaatatgtccctccctaataagggtgtggaactttcaggcacaacaagaaaggtgtgtgaaaagagcaaagtctcccaattacaactgagaaggtgggaaaaatagctggttacaggctgtcccaggattccttggatggtaacagaccttgaggacagccatctggggtaggagattaacactgagaagtctgcaccagtgtccaggaggaagtcaatttcctggccctcaatggttaaacttacctggggctcagtcagggtgatgacatgagctgtcacttgccctgggcaccctcagtcctgttgttggatcatccggttgggggcttctggcccagagaacctttgtcctctggggcagtgtgccttccagtgattgccttggcatagtggacatgggtgagggggcagcttgtttcttgttggacaatcttttttaaagtgtccttgcaaagcacactgataacaagccctactgggtgattggcctgctctgttttctgtcttctctgaaccaccaaggtttgtttgtgtgagggacatgactaaggctgcggcctttctcttatctcacttttcctttttggcctgttcctcttggtccctattgtagaacaccaaggttgccaggtttaattatgcctccaaattttgttcagggcccagggatagcttttggagctttttcctgatatctgcggctgattgggtaataaacttatcttttagaatcaattgaccctcgagggagtcaggtgacaggggagtatattttcttaaggcctcctgtagccgctcaaggaaggcagtaggattttctaccttttcctgagttatggtggacatcattgaataattcatgggctttttcctaattctccttagtccttctggaagacaggtcaacggatgtttgcgactccagtccccatgatctgagtctaggtcccagtggagatccatactggggacggcttgttgaccggtagggatttgtccctttctttggctgtcattctgtcatttacttgactaagataccatttacttgactaagataccaaactctcaggctgcagctaaagccgcattcttttcattaaagggcagggtttgatctaacaatagcatgacatctctctaagtgaggtcgaaggtttgccctagaccctgtaggacatctatatacctatcagtatcatctgaaaacttccccaggtctaccttgatctgctttaaatcagagagggagaaggggatatatacccaggttgggccaaattcccctccccctacagcttgaaggggacataaccgatagcccgggggttttatggtcccttggagatttctttgcttgtttccttctgagtgggggagattagaggaggcttatcattaacaggaagaggagctggagctaggctaggatatggaggtaagctcatgtttccaataccaagaatgttcttgttgtatcaagttgcttttttttttaatgaccacctgcccttgttttatagattcagtggtatcttcttcctgtatagttatattctttccctagttcctcttcttttatcatctcccattctctaagaagaagaaataattttcccctgttttcccactcacctagtgtcttgtagttatttgtttataccttgcctcccttgttcttctgtgagcttcctatgaatagcatcatatttttccacttttgcatcacagcacatagcacaatgcctcacatacctaagatgctcaataggattgttaagttgaatattgcattgcttcttaatactgaggagcagatactgaaagggaccaggagtcttttggaggaggtggaaatgttctaaaattggaatgtggtgatgcttacacaactgtaaatttactgcaaatcattgaattgtcatactacatgaatttaatgctatgtaattgtcttagtccattttctgttgcttacaacaggatatctgaaactgggtaatttataaagaaaaggaatttatttcttgcagttatggaggctgataattccaaggttgaggggttgcatctggtgagggcatttttgctggtagggactctctgcagagtctcaaggtagcacagggcatcatatggtgagggggctcagtgtgctagctcaggcctcacttccacttcttataaagccactagtcccaatcccatgataacccattaactcattaacccattagcctatggatgaattaatccatccatgaaggtggagccctcatgacccaatcacttcttaaaggcccacctctcaattttaatttaatgccacaatggggattaaatttcaacatgagcttcagaggagacaaacgttcaaaccatagcagtaattataccttaacaaagctgtttaaaaaaccaacaactgttggcaaaggtatgggaaaaccattgctgacattgaaaagttgagcaaggccacagatattaggtatatgtctccatatagttggtccagagctgaccactgttacctgcaagagggtgtctgataaaaggtatacttgactattatcagaaataaagctcccaggatggggatatttgttctgttactcagggctggtaattttaactggcttgccacttcaactggaattcatctgggattggcaagccagttaaaattactttccagacctgagtaatagaacaaatgcattcgtacacataaatacatttgttctgttactcagtgtatttatttactgaggctgctgtaacagcaaacagagactggatggcaacaatggaaatgttttctctcacagctctggaggctggaagtccaagatcaagatgtcagcagggttggttccttctgaggcctctctccttggcttgttaacagtgttctccctgtgtcctcacatggttgactctctgtgtgtgtctgtgtcctaatcgccttataagggcaccagtcctattgttggattagagcccacctgtatgatcttatttaactcaattacctcttaaagacccactctccaaatacagtcacatcctgaggtattggaagttagaacttcaatgtatgtatttgggatgggggtatacaacccagccttaacacagtgatatggtttgaatttgtgtccccacccaaatctcctgtccagttgtaatccctaatgttggaggagggggttggtgggaggtgattggatcatgggggtggatttcctccttgctgttctcgtgatgttgagtgagttctcatgagatctagttgtttataaaagtgtgtagcacttacctcttctctctcttcctcctgctccaaccatgtaacacgtgccttgcttccccttcaccctccgccatgattgtgagttccctgaggcctccccagctatgcttcctctacagcctgcagaaccatgagccaattaaatctcttttctttataaattacccgatctgaggtacgtctttatagcagtgtgagaacagactaatacaggaaactttttaaaggttagaagatgacattaagataaaatagaaactagagaggcagaatcgaaaccacaaaaaacatattccattctttttgaagaaggtgaactcatgaaaaagttctttgagaccatgcctggtgcacacgaggacagtaatggccgcgtgcccactctcggttctgaccgttatatagtaaagtaggaagcgcctctgggtgaagctgctattaggtggtttcccatgggcagcttctctgtggaacatactgtgatttactgtatggtctcatgtcctcagctggatggctccttgcgcgcaaagatcccaatttgaactgcgtttgcattttccagttcctggcagtatccctttctagtggctgcttctcaatgaatatgaacagtgtctgtttccatgtgctgccatgacaaaatccacagaatgttcctgatgttctttgtgttttccagaggacttctgaatgatgctttccagaaagggggaccagagggtgccactacccggcttatgaaaggagagatcacactttcccaggtgaggggacatcaccacacagagccctttggatgaacgttctctgcctgtgtgcccatctccccgaacttggggcccaccataatagaaaacacccaccttttctgtgaagacaaatgttgttttaatggtattaatgggagtattgcagtcaccttaaaacatacttgctaatatattgtggcaaatggtgaacgaaaactgtgatgaaactattgggaagaacattattgaattattgactttttatttaatccataaaaaaacctcagtaatattgttggaaggtaagaaagagggaaatgctatatattttcttcttcttcttcttcttcttcttcttcttcttcttcttcttcttcttcttcttcttcttcttcttctttcttctttcttctttcttctttttctgagacaggttctcactctattgcctaggctggagtgcagtggcatgatcatggctcactgcagcctttacctcctgggctcagatgatcctcccacctcagcctcccaagtagctgggattacaggcacacatcaccatgcccagctgttttttgtattattattattattgctagaaatggggtttcaccgtgttacccagactggtctagaactcctgggttcaaatgatacacccaccttggtgttccaaagtgctaggattacaggtatgagccaccatgcccagcctatattttcaatgaacatacagaatttagagtgaatttctagtaattgctatgaaaatcctgcgtttcattcagactcctttggtggcttctgatagtctgtgtgtaacttctaggaaactggcatggctagagggaagaagcctggaaaactaaattatatcatgctaaggctatttacacttgacttgtcttaaaaaaaaaagtcttatcttgggagtgaatgtcatcttttaacttttcatgtgtatatactatacagacagaaaagtacacatagcatacagcttgatgacttttcacacactaagtatactgctgtcaccagcacccagatcaagaaataaaacattctcagcgctgtaggcaacacataaccccgctctggataccatccctccaagagtattaccattctaacttctatcccaatagatcacttttacctgttttggactttatgtaaatggaattgtgcacatcagctcttttgcgtctggcatcttttgctcaacattgtatgagtgagactcatcgttgttgcatgctgccatagatcattttattctcattgctgcatgacattccatcacattcatataccccaatctatccattcttctattgatggggttctgggtagttttcagtttgggactattacaaatagtgctgctatgatgatgtgtatatataacaatccattctgctattagtgagtgtattagtttgctagggctgtgtcttacatagcaccttcagctgctacctacagcaaatatgccatagactgtgtgactgaaacaacagacatttatagctcacagttctggaggctgggaagtccaagatgaaggcactggcaggttcagtgtctggtgagggctctcttcttggtttgcagatggccaccttcttgctgtatcctcacatggtagaaagcagagagacaggggaaaaaaagcaagttcttggctgtcttctccctgtgtcctcacatggtcatccctgtgtgtgtctatgtcctcatctcctcttcttatttgggcaccagtcatattggattaagattcgtcataatgacttcattttaccttaagtacctctttaaaggcctgatttccaaatatagtcacatcatgagactctgggggctaggacttcaacacaggaattttggggaggacacagtttagcccataacagtggacatttgggtagttccagtttggggcttgctatggtccaagtgtttgtgccccccgcccaaaatccctatgttgaaatcctaacccccaaggtgatgttattaagaggtggggccttcaggaagtaattgggtcatgagggtggaaccctcaggagtgagatcagtgcacttataaaagagatcccagagagctatcgagccccttctaccatgtgaagacagcaagaaggtgccatctgtgaaatagaaggcaagccctaaccagacaccaaatctgctggagccttgatcttggacttcccagccttcagcactgtaagaaataaatttctgctgtttatgagccacccagcctctggtcttttgttatagcagctgagatgggctaagacagggctcttaggaatagcactgctatgactgtgggtgaatataatacaatctatccattctgctgttagtgggcatttgggtcgtttctggtttgggactcctaggaagagtatagctatgaacatttttggccatgtctcttggagaacatatgttggcatttccagtgggtatgtgtccaggagtggaattgcttggtcacagggaatgtatatgtttagatttagtagaccctgccagagcttttctgagtggccatacaaattgtcccctcacttcactttgacagtggataccactcatggaagaaaactgcaggaagtgctccgagaccgctaaagtctgcctccccaagaatttctccataaaagaaatctttgacaaggcgatttcagccagaaagatcaaccgccccatgctccaggcagctctcatgctcaggaagaaaggtaaggatctgatactggccaatctcaggccgaaccacccagaaccctcgggagcattaggtcagaatccattgaagtgagctttgagatcacagatcttctgagccacgatggaaagcctctttaaacatggccccaaagcaagttttatccaatggcaaaagcagcactattagaaaagctggaaaaatggcaggattttacttaataaagcaattgatgcccatgactgccttgtgaacatcattctccccttcaatggcactttagtaatgacccaaatgacatgatcttttgtcacagtgattaagaaacaaggcctttttagcaactgtgattttcttagcctctgggtatcagagtgtccaagctatgagttggctgacatgggctcagattatgtcacatagtctaagacatgaggtcaagttcatccataggcgttgacttggtgtgaacacctgactcttgtcataggcatattgaaactattccaccctcttatcagtagacttacctggttgtggctgagccatcccatgtctgcaactcttccctcctattgcgtgggaagagtctcaccatcaactcttcagtgtcttctttccagcattgcctagttctcaccctcgctggttaggcagataaagccaggggataatcctatttctatgtacacttctctagttttgaaatagaaacctagtccctgattgccaaggcaggtattctggaatttagtcaagcagtgttttcagtagcatggactagaaagaatgctggaccttcaccatgtggctctgggcagctcgtaacttgtctgagcttgtttgctgatctgtgaatctgggagggtaggattggccctgtccacccctgaggtggtagagatcaaaatgagctgatgaatgtataagtgctgctccactgttgtcaaggaggaaggagggtagtttctccatctaggcttctgagggccttgaatgaacccagctcatgcttgtgtctgtgtcagaggtgttcatgggtcaagatgattcttttccaatttgtcagttgaaagttgggcataagagattaataaaagtgagcacaacctgcttggcccatcattggagtcccttgggggtatctggagcatttcagggcaaaggtctgtagctggtctatctactggtggctttttgctcaggattcactactgccatcctcaccaacacctggctggacgaccgtgctgagagagatggcctggcccagctgatgtgtgagctgaagatgcactttgacttcctgatagagtcgtgtcaggtgggaatggtcaaacctgaacctcagatctacaagtttctgctggacaccctgaaggccagccccagtgaggtacggagacacttccttatggcagagaaggatgttcagagatattgcaaccagggaaaaactgaggagtgagcaggtgggatgcatcttgggcctggcaggacagctctgagtccacttctcccagaccacgtcttctcctagaagactgttacccattctttgatctagaaagttctcccagaggtgggcatttggctccattgtatagctcttacagaactttggtcaaaacaggcatcagcaaaagctgttttagcccagctgcctcagtttacttacaaagaaatggagatcctgggagacttgcaaggccacaagactagtagtcaggttcatccccacaaagggtgagtgaggacaggctccggtattgccatgctctcccaccagacaccctgtgccctgagcctgtctccagagatcacctgtcctaaagctcttttctctttgtgtgtctctactttaatctacaaaaggtgattgaatggagattaaattcctttccctcacatttccaaccccccacctccccacaagctgaccagagcaaaccctgaactctagccttggagtcctcaccatgctgcatcctgggacctcccctttcacctcctggactttgcttcttctcttctcagtgcctggagtcagcctcagagcagggctcccaatctaagcctgcacaggaatatatcagtcttcctatcgatggcttccaggttggatgagctgcttagaattctagacttcccttgtccaagatggtaaatgcatgcacccatgctttctatgacttccaggatttttcttctctttttatttatttattgtttaactaattaatttattttttcttagagacagagcctcactctgtcacctaggctagagtgcagtgaagcgatcatagctcactgcagcctcaaactcctgagctcaagtgatcgtcctgcctcagcctcccaagtagctatgaccacaggttcataccaccatgcatggctaattttttacattctgttgtaacgggggtctcactatattgttcatgctaatcttgaactcctggtttcaaccaatccttccagtctcccaaagtgctgggattacaggtgtgagccatcaagcctagcactttctttattactacatataaatttttgattcattaagaatctatttgggggtaagatataaagtaaggatccattttattcccccaaacagttaaccagtcataccaaggccattaaacaatcttccttaccaattggacatgacacttttcttagaaactaaattcttatttgtatttggttctatttcatagacatgtctgtttcttttctagtgccaaatttctaccttttgtagcttcatcaattgtttgactctctgccctcactacagttcttttccagatacattttttggtctacttatgcctgttgattttcccagaagaattttaatgtcaccttgataagtgtgtatcctctcctaaccctcttgcaatttcagaagtggctgaagccagtaggtctgtgtggggtcatatgtgcctttgttttcatgcgtatgttgtgtaattaaatgctttccattttagcagtagatggttataaaagaaaaagagtttttaatctcctcatcataaaatagcccctgtttgcattctggtgagtttctttctgagattctcccatgctgttttgggctcaggtcgtttttttggatgacatcggggctaatctgaagccagcccgtgacttgggaatggtcaccatcctggtccaggacactgacacggccctgaaagaactggagaaagtgaccggaatccaggtaacttgacttctgagcgagccaagcttcctggactcatctgtggtttctggactcaggagaaaaccacgagcagagaagctgctgtccgtggagtccatgaatgactcctgggcaccgctggttgggagtccatcacccactgtgcagtcagcacgatgtccctaaggagcatcttgcctctttctctgcagtcagtgaacagggagacaagaatttatactagtgttagtgccagggccggggaactggcagcaagagtgggatgttcaaggtcatcctgacctcacttttgagagtaagtatggagaacgtttaccctaaggatcagggcccctacctggcatgtcgagcatgccgctggcactcaggtgcagccctttagttccacccagctcagagggaagcctcttaagaaaagcctgtccgtccctgaggtggttgggacagccatcatgatgtccctggggttgcctggggattagcctgctcctccagttctgaggcacctttcttttttggggttgacctgagatcgctgatctcactgagtccacagccttctgcagaagtgcagcaccctcatcctgtgagcacaggggagaagaggcaggagaaagctggcactcagctgaggctgccacatgtccaaggatgcacagccattgcctcaaagggaagtaggttagtttgctcgggctgccataacaaagtactacaggctgtgtggcttcaacaacagacatgtattttctcactgttctggaggctggaagtccaagatcaaggtgccagcagggttggtttctccagaagcctctctccttggcttgaagacagccactttctccctatttcctcacttggtttttccctgtgtctttctgcttcctaacttcctccttttatgaggatacccgtcagattgcactaggtcccaccctaatgacgtcctttaaccttagttacctctgtaaaggcctaatctccgaatacagtcacattctaaagtattgggggctaaggctgggtgcagtggctcactcctgtaatcacagccctttgggaggccaaggtgggcggatcggttgatgtcaggagttcgagaccaacctggccaacatggctacaaccccgtctctactaaaaatataaaaacttagccaagcatagtggtgggcacctgtaatcccagctgctcgggaagctgaggcacgagaatagcttgaacccaggaggtggaggttgcaatgattcaagatcgtgctactgcatttcaacctggacaacaagagcgagactctgtctccaaaaacaaacaaacaaaaaagtattggcactaagactttaacgtgaattttgagagtgatacagtttagcccatgacaagactgatttttttgtctttagtgaataaattaaaatgtatacccagtgactccataaccttaaagcatcttgcccaagctttgttcatttgtccttctacaaacctgcaagtcccaggcaacagagaagaaagcacatcagacttgggctcagggaacccatgtgcttgtgcccctggctaggtctgtcccctcagcatacctgagccacagatacctgtcctgtgaaactgggaaagtaaaaactatatctcacttctctttgtctcaggggtaggaggaagaggaagatagaaggaaaaatgaacatcatcccccttgtatttttttcattgtggaaaaatgcatgtaacgtaaaatttgccatctttgtgtgtgtgtgtgcgcgcacgcacgtgtgtgtgtggacagttcagtgatgttaagaaaatgtacactgtcgtgcagtcatcaccaccactcacctccagaactttttcatctccctcacatgaaactctggaccatcaaacaccaactttccattcaatggcatgccctggcccctggcaacccccatcctgctttttttttttttttttttttttttttgctagggctgtgtcttatatagcaccttcagctgctacctacagcagacgtgctgtagactgtgtgtcctggcccctggcaacccccatcctgcttttttctctatgaattggactcctctagggacctaatgtaagtggaatcacaatatttgtctttttgtaactggcttatttcacttagcataatgtctccaaggttcacccatgttgcagcgtgggtctgagtttccttcctttttgggatagaatactaactattccactgtatggatagatcacattgggtttatccactgagctatccaaggacgcctgagttgcttttgccttttggctattgggaatagtgctgctatgaatgtgagtgtgcatgtatctctttgagaccctgttttcaatgcttctgtgtgtatacctacgagtggaattactggatcatatggaaattctgtttttcttttcttttatttattattatttcttttttcagacagagtctcactctgttggccaggctggagtgcagtggcacaatattggctcactgcaacctctgcctcccaggatcaagcgatttctggctaatttttgtatttttagtagagacaggattcccccatgttgatcaggctggtctaagtgatccacctgcctcggcctcccaaagtgcgaggtttacaggcgtgagccaccgtgcctggccaaaattctatttttaaatgtttgaggaaatgctgtgctgtttttcacagcagttatacccttttatatccccacagaaaaatcaccccttcttaaacaggggagcctgcgtctgtttctcagaggaaggcagtgggcgtcagtcatgaacagcctttgtaaattgcacaaacatataagatgattattaaagtaggaaccccccacttttcccacccccaaaagcaagggcatcccctggtgtatgacctaggaaactgaggacacatggcaggagggaccctaaggggcaccggccctgctcacaggccttggctcccgcccgaccatgggctcatggccatcaggagacagcagcctgccctcccccatcacactgagtccctccctgcccctgtcttctccagatgccatggagatgggaggactcacctcctgtgtccccctctgcagagtcttccatagttataaaggaggtagatttcttagcttacgtccccattttagaggtcacaaaactgagtcactgaggagaatgaatttttcgttgggttacgcctttaggactaaaagtgaccaatccagcagtaggattcacagcgtgtccagcagcagagttcaggcataaggctatattcacatacgtgtcctcagtagtgggctccttgtcatttctgcctcagggaaactgattccagtaaggtacaaaagccaccataaggactccttgttcaggaatttcctatttactgagatgggttagtctaagccctcacggactcctgagaacaggcctggcacctgccggtggaaggctattaggggctagactgtgtcccccaaaattaatacagtgaagtcctaacctctaatacctcaggatgtgactgggtctgaagaaagggcgttcaaggaggtaatgaagttaaaatcaggtcacaaggctgagccctaatctcatctgactggtctctttagaagaaggagagattaagcacaggagccgtggctcactcctgtaatcccagcactttgggaggccaaggtgggaggatcacttgaggccaggagttcgaggccagcctgggcaacatagtaagatcctgtctttaaaaaaaaaaaatagctggccgtggtagtgcacacctatagtcccagctacttaggaggctgaggtgggaggatcccttgagccaaggaggtcaaggctgcagtgagctgtgatcacatcactgcatgtcagcctggatgacagagcagagacccccaaaaaagggagaagaggcagagattaggacacacacagagaggtacccagggcatgaggacacaagggaaagaccatgtgaagacactaggagaagatggccatctgcaagccagggagagaggcctcaggagaaaccagccccaccagcaccttgactttggacttccagcctccagaactgtgaggaaataaatatctgttcttgaaaccacataaactggtattttgtcatggcagccacagcaaactaatacaaaggcccagagagtttgattttggccgacttgaaggagagacctttcagcagagctgtgctggagtgactgctgtgtgagcttcgcatggtgtcccacatgagcctgggcgaccatcggaggagctgccacagaagcaaataatattaattaaagtccaaattctctcgcttagagcaagtgatttttgcttcttgcttatatggagttcagtggccagtggccaggggcttcgcctcatgcagtcattcagggactcaggatgatggaggatgcactgtcttctacctgtggtttttgaggtcacactggacacccagctggaagatggggagttgaggaatgtagagaatcatttgggggttttaatgtgccaggtaggaggctgcactcttccatctgcatccattggccagaactcagtcttggggctccactcaactggaaggcaggagggagaatggagtctggctgtgctggcaggagagggagatgggctggtcagccaccaggagggctcaggatggagtggaaaaggtgatttccaaggcctcccctggcaccagtattcaggagagcctctcacggaaggaggctgctgctgtctctctcactatacctttcctgcttacagcttctcaataccccggcccctctgccgacctcttgcaatccaagtgacatgagccatgggtacgtgacagtaaaggtgagtcagttttgtctctcagtcggctaagtgctctcccaccaggtcacctaaaacgaccagcagagacacccaagaggctgagctgtgaggatcacctgaacctgagcctgggaagtggaggttgcagtgagctgtgatcacaccactgtgctccagcctgggcaacggagtgaaaccctgtctcaagaaaaaaaaaaaaaaaaaaggaccagcagtgacatttgttaaatatcgagggtggttgaacatccactatttataaggaaatgttatttcccacaaatctcattcctcagaaatcagtgaaagacagaccctgtctcggattctataaagcagtgtgactgatgtggccaaacccccatagaacagcaggctagggagcttgggcagcctgggaggctaaagcatgcacacagctggcctgtgttggaggagagcatgttttcattcaacaggcatttatcgaacacttcctctgtgtcaggcacaggccagatacaaggggtgcagtgacgatcaagacagacctgtcctcaaggagcccacattgagggcaaagagagggaaaggtcattaaaatgttctttttgttttaaagggttatcataaagccaaggccacacacagagggccctggctcgtggcctggctgagacatctaacttggcttgctgacacagagcaggggtttagtacgtcctcatggattcactttgggatctttcctcatttgtcattggcctcatttaaatatgaaaggatctaaagcagtgggtccactcatcagcaaaaaaggccagacagctactgtgcaggcagataaacccagctggaatcttggttttgccacttaactgacattgcagccttggacaagcatcttatcccggtgagcatcagtatccacaacttcataatgaaatgacaataatatctctccatgccatttctgtgagaattaaatgaaatgttgtatgcagaccatggggcatagtatccaacagccacgtactccataaacagcagctgacaaacaggagaactggaggctatggctgtgctgaccttggagaccttggggacccttgctgtcctggaggagaaccttcagagagaaattctgagatgaatggagggtcttccatggtcccagggattttacactcacaacctcggtggtttggttacagcaaggatgaggtgcctgctcagaatgggatctgtgctcagaatgggttctgccagggtggaggcagccaccacaaatgtaaagtgggcatccaggcacgagtgggtttgcatagtaagaaaaggcttttctgggacttaaagctactgctcagcgccactgacatcccttctataactctgggttctcctgaaggggtgagtgtttaatcagggccttctggtctcatctctctggtggtaaagaggagtgaggggcttttcgcccagggctgggggctggattgtaaccgtggacagggttattctcataattcccttagggtttgcatatccagccagtttcaagagattatttatttgaccttgaaggagtgtgatcagaatcactttaccccaccttgtctttcccccaccccatatttaagagctggcagtgaatttctggggagtcccagctgcgccaggctctcagggggctgttgtattgattgccactgaatcctaaactgggttgataatagatctttctgtgttctggctttatggacatttttcttaacacagaaaaaaaatgagatgggaaaggacatgcgtttgctgggctactcagctgagtcaatatgaagctgtgagcctcagtatccacagcttcatgatgagatgataaagctcaagagtgagctgtttagttgggatctgtgctagaacacaggcgaactaggatcgtttttgatcagacataagtgtgaaacatttctcagtgtaaggtagatcaaatttaatgtcaacttttgccaagtgctgaaggaaagactatggaacaaactctgataaacactgtagtctgtgagagggtctgccagatgcccacctaatgttttcttgagcaaaatagcttgttgggaattatgaataaaactttctgtggggccaggtgtggtggctcatgcctgtaatcccagcactttgggaggccaaggcaggaggatcacttaatgccaggagttcgagaccagcctgggcaacatagtgagaccccccatctctaaaattagctggggtggtggtatgcatctgtggtcccagctacttgggagactgaggtgggaggatcgctagagcccaggagtttgaggctgcagtgagctatgatcatgcccctgccctccagcctgggcaacaaagtgagaccatgtcccccacactgcccaaaaaagaaacttccagtgtggggcacagcttggagtcatctaacatacagccaagtggaattgttccacgtgaatttctataatgtgactctgattgttctcctgcatttcctttaggatcgtggagatatgtaattggggtaagaacagggcactttgattatttggttcatttggctggaccccaccataacagtcaaggctggttagtggctataacaaacaccctgtccctttcagtggcttcacaccaagtgtatttctcgcctacagcacagtgcagtgttgtgggctctgtccacacagccattcaagcaaccagactccttctctctgctgcctccaccttcctcgaggcccatgtcattcaggcagagataggcaaagggagggaggccacgcacaggaggttcctgtgacccccggatgtagcacctttcctctgcttgggagacactggccggagctcacttgtgcgtccacaccgactgtaggagggggaggtgctctgcgagatgctaccatgtgtctggaagaagatgggaacacagactttgtcaagccctcacagtctctgccacacccgtagcccccaaaaagactatgggtgtggcaaagcttgaacagatttcatatttaagaagtaaacagctcttaatgaaacacttatagtattgagacagccaggtgggagggggtccccagagaaactccaaacagcctgtgcactggggtggagcctcaggaagttcttgccctttgcagcagggaggagcctggcccctcctcctcctgtgtggaaactgggattccaacagcgaggcgggaagtgctgtggcagggaactctggccttgcagagagtccctgttccccgtttttttccttttcaccaagaaaaccctgctctttactcatgcttcaaactgcgagcctatattttcatgaccttgggaacaagaaccccgtcttcagctgaactaaggaaaagtcttgcaacagtattctgcacgtgaccatgaatattaagctctgcacagtatcagccccctgtttaatatactgaaaacacatcacaacagcatcagaaactgtgagagtatgggggccttgtagagaggaaggagaagtgtgttgttttgttttattttgttttccaacatcataatctttgcagaattcttaggttatggtgagagccacctgtttttattgagtaggttggccagggcctcttctcagccattttcatgtaacactggggtctttcactgagaaatctgggtcatgcacaatccagcaacggactgaaacggccctggcattctgcagacgctgtggggcctgggtccactgggcctggtgcttggtcgctgccctctcctctttcccttccacagcccagggtccgtctgcattttgtggagctgggctccggccctgctgtgtgcctctgccatggatttcccgagagttggtattcttggaggtaccaggtgagaaagctggggaagatgcagccagtcagggtgaggttgggggagtctagatggtgtggtccgacgtggactgtcgtgaggaagctgaaacctgacagtggagcattgtctccaaagtgtgaccaggttggggcaggagggtgactccagacctcagggctatgttaggccacgaggcacttttgcagattagaaaagggcagacttctttaagacactccatgccccctgctgggaagtctctgtaatgagtatagaaagctgcaagagctttgccagggaagatgctgtcttagatgtggcatttctcccgtgccccaccaccgtccacagcagccctgtataaatgggcttatttcagctccatggcaaagttaccgggtagtgccctgtggctcttggtttgatccatttacaggaagaaggggatggagggaagcaaagagggagtatccgcctaggactgatgggaccatgctggagtgtgcctgtttgttttctagatccctgctctggcccaggcaggttaccgggtcctagctatggacatgaaaggctatggagagtcatctgctcctcccggtgggtgtgctgtcttgcagctgtcttatgctggtcttgccttctacctgcctgagcgctccacgcctcggtgctttccctggtcccagatcagagtagccttccccttaagagagtctgacttcacctctttcctctcctacggtgccctgtgtctctgcactttgggcctcagatgcccctgccccccacactctgaatgaatacagcagcccctaaggctcatgctccaagggatctcccactgatcatgggggatggcggacatagaatgtaccatccatctccagaacattcttcatcttgcaaaactgaaaggctgtattcagtcctcagttcttcctctccccaacccctgacaacttccattctactttctgtctctatgaatctaactcctctaaagactgcatataagtggaatcatacagtatttgtgcttttgtgtctggcttctttcacttagcataatgtcctgaagtttcctccatgttatagacggcaccacaatttccttcctattttttttttttttttttgagacggagtctcactctgtcacccaggctagagtgcaatggtgtgatcttagctcactgcaacctctgcctcctgggttcaagtgattctcctgcctcagcctccctagtagctgggattacacgtgtgtgccaccacacctggctaatttttgtatttttagtagagacccactttgctggatacatttatctttcagttcttgtaacttttcatgaattatttctttgataattttttcttgtattttctctatttttgttgttctttttctttttgctttctggaattgctattgttaaaatattgttattgttaaaattgctattattttttaaatcatactacccattgatttgggtactcatatgacccaaagtaacctacagatgcaatgcaatccctgtcaaaatctcaatggcattttttacaaaaatagagacagcaattctacagttcttatggacccacaaaagactgcaaatagtcaaagcgaccttcagaaagaataacaaagctggaggcatttgaagcacacttcctgatttcaaactacattataagtctatagtatgatacaaacagtgtgatacaaacataaagacagacatactttcagtggaacagaatagaaagcccagcagttgatccacatgtatgtggtcaactgatctttgacaagggtatcaagaatacacagtggagaaaggacactctcttcaaacaaatggtggtggggaaacatgaaaaagaatgaaattggacctttatcttacaccacacacaaaaatcaactcaaaatggatgaaaggcttagatgtatgacctgaaactgtacagcttctagaagaaaacacagggggaaagcttgacattggtcttggcaatgatttcacagatggatatgacatcaaaagcacaggcaacaaaagcaaaagcaaacactcgagtctacctcagtctaaggatttagtaagtttttgtgggtttttgttgttgttgtttggtttttggttttctttgcaaaaaggtccttttgatgtgttgatatattttaagtaacgtgaattaaatatgtttcttttatttttaattgcagaaatagaagaatattgcatggaagtgttatgtaaggtaagaagaatcttgggtaacatcttccccatcctgcgatttttgttgctataaacccgaagctggggtatccattcaaattttagggaagcatcatttcacagcctctgggtataaattcctactgaaagttgaacagtatttccaaatgatagcccacatgtatgcagcatcgactgtgtgtcaggtcttcctccaagcaactgacagaagagaaaactgagtcatgggaagttaaaggtaattgcctgaggtcagtagccagtagagccaggttggaagcctgcagtactgcattcgattgcctcaccatctaaagcattgaaaaaagtcactttattctggtaaagacattgttggccagacctaggccagacctgtgcagactgtgaccagcatggaattcctgctctaagacaggtgtaagcaccatcctggagaggggcccctcacttcagtgctggcaggggaggccaaggccaaggggaggagagactgggtcccaaacctccacgcagctcaggagcaaaagcaaaagctgggggagcccaggggaggaaacagcccccaggttggctggggaactagtaatgctgctggtgacactacgattacaaaagcctccatctctgagtcacagccctgtgggggcttctccccctcatgtgtgccccacagcttcatgcgctggctttggcatctcagaagcaatcatgggtaaaagttccatttccaggcagggctgctcctccttcctcagttttccagtctttgcctcttgcactctgctgcttctgatcccaagtgtctcccccaaagtcctaccaaggtctcaccagtgaccccaggagcccctatcctgctgttgtcctctaacctggaccttgcttatttccatcaaaatccattcttgagacagggacattgggtcacttaggagaactggtctcttgaagaaagtccttttaccaaaaacaaacaagatggtgctcccatcctcctgttccacctttgaaaaatcatgagtacatccacagctaggtatttacccaagaaaatcgatgacataggtccacaaagatacccagatgcaaatgttcacagcagcattatccctaacagccaaaaatggagacaacccacatgtccatcagctgatgaatggataaataaaatgtgggccatccctgcagtgggacactgttcagctatacagaggaatgacgtgctggtgcaagcttcagtgggaatgatccctcaaaagacgatgcttagcaaaagaagccagtttctgtgtcaggacagtgggtggtgggggcaggaatgtgttgtccccagggtggaacgagcctctcactgctcccctgcagcagcacaagggcaagctctacagggcagctgtcttccgtccccctccagtaaagagcccaggcttgctgtcttacaatggtgatgggatagttagggatatgtattggcatacactgaataattcactgtgcgtgtttggagtcagcttggttcctgagaggatgctgggaagggaagggtgatgtcgtgaagactgatgaacgatggacggctgcactgctcagcctggctaccgtaacaaagcgccacagactaggcacttcaacaatagacgtttgttttctcacagttttggaggctggaagtctaagatcaaggtctcggcctccggtgccagcactgaagtgaggggctcctctccaggatggtgcttacacctgtcttagagcaggaactccatgctggtcacagtctgcacaggtctggcctaggtctggccaacaaaggcacagttgtttctctgaggcctttcctgggcttgtagatgccaccttcttcctgtgtcctcacgtgctcgtccctctgtgcgtgtctgtgtcctaatctcctcctcttttcttttcttttttttttttttaataagcaacagggtctccttatgttgccccggttggtcttcaacttctgggctcaagggatcctcctgcctcagcctcccaaagtgctaggattacaggtgcgggccattgtgcccagcctaatctctcctttttttttaattttattttttttatttttttgagatggagtcttgttctgttgcccaggctagagtgcagtggtgcgatctcagctcactgcaacctccgcctcctgagttcaagcgattctcctgcctcagcctcctgagtagctgggattacaggcgccggccaccgtgcccagctaatttttgttttgttttgttttgggttttttttttgagatggagtttcactttgttaccaggctggagtgcagtggcatgatctcggctcactgcaatctctgcctcccgggttcaagtgattctcctgcctcattctcccaagtagctgggactataggcgtgcaccaccacacccagctaatttttatatttttagtagagatggggtttcaccatgttggccaggatgatcttgatctcttgacctcatgttctgcccgcctcggcctcccaaagtgctgggattacagccttgagcgactgtgcccggcttaatctcctcctctgatcaggactcccagacccgttggattagggctcacccatatggcctcattttaccttaatcatctccttaaaggctgtatcttcaaaaacagtcccattctgaggccctgggggttaggacttcaacacagcagttttggggaggacgcagttcagcccatcataaaggctgaggcaggcgggtgtggttgctgattttgcctgtgtgtgtcttcttccttaggagatggtaaccttcctggataaactggtaagtcattattttgaactgatatctttggagaattcctttggggcctgggtaattaaagaaaaggcgtcagcctcgagcagaggtgcacgggcagggagggcccattttggggcagtttagggcagagtgggcatgggcagggaaaatcacaaaaacaatgacaaagagcaaggattgcgtggagaacaggatggagatgagcttgtttatttgtcttttaatgaaaggcaggttccagggaatgggaccagggaggacagccttgagtatccattagagaagtttggaaaataccccataggctaatatttctcagctctttaaactttcatcccttctgacactcctaaaacctcctgtttgcatttgacattgtcatgaatgtcaaactcaatgataccaaatgaaagcaaatcagcagtggtgagctgagaatgcgcttttgcagagtacacttcccactcccaagactgcatggtataacagcgtccccttcccccaagtgaggtcagaggggcagaatggacggaggggtcaggcccaggcagaacagcagcagtggaggacagagaaggatgatggagctgtgggacttaaggcctcttaattggatgtgggagtcagagaggatctaggaggctgacctctggttcaccagcagggcgctgtgcctgacacggcagggaagagaccctgagaatatcatggtccctaccctctgcagattctcagtttcctgggattaggtttggaacttttgtgtgtgatggggacagggaacagggcatggcccagagtggccacccagtcctgactctgtacagacttctgtctagaagcgtgtcccttattgttgagagagtgactctgcggttgctgccagtggggtcagtgtggagcgaggtgtggataggctctgccatctaggtttcgctctgtgatgtttgtgtgacaaaaccacctgacacatttctgagaacgtgtcccccttgttaagtgacacgtggctatagctcttccataaaggggagttgacgttgtcattttcaataccagcagcggaaagagagagattaaagatgctttgggacttttaatggttgtttaagggaggagagcttccaaaaaagtggggttgtggggggtagaagcataatcatttgataaaagatgcacatggaacatgaagaggtaagttttacttcttttaagatagaagggaggaaaaagaaaagaacgaaagaaaatttgatttgagagaaggtagagagggagaaggaacccatggcctgtggccttggtctcctaagcagatgtaaaaggctggctatttgtgttgagggtctgtggctggtggagggaggagaggcttgaagggtgggcatttggagagctgctgtgggtcgggggaggagaccctggtgtcgaggggctggctgatggccgaacctctcagcaccccgttccagaagcctccccacattcggctcccttctttttccttctctagggcctctctcaagcagtgttcattggccatgactggggtggcatgctggtgtggtacatggctctcttctaccccgagagagtgaggtaattgggcctcgggcaataaagatttggaggaggctggacttgaactcctgtgagaattgttcctcagatctttaagcccagaaaacttctcaaaaacaagtaggtagtctgggaaggtgatgtcttcactctttagtgtctggtgacacattataaagagggcctagccgggcgtggtggctcatgcctgtaatcccagcatttttgggaggccaaggtgggtggatcacctgaggtcaggagtttgagaccagccctggccaacatggtgaaacctcatctctactaaaaatacaaaaactagccgggcatggtggcgtgcacctatactcccagctactctggaggctgaggcaggagaatcgcttgaacccaggaggtggaggttgcagtgagccaagatcatgccattgccctccagcctgggtgacaagagtgaaactccgtttccaaaaaaaaaaaaaaaaaaaaaaaaagggcctaatgagctaatgtgttaggaagcggcacctgttccacttacaggcaatgggacaaataattcagggcccgagtggccagtgggaatacaggaggatcctgacttgagcttgaggggtgcaggggaggcaacaggtgtgtcttcagtcctggactgagaatcagaaagcgtggccttcggtctgccctgatcagctgtgtgacacatcacttcgcttcttaggctttggcattctcaaccacaaagtggtaatggtaactcctgcctgactccacaaccagaaaatgctgtgcaaatgtccagtgagcccagcatgtcatggtccccaccatttcattcataatcattcttagaccagcatttcatggcttgagtgggagctatcagatggcaggttttgggcccagagactctgtagtctctttggccatttgagctggtgagctgcagctaaacctgtctgacttcccatttcagcctctggtcttagcaagttaaagaaacatcatcctaagccaccatctgaatttccctaactaacccagttattttgtatttggctaagtttatgagattggaactaccaggaaactttgttctgcttcactcctggctcaaatgataggattatatcaaagaataaaaagaatcaaatgttcctaaaatattgttaaagttttcatggtattgttgtgttcatctctctagctttttaaattttttaaaaaaatttcttgtgggtacatagcatattctagcttcttcctctctctttctctgtcccctctctcattcaaagtggaaataagagcttgattcttaagaactgggttcaccaaaaagttaccctgcagactgcacaacgtactggttaaagtcaacaaaaggaaagatagcaacgagctgtgtttgcccctcaaattcacccccttttctattcctgtttttttttttttttgagacagagtctcactccattgtccaggctggagtgtagtggtgcaaccttggcttactgcaacctctaccttctgggttcaagtgattctcctgcctcagcctcctgagtagctgggaccacaggcatgcaccaacacgcccagctaaattttgtatttttagtagagatgaggctttaccacattggccaggctggtctagaactcctggcctcaagtgatccacccccatcagcctcccaaagtgctgagattacaggcatgagccactatgcttgtccgtcttttctattccttttgctagcatcctattccctcttcaggtgataagtcagtggtctactggctggattcccaggttctggcctctctgtctgcttccatatggtctctcagtgcttgattaatcttcctgacctctctctctgtgtccatgtggtctctcagggctggattaatcatcctgactgcaactcggatccaccctcccttcttctgagacgccctcatggttttcttggttcttacagcaccaaattcagactcaggtcccttcatgtctaggctccccactgcctttctgttgttatttcccaacatattccattccatgcttggcttctagccacgcagactgtgtgctccattgaatacagctgcaagctttgcccccttctagaatttgctcaggctaccttatgttgttcccctcccaggccttgttctcctccccagctctccccattctgaaaagccaagttcaaatgctcccttttccacagggtcctccatgatgcccagttcaggaattccttatctccttccaactcctatgctattttgtgctattctatggctcatatcatagtcatctcataaggtcactgtgtgtttttctatttttccttattaaattataatgagctccttgaggataaaaacgatattttattcattttacattttctctcctctagtatatgccatagaattatgctcaatccagaggagacacaatgagtgaataaagggagggaaaaaaaatgaatgtatattttaaaactagagagagattcgtgtctccatattctatccagggttgctacagtatgtgtactgtgtgtgtgtgtgtgtgtgtgtgtgtgtgtgtgtgtgtgcgcgcgcgcgcgcgcacctatgtgtctaaggcaagttggtgagaaatactgcagtttagtaggaaaaaaaccaatggactaggaatcgaaaatcctgagttctgatcccattctcccattcactgctagtgtatgaccttgtgcatagaatgttcccactctgagcttcagttttgaactgcaaagtcctttctggctcttgtaagactgtcttcttacaggggctatgtcttgctgcctcttatttctgtagggcggtggccagtttgaatactcccttcataccagcaaatcccaacatgtcccctttggagagtatcaaagccaacccagtatttgattaccagctctacttccaagaaccagtaagtatggcaccaagggcaacaatgggagcattagtgtttgcctttccccttcctgtctccttcttatttgctttatcactgtcccctttaattttatgtggcattagtcagaaatgattttacaaatgggctcaggtgaaactggctgccatgcccagctgatccttcccaggcaatggcacatttccgtgtgtgttcgggtggtgaagggccgggggatgttgtaccctggggggatggcttctctggtgtctctgcaattgcagagttttggggctcaatgctcaggtagagctgcccctcctcattctctggctgaaaggctggtgattatggcaccagggtctaagagtcctgcaacaggccccacatgtgctctgaagaatctgagaagtttctaggtatcagtacacgtgccacaaagatgcctttcaaagatgcccccagatgtggctgatacatatattggggcatccctgccactgttaactggaattcactgagagcagcatcaggagtcaacgtcacctggcctggtgccccgcctacagctgccctcttctgtgggagacatctgctatgcatccacttgcaggaattatccagagagaataaaagatgtttcctgcacactccagagagagaggaatggaaggaattaattaatcaggaatgtgagagcgtctcccacgttcctctcccagcctccacctctgctcctcttaggagggaccgtttccagcaagaccacaaccatcccagtttcgattcaacgagtaactgttctccaacaattattttcattgatgagacagcatctgtgtgaaaggagctttgcgattcaggcaataactggactcattcaccaaaagctcccagcggcattttgaagagacctcgacatgtcgcatcccacatactacagggaggcctgggccctgctgtgccacagcctggtgtgtgggaatccacgagcttcctttggcctgaatgaaagcacaatgtccttcattagtgtgagatagtctcgatggtgagactatgggtgtggtgtgtggtgtagagggcgtattactttgctggggctgccataacaaaggctaggtagctcaacagactgggcagcttcaacaacagaaattcacagtcttatagttttagaagctggaagttcaagatcagggtatttgtagagttggtttctcttgaggcctctctccttggcttgtgggtagtcctcttctccttgtttcctcatatggtatttagcccattaaaaaaaattttttttgagacaggatctcactctgtcactcaggctggagtgcagtggtgtgatcatagctcactgcagccccgacctctccaggcccagatgatcctcccatatcagcctcctgagtagctgagactacgggtgtgtgcccccacacctggctcactttttgtgtgtgtattttttatttttattttattttatttgaggcggagtcgccctctgttgcccaggctggagtacagtggcgcaatctcggctcactgcaacctccgcctcctaaggttcaagcaattctcctgcctcagcctcctgagtagctgggtctaaggtgcatgccaccactcccggctagttttttgatttttttgtttgtttgtatttttagtagagacggggtttcaccatattggccagactggtctcgaactcctgacctcatgatctgcccgcctcggcctcccaaagtgctgggattacaggtgtgaatatatagagacggggtttcaccatgttaaccaggctggtttcaaactcctgggctcaggtgatccacatgcctcggcctcccaaagtgctgggattataggtgtgagctactgcacatggcctaaaatatttttaattgtggtaaaacacatgtaatgtaaaattgaccatgtcacctatttgtaagtgtgcagttctgtggcattaaccacatgtacattgttgtgcagccatcaccacatccacctccagaactttttcatcttcccaactgaagcccttcgcccattaaacactaactcctcatctcccctcctcccagccctggcagccaccattctactttctgtctgtatgattttgactcctctaggaacctcatataagtggaagcatgcagtatttgtccttgtgtgactagtttcttccacttagcatcatgctttcaaggttcacccatgttgtagcaggggccagaactgccttcctttttaaggctgaatagtattccatggtgtgtatagaccacattctcttaatctggtcatctgtcaatgggttacagctacagctgtttttgagctcttatgtgccacgtggttctaatcttcacagcaacacgaagaattctctcctatcttctcagctgagcaaaccgaggctcagagggcttaaccccaactggcccaagaccaggtacatgattgggtcaggatatcgacctaggcctgtttgactccaaagcccatgcctccaactaagccatgctggaggggagcttgggctttgttctgtgcgctatggggagtcaagcagagagaggagggacaaatcaggataggctcaaaatcctgattgcaaaagtgaccttaggagaaagacgcttagtaattacagcccttgtcaaggcacagttttttgtttcaaaggttgttaacagttattgtggaaaaatcagtacctctattctgttgtagcagctgggtttaaaatctgcagtgagagttttggggacagttttgttcttaagaacaaagcgccttggcagggaaatgttagatattcaaattagtgatctggccactgaaagatacccagtaaccaggttgggctgcatccagccactggaaccactcaataggtacagagctgggactggaggagaaatcactcacaggggttcctgccagcctgcctgatacctactctctaaggaacaagtaggcaaaggcacttcccatccctggccctcagtttcctcatctgcaaaaggttggttttgggtggttttcaaacaggtaatagcttcaaacttaagctgattccaggtcagcaaataaagccaataacatggagaacagctcttggatgtatagtgggtgctgggagttcctccttcctgccacctcctaacccgctccctccctggccaggaggaggcatttctgacatctcctccttctccctaggagcactgaggctgttccagacccatgcagcctaaggaagactccttctgtgctgtgggtgcacccgtctcccccacttatttttttattattattattatttgagacagagtctcactgtgtcgcccaggctggagtgcagtggcacaatctcggctcactacaacctccagctcccaggttcaagcgattctcctgcctcagcctcccgagtagctgggattacaggcacccaccaccatgcctggctaatttttgcatttttaatagagacagggtttcaccatgttggccaggctggtcttgaactcctgacctcaggtgatccatcctcctcggcttcccaaaatgctgggtgagccactgcgcccagccccatctctcccacttctgggtcatctctgctgagcactgcagggtgaggcttagactaactccaagtttagagtcagctcccatatagctctttgaacccttagccaacgtgctgaatcttggcctgggaatctgccaagtctgctggaaacaaacaaggcttgcttttcttgccttctcagagaagaggtgacagctttccatgtgtatagtgagaaagcatgaagactaggcagctctggcagcgaaggccagtggaatcggctgggtcatttcagcttagctgttccatgttttaattctgaggattcccaaagtcctcacttggcctgggggatactcacaccccattatgccccccataccagaacgtacctaggatatcctgtgaaccctgctctctcccacctcacgacactggtcctctttacttgtccttaaaccgcacatgtgtatttttatttctttgaggaagactgggtggcaggcacctgtgtgtgtgtctggaaacatatagcaagctagaggcagatttcaggcaaaaaaaaatgctcttttgggctgggcgtggtgactcacatctataatctcagcagacaggtggatcacctgaggtcaggagtttgacaccagcctggccaacatggtgaaacctcgtctctactaaaaatacaaaagagctgggtgtggtggtgcatgcctgtaatcccagctgctcgggaggctgaggcaggagaatctcttgaacctgggagatggaggttgcagtgagctgacatcgcagtactgcactccagcctgagcaaaaaaaaaaaaaagaaaaagaaaaaagagcccttttatttaagtatttaaccagaagagaaactaaggatcagagagaaaatgtgggaaaagaaaaattgtaggcagaaggttttacctggctgaaaatcatccacaaatgattttctttctcctcaaaacattgagtctctctctctttttttttttttctgctgtgttgcccaggctggtctctaagtcctggcgtcaagtgatcctcccacctcagcctcccaaactgctgggattacaggtgtgagagctgccatgccagcctaaatgttgaatctttcttaatctctagaacacagtagctccttcaggccatggggacagctggtgattagttacagagtttattttttaggttttgtttttgttttgaaattatgaagtaattcatccttgctatttaaaaaagtcctgtgttgtgtaaagtaaaaagctgaatcgccctttgcccatcaacgagctactaatagctactactaatagtctggtatttcccagacattttttgaaatatttaaaaactatttttgaatgtttttaagcaaatatatgtgtgtatgagcacacacacatatataatttttcatataaatggaatcatgctgctttttcatttaatacatattgcacagatttttttgtcagcacatatagatttatctcattctttttaatggctgcatggggttttgtaacaggtagactatggattatgtaatcctctgtggagggacattattttgattatttttcacagccgaataatatagtttaaaagaaagtgccactgtttgctaccttatgcaccaagctttaactattgttactttaatttttttcttttttttttttttttttgagatggagtttcgctcttgttccccaggctggagtgcaatggcatgatctcagctcaccacaacctccatctcccgggttcaagtgattctcctgcctcagcctcccaagtagctgggattacaggcatgcaccaccacgcacggctaattttgcatttttagtagagatggggtttctccatgttggtcaggctggtctcgaactcccaccctcaggtgacttacctgcctcggcctcccaaagcgctgggattacaggcatgagccaccacgcccggctgttactttaatttttatgccctttatggaggaaacccttggcagggttattttcattgtcttaaattggcagtgttgtgttaggttgtggtgaaaagaaccaaatatggaggggtttggagtctgatgttctcatttataatctgcctgaccttcaacgaggcacttaaggcccctgacctgagcgtcttcctctgtgaaatgggcctcacagctcagggctgttatggacagaaagagctggcaccatcagcatgtggcaggcggcccccagtgccctgggtccctgtagagccttctaagtctttgctgtccacctctttctcatctgaccagccacactgcagagtcaaaggtcaacagtttgctgtctgcccagatttcggatgcttccagccactgccatttttgacctcagggacaaccaccccactgtttctcttggcctgtcttggagaacactggcgcagacttccagaggaattggagtcatttttgtcaaggtagacggagcatgaaacagagtcactggcccagcccgctgaccagcagaggcttcacctccactcctggatggcatcctttggcgttacttgtaaagggcaggagggctgagtgggggcttcgtggacctgcaatttggcttcaacagctgcctccattgtctcacccacaaaacaatagccacagttaagtgcagcctctcagcagacctgttctctaccttggaaaggacacaagagaagattaaagaggagaaactcctgggatggtggaggggagctctccctgttaggagggctgagcacaggaggcaatcctgtgccctccaccaatgtgggggcacctccctggcaaattaggtgactgacagtgccgcccctaccagcgctgagtggaaagtctagacaaaactccatctttttgtggtgccctgcatttctgggggctcctctgacagtgtgctgaatacgcacatgggaagtaaattgagaggatgagggaagtccagggcaccttggatcctgggaccctccagacccccaccctgcggttggcacacctgctgcctgttgctcctgggggtggtgcctgggccccctgagcccagggtaatgaagaccctggcccctttccctcctcaccctctcccctcagcccccacatcaagataccccctggagacatgctttagtgtaagctgggggccagaaatgggaggaaaataacagaagataacatttgtcctctgcttatgtgcttagctgagaccttctgactctttttaatctacaaaaggtaagaccgtatctttaaatcctacagaccaatgacaaatttcctgcctgctctggataggggcttctccttttgtgttcccactcccggggctgccataacaaagtaccacaagctgtgagttagaaccacaaaagtgaattctcaacagttcttgaggctagatgttcaaaatcagggtctcggcagggttggtcccttctgggggctcccgagagagagtccatttcatgcctgtctcccagcccctggccgttgctggcaattcctggtgttcctcagcttgtagacacatcacgcccgtccctgcctccgtcttcatgtggcatcctcccttctgtgtctctgtatgtctcaatttccctctttctctcataaggacacaggtcattagatctagggcccaatctaaagccaagatgatatcatttaaagaaccctaattagatattaatttaaaattttaaaaaatcagccaggtgcagtggctcacacctataattccagcactttgggaggccaagtgggaggatcacttggccaggactttgagaccagcctgggcaacatagccagaccccgtctctacaaaaatgttttaaaagttagccaggcatggtggtgcacacatgtaatcccagctcctcagaagactgaagcgagagcatcacttgagtccaggagtttgaggatgtagtaagccatgattgcactactgcactccagcctgggcaacagagcaagaccctgtctctaaacgaataataataataatggagataatgatattaatatttattggcatgcctcctgcatgtcaggcattgtaagaaatgggcattatctcatttaatccttacaaaatccccattttacagatgaggaaaccgaggctctagggaaagaagttccccagctggtaactgtcagtacttgggcttgaaactgtgtttattggattctaaagtccatcctttaacttctgtgcgcaggaacacagaaggaggagcccctctccagggcagacaggaaatttgtcattggtctgtaggatttaaagatatagtcttatcttttgtagatgaaagagagtcggaagatctcagctaagtgcataagcagaggacaaatgttatcttctctcctttctggctcccagcttcatcctattctttctgttgctctgctgcacttttatgtgagtgaacagatttatttaccttttttctctctgattttttttaagagacagggtctcactctgttgcccaggttgaagtgcagtggcacaatcataactcactgcattcttgacttcctgggctcaatcagtcctcctgcctcattctccctagtagctgggaccacaggcatgcaccaccatgcccagctgatttttaaaatattttttgtagagtcagggtctctactgttgttcaggctggtcttgaactcctggcctcaaagtcctcctgcctggacctcccgaagtgctgggattacaggcttgtgccaccacacctagactctttgattttctttactgactttttgacatcgtttgccctttaaaggatcatttgaggcaaagccctgtccaggcttccatgggttccttcaaacactgaaatgcacccctgagctcatgaacagcagctgtttctgggatgaggactgctctcagtaaataagaatgatgaccgacagccacacacacagacctgaccagggcttccatccatgacctaaatgtgcttcttcccatggctatttctcactgtggcattcatcatcatgttgcggaaggccgccattggcaccattataattgaatcttacaaaacggagggaactgtcattaacaggcagacatagctttcatcagaaaatctccaaccctagatccagcaccgccagatgatcaatgtctccattcttctgtgctgccactgcacagatccagagctctcgtgaggagtgatgagcagaacaaaaaagagtaacgtctcactgggcatggtggctcatgcctgtaatcccagcactttgggaggccgaggcaggcggatcacttcaggtcagaagctcgagactagcccgaccaacatgatgaaaccccgtctctactaaaaataccaaaaattagccgggcgtgatagtgggcccctgtaatcccagctacttgggaggctgaggcaagagaatctcttgaacccatcttggcagtgagctgagattgcgctactgcacaccagcctgggcaacagagcaagactccatctaaaaaaaataaaaataaaaaaagtaacctctcaacgtgtgcaagcactgaggactgcaggtcgctggaacgaaagctttgtggatgtggctttaggatcttcctgtcctctgactctatctcaaaggcagccacagatgctgctgagaacaggatgagtccccaccactaaggggatcccaggagagcacattcaaggctctgcaggatccaagaaaagcagagttaccccttggtggtgggaaagatggaacctcatggagaaggcagtgtttgggtccggtgttgaaggccaaactaatagaagtccatgctcttggtgaaggtcacaatgtgttaaaccagggaggccagcgagtaggaggcccgctcagaaaacacatgcagaacagttcagctgatgtttgggtgcgtgcaggtgggtggttagagggaaggagaggagagtcagttggcattgccacacttaactcaattccctctggtagcactagtccctcagcagcagctgtgttacagaaatattttattttattttattttatttattttgagacagagtttcgctctttttgcccaggctggagtgcaattgtgagatcttggcttactgtgacctctgcctcccgggtccaagtgattctcctgcctcagcctctgagtagctgggattataggcatgcaccaccatgcccggctaattttgtatttttggtagagacggggttttaccatattggccaggccggtctcaaactcctgacctcaggtgatctgcctgcctcggcctcccaaagctctgggattacagcgtgaaccactgcacccggccaagatttttattatttctgagtggttgcccctagtggatctctgcctccaggacagctgttttctcctaaactacgtctggaacagctttcgggtccaccatctttcaacttctggaaacgacagcttgaattaaaattgtcctcttatgctccaaaaagccatgaaccaggctacccccactaggagagtaggatccatggatggatctcttgtcaccttccagccattcccctgttcttggtgtctgctttgctgaagtgctcctggagagggttggggtaggaaggagaggggaagcaggagaggaagactccacaccctgagcctccagtaggaatctcctccccagccctcagcacatgacattcagtgacctggacacttcactttagtcctcatccaagcccctcccccatcctttggtccaccaggaaggttctggagcctattttgtacattggcatctcttggtccagtttgccagagaaggagctcagtgtctgtggagctgatgaagcaagttcaggtcagagaattcccaccatacacaagccagagacctgggaacagccagagaactgtgtgtcgactgggtaattaaatgccatactgctcccaagaactggaaggacctggtcatttgtcaccaggaaggctatgtgtcccagctctttaacagtggaaaccttgctgccctgtctgtggaatacaatctattggcaatctaatggtctgtaacaattaagacccaagtcaaaggagttgattttgaagtttctacagcaaaaaaaaaattgtttaagtttctttgtaaagatggggtctcgctaggttgcccaggctgctcttaaactcctggcctcaatatagcgaaatttagatgcctggatggaagagcatttggtatatagtttttggcttttctgcttggtttctcagaatccttggagcccctctcttcttaccaccagtcagcctccaacccattcctctaccagccccctcccaagtcctttcaagagattattataagtagtaccttctcattataggaatattgaaaaacacaaagaaagtggcatctataaacctgcctcccgtggggaactacagttagcatcttgtattttatgctaacctttttaaaagacatgttttatgatgaaaattcaaatggatgctattctgatgaaacttgggctggatggggcacaggtagggtgcttgttgctttcagtcagatgaaggaggggtacagtttccacgatttctagggggtccttcattttgctttcttgattgttttagggagtggctgaggctgaactggaacagaacctgagtcggactttcaaaagcctcttcagagcaagcgatgaggtgaggggtggggatgggtgcagaagaacaggagggggcagttgtgaaggaagtagggtacctagtgtgtggcagggaccaggagtagcaatctggcctccttttctttcatttctatagtcagggtaattgaggtcctcactctactgggaaaatttacatcctcgttgacacacaaggtcagagaatgattataataatgatggcttggaaattatgctattaccattaccattttaacatgcataattggcttacccaagtacaaaattaattgatgtccccaaccctcttcttgaagcagaggagtttagaaacctttaactctgtaagctgcaccctcctgtcttaggtgttaggagtcatcatcactattgttgttttatatacagtcagtgcctgctcaaactgtcccatattttctactttctttactgatcacttcttgcatctcactcatttgcattgagttcagtttctttcttcctgaaacatcccctttagtagttctctcaataagagtctgttggtggtaaattcacattttggtgcctgaagacatcttaattttaatcttgaagaatcatttatctgagtatagaattttaggttattttcttttagaaacttctgtcattgcttgtgagtcagcctcgggtctaacctcctatacattaattgtcttagccaattaattgtcctggacactgcagtgtctgatctgcagtttaacctgtctttgaagttttaatttcaataaatagttttttttaatttgtgaaagttttatttggttctttttcaaatcattctgatctcttttgatagagtcttgttgtattcttatttttcagttccttttatgttttcaattattttaagtatattcatttctaattctctcttgtttctctctctccctctcgcaaactctgttattggatgtttttggggagtcgtatttactgtttgctacattttttgcctcttgctgtggggcctttttgtgtgagtgtgggttttgtaattttggtttataagctcatcttcagcagtacttaatctgtacccatctgcttcaattgggcttgaggaaatgaccccttgagtggttaaggatttcttctgccaggcatcctggtggcattaccaacccaggctcactttgttgttattgttgttgttgttcttgtttacttcacaccttgagagtttccagatcatgcagagaatgcaaactcaaatccaagcacttgggaaggcaggcctagagctatgaattcccaagggggtgtcttttggtttcctcttagtaccaagctgaaacagacaaactcctttaacatctttatcatcatgaggggattttttttctaatcaattttttcactgagggtatagcatgtcagagaccccagatttactggatttaccatggaggagcatggaatatcacatcttcaacttctcatcataggccaaggtctcttttcttgttcccattggctgataaacctaggtcttcatattaccaaggtctgcaagggccctggggcagtctcagcccagagctttggtcgtgagcccgctctttacttgacttctgtgagggggtccctggctctcttgggagttccacatgtttgttacagtctgcgtggtactcagaggtcatttgtcataacagggttttcagatgagcatatttcctttgtcatttgtcgtaacagggttttcagatgagcatatttcctttgtatcacccatgacatcatttgtaactcttttcttttcttccttcagagtgttttatccatgcataaagtctgtgaagcgggtaagagacatgcttgggagagccatatctggaaccagctgaatgttaaagggatgtttctgtctctgactgctatgggcagaagccctgagctctccagctctgaactttaagttgcccaaccagggtcccctcggcatgcatagggctgactctaaccccaggcctgagcacacagcctggagttcctaccctctagggagctgtggcttcaagatcttaagcagtaagagcttggaggagtcttagagcttgtccagggcaaaatccaccctctactgataaggaccccaggattgagagcttacctctatgggggtcacctcgtgtatgcaggtggagtggagtggggcccctgcccaggtctcctccattgcagtccactggcccctctccatccaggcgccatgtttccaattcccccacctggagctcatccttgtctccctcctgggttgggtatgagtgaagggtcagagttgagatttgatttgagctcatccccatggcccctagatccagcactcttcccacaagaccttatttttgctgcagcactgtggccttgacagcattcacttgtatttttatgaataatgatgaccactgtcacttgtttgggcacgtgctgaccatctgtataaaactctggactaaccccctttagataaaatatttgtgatcctcgaagcattctgaaaaatgctactatttttaatttccaaagaggaaaacaggtctcagagggttaagtaacttgtccgaagtggctgagctggggttaaactcctctgaccctgcaggccatgctcttgtcactgctcaaagaacatcttccttccctcccccacacccacattcccttattccttcacaccgtctgtcactcattcattcacccattcattcattcctcaaatgctgtgagcacaggctgggtatgaagctggggctgcatgctcagctacccagacacacgaagcagggtggccaccctcagtgagcccacagtctcacgggaggcagagcagctgggatgctcgcagaggggccctgaggtacagtgagtctggagcacccgcctggtggggaggctcagggtggcttcatcacagggtgacatcctcatcacatacccctttgatgtgtctcacaaaagcctggaatgaccagttcctgtgcctccgggtcttcgtgaatctgaaaatgccgacgggccctgttcaggcaccagcattgaggctgtgccctgtgaaattgcagtggtccctgggctgccaggggtcatcacaggccatcctctggagggactgtgcagcaccctgaagacaagagaggggtccacagtgggataccacagagggtctgtgcggcacgtgggaggtgacaggatgcagccacctggcctgggttctcttcctgccttagaggaaaaacggagcaaatccttatgaaaattccaagaatctctggcgatatctccaaagggccacagttaagctggctgggaaaggtttagacgaggggagagcaggagctgggggctggcagggtctgggatatagctgctgtgtgcctgaaaaagccggcaactgtggttggtccaggagctgtgataatagcccgtgaagtcgtggctaggtgggagggaacatcaggctccagtgtgaccgtgagatcacagctttgagctttcgaggagatgggatcactctggcaaaggataagggaacaaaagatggaggcactcataaggccttgcgcaagttcagatggtctgcgagaggcaatgaggtccccaccttaaaatgcagacacctggcccggggatgggaaagtcaacaagtggctttttttgcaggaggactttttgtaaatagcccagaagagcccagcctcagcaggatggtcactgaggaggaaatccagttctatgtgcagcagttcaagaagtctggtttcaggtaaagagagcacagggcccagacacagatgagagatgatcgacagatagggatcttcagccctcagggtggagggtgaggcccagttctcctccaccacagccctcgttagtgccaggccagcctctgcttcaatgcctccagtgtcgggaggctcactactttatggtgctcagcctgctctagtttgggatagctcagcttgttcttccttatgcttatggggcccccatagggcagagggttttcactactttttagtcatggctcctcagagaatcagatggcaactctgggctctttcttcagaaaaacataaaaatccacataaactcaaaaagtgcatacattttggtgcatttgccctacttcctgatgtcatattaggagggggcatctttgctccacctcccaatgtccctctcaagtgggctccctggggcaggcgagtggcctctggatggtgaggctgctaaaccaagttccccaccatcagcaacctccccagcctccaaggtgacacgatgacattccctggagggtcctgtagggccggcttctttgtgtcccaaaagccaacctagaggctgccagttcactcagtggagtcctgtgtccttgcacaaggccttgctgctagagcttggcaactgcgcccgacagcaaggcgtgggtcctgggctctattctcttgcccctgcaggaggctttgctcttcccaggacgactggctgtgcagagcaggtttctgctggtgtctgtagcagagccgtctacttactgcctccctctttttactttctgatctctccccagaggtcctctaaactggtaccgaaacatggaaaggaactggaagtgggcttgcaaaagcttgggacggaaggtgagtgccaggttcagtgtagtctcatccacaccccaggacccgcccgcggggcttcccattggcctgagctgatatgacctgggccagagctggttgtggacagatctgctggccacctcctttccctttggggtttgggaagtgactcccttcaggggtttccctaggatctttcttgctggtgcttctcttgggatggtagagggtgaccttggggatggagctggggtgtgtccagggaactgcagcatccatccggaatccccaggtcccctggtggtaccccaaggcagggctgcagatggcctggggcacctcccagaagtgacatggatactggagcccccagcccagaggagcgttaggtgctctcagagatgtgactttagccttcggttgtgtcaccttgcacaagtcaatctctgagtctcagtttcctcatttgtcaagcagaagatgagtttccaatctctgggtctgcagaaggagtaatggaggttcccagtttacattcaaaatgtttaaaaatctaagggaaatctgttccccagtgtgactgcacaggtagctaggccttcatcagctcactcagtagccatggttaccttgttggttcactctgtaagtgaacacactgctacatgccagacttcctgccagaccctgggataccatggtgtgtaaacagaccaggtcttgacctcccaaaattaagtcttgaggcactagagtatataacatcgtggttaagagcaggctaggaagcacatgggctgagtctaatccctgtgtgaccctgggaaaggtacttaacccctctgatccactgtggcttcttctgcaatatgcaagtggcaagaacagtgcctccctcacagagctgtgtaaggatgaaatggttgaaggcatgtgacctgttacaagcagtactgggaacctattagctccattagtgttccttgtcattatcatcatatgaccgatgaaaatgaccaaactgcagttggacagacaaaatctctcaaagcgtggaggaaaatattgacaaaggcgctgggaaggtgaatcccaatggtgctaaggtcagaaaccctcctcttctgcagtttattttttgagacagtcttgctcagttgcccaggctagaatgcaatggcacgatctcggttcactgcaacctctgccccctgggttcaagcaattctcctgcctcagcctcccaagcagctggaattacaggagtgcgccaccacacccagcgaattttttgtgttttagtagagatggggcttcaccatgttgcgcagggtggtctcaaactcctgagctcaggcgatccacccacctcggcctcccaaagtgctgggatgacaggcgtgagccactgcacccagcctctcttctgcagtttccagctggatcttcctctctcctcccccacctcctcccatcccatcctctcccccccccgccccccgcccagttcacattttagcttggaactttctagagtttacaaacctcatagaagcctcaggattcgttttagccacaaaatcatttttgaccttctcctggctcctggttgtgggaggagggaggggtgtggagagatgcccatcactctgggtgtaaatgaaaatagtgcacgttcctcaaccagggatgggtcaaagctgcttggaaattagggtaatggtggagcgagaacaaaggaaaaaacacagaggctttcctggccttcctgtgcatgcctccctgtgttcaactcatttgccagcaattggaagttactttgctgccattcatgtcacattgattactactgtggctgcccccattttctctggaaccttggtcgccccttttaagcatctatttaattcagggaagaggaatcttgatcttcattcaagggtgtcttctgccttcttggtgccatcaattcggttctcccagttacatgcagctcagcacacgttctcactcacacacatctgcacacataagacccatattggcctctgcactgctgaagctgttattttaaagatctccagtaataaccacgagtctgttgtgcaaagttcggcagatacaacgtcaggaccacagcagggtggcgagcaggggtctttcagaggaggagggagggcttcctttgtggagtgctggccacttctgtttcctgttctccccccagatcctgattccggccctgatggtcacggcggagaaggacttcgtgctcgttcctcagatgtcccagcacatggaggactgggtgagggaatggccctgtacaagggtcatcagtgcaccccgggagagggcacgggtgctcagagggaagacggcagcagaagatacaccttgtcatgtggataggaccatggttgaagcacatcatcagtaacatcactgtccccccattgcaagcagcaaccgtgactgtaccttcctttcccctgcatggatgtggggtctcattcattcattattcccttcctaaatcatgcagggtttgggcagggtggcctgcggggagcagagagaaggcgtccattgcccattgcactagctagagacacacccatctgccttcttccatttacctttctgcctggggtttcctttcagattccccacctgaaaaggggacacattgaggactgtgggcactggacacagatggacaagtaaggaggttgggggctcctggggtcggggagagcagggccccccgttcaccttccataaaagctttcctggtttcattgtgctggctttggcctggcttagccactcatgtcactcacctctgccttcgagttggctgggtaggtgcagacaagtgtgaatggctatttttttcttttacttctccctttcccccaggccaaccgaggtgaatcagatcctcattaagtggctggattctgatgcccggaacccaccggtggtctcaaagatgtagaacgcagcgtgtgcccacgctcagcaggtgtgccatccttccacctgctggggcaccattcttagtatacagaggtggccttacacacatcttgcatggatggcagcattgttctgaaggggtttgcagaaaaaaaagattttctttacataaagtgaatcaaatttgacattattttagatcccagagaaatcaggtgtgattagttctccaggcatgaatgcatcgtccctttatctgtaagaacccttagtgtcctgtagggggacagaatggggtggccaggtggtgatttctctttgaccaatgcatagtttggcagaaaaatcagccgttcatttagaagaatcttagcagagattgggatgccttactcaataaagctaagatgactatgctgctggctgtctttgttcttggagaggtggagtgactgttcacggagaa

SEQ ID NO: 37215 - DNA, 3357 bp, Homo sapiens
ccgagcgccttcccggtgaccccgcagtgggtgtgtgaggggaggacggacagacccagacgccgccggaccaggaggacgctgacgaggcaccatgcgtgagatcgtgcacatccaggcgggccagtgcggcaaccagatcggcgccaaggtgggcgcgccgcagcggagggggtccaatgggggcgcgaacctgggccgagagcccctcggggtccccaggcgcggtcctgggaaggcctggggatcgccaaatgcagaccttcctggccgctttgtgccgccgagtgtggcctgggctaggaggtgactttcgcggacggagggggcacctctctttctttctgctgtaactcatttggagtccccgtcaccccctcggcctccctccgcgctggctgcttggcaggcacgcgtgcctggagaagacgagggtgtgtccgcgaggctgtgcgcggcgctccgcgcgaggggctgggacaccaggaggattaattgtactcgcttgaaccggagtcgagctgccgggggaggggaggagagcgattgtcttgcggtctcaggacgtgctttgaatctaaaaccgcggtcctttagctcctttgcgttcctctttccccgcccacccgctcctggcgggctgcagtccctgtgccctcgcctcctgccgcagcctggggctgcgaccagtgcgccaagctccgccactgcccggctttggctggtccttaccccctcgacccctacctccccccgcgagcggcagctgtttgcctgggaaacgcccagtttcaactttctgaacctgcaaaatacaagccccgcggctgtgcccgggtcacgacgccctttaaagcttcaagctcctgaaatgttgggttgtcggaactgagtcggggacatttcattgtgagccttggcgtttctgggggcatcgttcatggctaaatgcagcctttctgtctcagttttgggaggtcatcagtgatgagcatgggattgaccccactggcagttaccatggagacagtgatttgcagctggagagaatcaatgtttactacaatgaagccactggtaatcacccttgccccacccccactcccttcagtttttccaccttctcccctttcccttgcgtgggaccccaggggtgtggccctgggagagggtggactattcagtttaggatccccgctctttccctgcagtatttcattgggcttccttatgccaacagagccctttgagaacctgatggtgggtctccctttgtttggggcaacatctgcatgatggcagcaggcgccaagcccttctctgcagaggtccttgcctgagggtctaagtcactgttgttccttgcaggtaacaaatatgttcctcgggccatcctcgtggatctggagccaggcacgatggattcggttaggtctggaccattcggccagatcttcagaccagacaatttcgtgtttggtgagtgcctggtgtggctgagagcatgagggattcattttacgctgggcagtggaggctgaagaggtgtgattgccagagggaaagcatgaagaacatccgcggtgtgccaacttagctttaatatagtgtaaaattgtttgcctttcagctgctaagagcttggtgtcctggccttccttatttataattatattcatgaacaaatattttaacgtttggccattttggtgataatctgaaatagtcttatctgagcattgactcactgatctatattgaggggtttgaggtaaggtatttagtacaatcaccggtgacttaagatttctctttccctctggcaggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcgtagatgcccccgcgagacgggttagggaaagcggaggaggaaagcgagggggtggggggcttcccgggacgataacctggcagtggaaggaaagaagcatggtctactttaggtgtgcgctgggtctctggtgctcttcactgttgcctgtcactttttttttccttttttgtaatattgatgacatcaatgtaacatttgagatatttctgaattactgttgtaatggctaaaatcacataaacgtttgtgtcggaatggtgtcctctctttctcttcctttttctctttattaacgatttaaatgtaactttctgaacacattgcattgaattcttcctttaacaaaaagcaaaggcgtaggtaaaagctcaaatgaatttattctttcggtatggtaaaattgaaccaatcacagttaagatgagagatcaacctgagttttaaaatacctttaataaatattagttgaa

SEQ ID NO: 37216 - DNA, 33492 bp, Homo sapiens
ggagcagcagggaggcgagcagagggcccccagagggagccgcggaggtgcaggtcgaagaggccgggctacgtcgtgccctgcgcgtgagcagctgcagaggcagaggcagcatccagcggcggcgccagcagttccagtccgttgctttactttttgcttcaccgacatagtcattatgccgaagagaaaggtaagtcttaccaaaaaaagatttcaaaagccttcaaattctgcttacagtaaatgctggcattgcaatggctcgcgcagaacgcgcgcggtagtaacccggggattgggaatctttgctcctccacgcttgtttttagatgcctgttgcagacgttcctctctctgtcccccctacccactccgtcctcatcgatctcttaatgttactttctctccagtgacgcggtttcccttctttttgaactcattctcgctggaatgttttccacccccaacaacaagaagcaaaagcggctttccattccgaaagggagtttcctctttgcaaactgccaggttgcgaattagtgtgaagggaaaacagcgagaggagaaaaacaagtacaagcgtaaggagagggaagaaaataaatcaggcaaatgttgggattattcccatgcggctgtactcgcgggctgggtgcgctgcggtggctcctaggctaagggaaagagaaagccatgtttaaaatagcgctcaccctcctgctcgcctccgctgcagacccgtatgtaccaactccagtgtcaatcagggctggggccggcgaggcggggcctggcggcctggacctacccgcagttcggggcgggagcggtggagttggcagcgtggaagacgggacggcgccggggcgtccaatatggctcgtccaaggtcagggggccaccaggtcctccccagcgactggaacccacactcggttggggaaggcggggtccgcgcgctatccgcccctctgcgcgtctagcgaactggagtcatttttgtcttgtcttccgccccttgcggactgtcctcttctgcgcaggccccggacaccaactactacattcagggacacaaatctccctcggggtggggcttcgacttgtcccggggagggaagggaaaggtttcctcctccctgagaaatcagtgaggatttctcagctggttcctaagcaagtgctttgcaccctcccaccgccagcctcagtgtttccaacagtgtcaacgagtgtgggtattaaatttgaagcaaaattacacctaatgtcttgctttatcaaagaccatggactaatttgtgtgtgagagtgactgcattattttaaaatactgaagttttaaaaattcaaaagctttccccttcttatatgttattactaaaaattgggtagaaacttgtctcctaccccactttttaaaaataattgaaagtgtttaaaagtcttagagtttgttgtgcacatactgtgtccctcacgctgtgcagaatttgacttgcattatctcatttaatcctgaaaacagcttgagcggtgttacccccattcagctgggacttaaagacataaattgtcctgcatctcaccaaccaataactactagtaaagatttaatcagatgctatagatgccaaagtcttattctcacccatttcgtactcacttacgaaagggtgggtcaagaggaattaaggaaatccaaaggtactcccagtttaagaagacagatggcatattaagagcactaatacttgagatttattatttaaacttaattttatgaaggtattttctagccctgttttactagaattaggatattaagtgatgtcaccattttcagcattttgactgagggttaatgatggattggaaattctagtagagacaaaggaactaatcatcaagatacgggttacagagtaagtgagctggaggccatctttttttcctgggaattataaccattgtttacataaacagtaggttaggtgtgcacactttatgtataatggaccctgacgatggaacccttccttgctgtttattcaagggccagagctgctgaaaccattattcttacttcccctgtctgcctctctcaaggagacggaaggaaaaaaaaaaaaaactaaaataacagtaaaattacagctacagttttatttccctggaaggcagggaacccccatgcataagctagccaatggtcctgagactaggggcaaaactgtgtacaggcacctgtgtgtcattcctgaggacatcagagtgttctccggtgatggaaaacctctccttgattaataggaaggctttccatttatacctgaagcctaacgacctcagttggtacctgggcaggaacaacctcagattaaacacggcgatcatggccatccatctatcagtcaagtcttagagcagcctcatggaatcctgaagttcactggaacttatgtgaggaaccactgtcattaggtaaagcctgcttagatacaaaaaagaactggagacaatccatgcatagctcttcaagatcttcaaagctggggtaactgccaaagcatttacatactacacaatatttttcttgactaaagaattgtctgctctacaatataataagcttttaaaatgtccccctagtacttttttgccttcttagccccctgtatcaacctttcctagaaatcaagaaatgttatttaatgaacatctgagtaagttgttctgcagagcaagaagtggtacagataaagtcaatgaaaacatctggaatcctagccctgttgtaatgctgtagggacatacagtttttgccctcttggaacttgtgtttaattcaatgaggtgataagactagcagcacaaaacagttgaataacattaaaactgtgtatgtgttccagaatgtgtagttatagatcccacaagcagtaggacagataaggaaagttaactttaggctggtcttaaaagtgtgggtaggactcaaatatacaaagaagtcagagtcattttttgttaccaggtattcaagtgtgtctcctgattgtatcttaacatgaccaggcctcagttttgcaacttcagggctataatatcatctgaattaatattaaaatgttctgatgacatttctttgtaagttttatgtgtatctttgtgtgtgatagtcataactacattaagccaagtggttttttataaatgccatagtattttgtgaagtaatacagcacttagtgaagagttcttcagtgcatattatctctaagtttgtgagatgtaaataaaagtgagtttcctgtattttttagataatggatggtgggtgagtggaattacaggggaaatgataacattcatggactcagtggtgagacaatgagtgattgagttctagactgttctggccagacatccacaaatgcccgcagtggtcatgttgttatgtgatgatttgatgttctacgaagagacatgagccagcgaggcctagagtcacagtcctggcatgattagcgacaggaaacacatttttacctctttctttttattaatattttccagttccttatcactagaactattttaaatgtctagtgtatcacatcagaaattctctaatgaggcaattttccatgaatgtggcatgtaagcagtcatgtctcttgacacttaaaggtttaaggaaggaaagcccatctgcctctagctttgaaactcaaaattaggtttttatctgtttccttaaaatggaaggcccagtagcagtagcattgggcttattagcacaggggatgcttaactaaccatgatcaaggtttgtgatagttaattttgaaaagaatattacttgtcataacaccaaaaacagaaactgtaaatgaaaacacagataaatttggctacatgaaaatgaatatttcaatatgggaaaaaaaactgttaacaaaatttttaaatttatgaaaaactgggaaaaaatatttgtaccacatatcactgaaaaaggtttgctgttttaaaaagatagcatctcacatttccttatggaaaagatgtatatctttataggaaaataatgaagactcaagtagacagaaatgtttggttttactagaaatcaaagaaatgtacaatattaagaataatgagatgtaatttttaaaataaccaatctggtttaaaaaaagattaaaaacctactggctagtgctgagggatatagacactcagcactctcagttatgagagtataatttcctttaaaacatttattgagtataatctacttactataaagtccattcatccattcgaagtatacaattcagtgatttttagtaaagtatagagttgcgcaaccattgtcataatccagttttgtaacatttccatcattccacaaaggtccctcatggagtttatagccaatccccactcccagcctagccctaggcactaatctacttttgctgtatctagatttgccttttctggaaattttatttaaaagaaatgatacaatatgtagtcttttgtgactgattttttcactcagcatgatgtttttgagatcagtttgtgttgtagcatatatcagtacatcattcttttttattgtccagtagtgttccattgtatggatatactcatttttgtttatcctttcacaaggtgatggacatttggattgttccaggtttggattattatcaataatgctgctgtgaatatttgtaaataagtgattgcatggacatatattttcatttctcttgggaagatttctaagagtagaactggcaggtggtatgaaagtctatgtttatcatttttttttttggaggcggagtctggctcagtcgcccaggctggagggcagtagcgcgatctcagctcactgcaagctccgcctcccgggttcacaccattctcctgcctcagtctcccgagtagctgggactacaggcgcccgccactacgcccggctaatttttttgtatttttagtatacacggggtttcaccgtgttagccaggatggtcttgatctcctgacctcgtgatccgcccgtctcggcctcccaaagtgctgggattacaggtgtgagccacggcgcccggccgtctatgtttaacgttttaaggaacctccaaactgttttccaaagtgcatgcgttctaatttcaacatacttgttcatacttggtattgttgattttttgcttatagagattcttatgaattttaatttatatttctgtaataactactgacaataagcatcttttcacgtgtttactagcataatgtgtatcatatgtgaaatgtctattcagatattttgcccatttttaattgggttgtcttattattgaaagagttctttataagtctgagatacaagtcccttatcagatatatgattcgtagatatattctcccagtttgtgacttaaaaatatatttttttcttaatggtgtcttttgaagaacaaaagtttttaattttgatgaaatccatttagtgttaatatctaataaatatttgcctaattcaaggttatggatgttttctcatagaggttttatacttttaactcttatatttaggtatgttatccattttgaattaattttgtgtgtggtatgaggtaagggtttaaattcattttattgcttgtagaaatccaattacctcagcaccatttgttgaaaagaccatcctttctctactgaattgcctacgcacctttgttgaagctccttcataaatgtaaaactttatttctggacactcaattatgttttatggtctgtatgtcgttcttataccagtgctacactatcttggctaggtgagcagtggctcacacctgtaatccccacagtttgagaggctgaggcaggaggatcacttgaggtcaggagtttgagaccagcttgggcaacatagcgagacgtcatctctacaaaaaatttaaaaactacgctatcttggtatcttgattattatggttttatagtaagattttaaatctggtaatgtcagtccttcactttttgttattttttcccaaaattgtttctggctattcagtcttttatgttttcatgtaaattttagaatcactttatacatttctacaaaaataaagcctgccattattttgatagagattgaattgaatctataaatcagttaggaaagaattgctttcttagcaatattgagtttcccagtctgaatatgaaagggcctgacatccataaatgcttgctccatttgattgagttaaatattgatatggaatctatgtttgagtaaaggctccaaaatggcagggctgtacatttaattattcatttgctccatgttaaacattcattgggcatcacctttatgcaagataccatcgccttgggaaattaaatgaaaaattactgtttttttcaacctgaatgagtaaatacccttgtttttaaggatttttctgtctgatgggataggtagaacacataaacaagtatttataattcatgccagaaagtgataatgagccacaagagaagctatgagcagtgagcattcaaaggtttggccaggctgaatgtccaaagaagaaacactgcgaaagagtgttgttcagttaaaagggttgggggttatagcttttaaccaccctgttgtgtttcagaagttgtctggcgccatgtttctaaatcagcacaagttatttgattgattacctatttttgatttaattttgttttgtaatcctaattttactttaccatgaagtcattcatggctctgatcttcctttcatcccccatagcacctagcacaggtagtgtaaatatttgtagaacaaattgatgaataaattgttttcaaaggaagggagtaataagtttaatcatttcatactaagtaggtttaattatttcatacagtgggaaaaactctagtatggttctggcatttgctgtttattagctatatgatctaaggtagcttccttaacctctcccttagctgctaagttcctaattctctaagactcagtttcctcttctgtaaaatgggaataatgatatgctctgtttcgttgattatgagaattaactgagatagtgaattcaaagaacttagcccagtgcctgatatgtgtaaaacaatcaatggatgtttgttgtgattatgagatttttaattattaagagaatcacagtgaaataacaggcttctaacaagcactaggcctccactttgtgggatgataaatggtgcacgcagtgagtagtagggagccagcagatcccaccctgatgtcaaattcactgcaattatagaaatacatgtttaatcaccaaataacaaatggagtgtttctgaaagaacagaagctttaatcttgtgcatttttacatggttgatttttctaatggaaaaaaaaatgtttaaaaatatcttcatataatgttaaaattcccttggaagatcaggtaccaagtgatcctcttttcctatatttttctcctaaaacattgcttttgtttacaccagagttaaatatattccactttcctgcagggtacaatttggaaatggtgactgaaataaacaccatttaagctgtctgccttcatagtacctagagtgttgaaatatgatgttagtctcctgagtaatttaaaaatcactgtcgaagttaacaaactaaatcaaaatgttgaattccttttcactggttacttacttattgtacatttcactgtcttcttagaagaattcagtcaaatcacgtaggggttcttggtcaagctatttattgaatccagtattcttctaccctgtgggcatatccagaaacagggctattgagatatgcccaaggcaaatacatattcagtcacacataaagtaaatgatatgcacattcagaagtaggaagatagaaaaatggttttaaacttcgaaattggctccaaaatttaatattttaagagaaatgtcagtaattaacacaaatatacttactactattaaaattgaattaatatcaaaatcgagctatttcctgaatgcctgggtgtaccagacctgagatacgtgttttgtattcataatgcaccttagtttaaataaaaatgtgaaattattagaaataaatgcgagagaagtatatactataatttcatttttcattttattctcacaacagtttaatgaagcaatttcatctcacagctaagaaagaggtctctttctatgagtcagactgtttttagcactttgcattaataatattaattcttccaaccacccagtaaggtgtgtccgtttcccgttctcattttacatatgagaaaattgaagcaccaagaggttaacagacttccccacagcacctgtgataaggaatggctgagttgggatttcactcctgaagtctggctgcagagcctgtgatcttaaccagtgaaccctgcagcctttctcaaacacagaggaaaatattgggatttagtgagattaacaaatttcctctgggtcacacagctaggaagtgatagaaccagcattctaaccaagccctcttttactcaggaattttgctgttaactattacaccataatactttctgtatatgtttatttctaataaccacatgtatttttattttaactacagtgcctaatgaatgaaacatggaggaatcaagagttacgtaaacatgagtgttcatttgtttaaaatatctttattacaatataggctggtgccatggtttctaaatgcctgttgtagaaagttacccaacaagtcattattatttgtgatcctgccctaaggctggcctcagggtgcagttctgttcttggtaagagaggagcattaccatgaaatcttctaggtatttcagtaactagtggactgtagggttgtagacaagatacacatatgcagtttcctcacctaaatattgattgtttagagtattaaaagtctgactctttataattttctcagattccactgtgaactgctggatttgctacttccatgatacattgtcttcatcaatttgctatatatagaataatgggaatactcccttgtgaacaggaacatgtaaatacgcttgcatattatacaatatattgagggattttaatgtaaatattaagctgtcattacttagggactgggtttaaaaaataagtagatgcttttgtttttggaactcgtgaagaataaaagcttaatagctaggaaaatccactggacctaggactggatggatttttatttaggtgtgctagattaccagttgactaatgttttatttcagatgttattttttaaatgtacaagtgatattttaaaattatattttgattattttgaccccatacaatgaaatacaaaatctaccctgagaggtattggttttcttatttcttttactttttgctcactctttgtctctttcttaggtggaaactgtgggatgtttttataatattggacagaattagttaagttctatattgtagaaattcatggtatgaaaagtaaggcatgatgtatatgggagaaaacgtaccaaagacgaagttatcaaaatgtgaagctttaaaggctccttaagttccatatgtattttatttaatacattttttaacaaactatattctgactacttctcattgctttactttaccccttaattacaatttttaattttatttgtcctaagcaaccatatgtagatcacattacagccagctgattagttttgcaaaaatacaaggaacatcataactgtgtttaccatttgccagaagttaatgtatgtccgagcaaacaggaaaataataaagtaaccatctggtaacatctcttttaagagccctgttataacaatacagagactttggtctagtgtgaattctgccactttttacctcgggaaggtcacttgacgtcttggaagctctactcttcatctgtacaatggaaatattaagactgtgcccctgtttatctcagaaatattgaaagcatcaaatgcaacaaccatatggaagcacactgaacatgtaaagtactacaaaaaattatagatgatttggtgtatgtttttggtttcaatactgagataaaaacaaccagatccgtgcgtatgactttttaaaaacccagaataatactaaaattttgttcaactcaacataaactatttttaataggttattgtttgttattatttcaagaggctcatgaatgatggagaataggaagcactcctttacatatcatttgttctttggctagggctacaggttaaagcatttcccaagctggaaggcttttgctcttctagaatcccagatctgcacccagttttgaaattaagaacacttaacacaaaccactttgaatggtgtagtggataagagtatgaactttgagccagcctagaagagctgaattccagctcttctgttaatacttaccagcaagattaccagctgactaatcttgggcaagttattcaacctctctggccacaattcctagttaataaaatggatataatcatgttttaccaacctcataagattgcggtgaagattaaatcatttcaatcattgccttgcacataattgcagtacacatcttcattattctgctgtgctccttttcctttgctttcctgataccccagtgcttggcattcccatgatgtacacatggcacttctatagtgtgataaataagtacacaagtagctaagttagtcaggtgagtgagatcttaaggtccatcttaactagttttactggtgaagaaactcaagtctagagaagtcaggtgtgagccagactggaattcaggcttctgattgagccacgtgctttctgcatggccatgtttgtacaaaaccacagcacataaaaaaaaaaaaaggtaactctagtgaaagggacagctcagaccaaagaggtttaaaatatttaaacttctttctttttttgagacaagacaggctagagtgcagtgcagcctccacctcccagggtcaagcgattcccacacttcagcctcccaagtatctgggattacaggcatgtgccaccatgcccagctaattgttttttgtgggtgtttgtttgtgtgtgtgtttgtttgtttgttgagatagagtctcgctctgtcacccaggctggaatgcagtggcgcgatctcggctcactgcaacctctgcctcccaggttcaagcaattctcctgcctcagtctcctgagtagctaggactacaggcatatgccacccggcccagctaattttttgtatatttagtagagatggggtttcaccgtgtcagccaggatgatctccatctcccgacctcatgatccgcctgcctcgacctcccaaagtgctaagattataggcctgagccactgtacctagccttgtgtgtatttttagtagagacggattttgccatgttggccaggctggtctcgaactcctggcctcaagtgatctgccctcctcagcctcccaaagtgctgcgattacagatgtgagccactgtgcctggcctatatttccttaatattaaatataaaccctaattattgaattgtgtgtatttacactaataaagtttcactgaacatactggcacacaactttctttatttttagttatcttttatatctgattgcaagagaaatattttccctgcaaagtggtcctcagaaaagagagagttgctatttatttcagttcaaagtcttctaaagaagcgttcttaattactacttttatcttgaacaataaaataacatttacaaaagacatagtagcctgcagtgaccttaatcaatgtaatttgagtttatagaagtcacctgttggaattgataagccaagcaggggaggatatggaaaataaatttaacgtaagtttgattattaatcccatgaagggacctctcaattccaagtattggatatttaaagattactttaaaagcaatgtagtaatagaggatcccagacatacacctacaggatcaatgaaaaacaaccaagccattgttaaacatcgcttggtggctttgagtaaaacttccagtgtctgtttaatgtgtcatagaagtatttgaatttaaggagactaccttttaactcaagaaaccttataagaatttcatggacagtgccctcatttgtggagagaattaaccttgtgttaagtagttatgtgttcattttagctgaagagcgacagagttaggtataggcacatttcagaccttctcgtggtgtgttatttgaattttttggtgccatagtggttttctttttaaccaatttaatactggactgcttttttccccagccttgagtttgtaactgaaaaaaaacaataaaagtaataattttaaaacattggccagcaaattagaaaaagattatctcaatgtaatacactccctaggttaaaagaaatgattgttggtctctttgcactgttatatataccatcagcttttcctcgttagcatggataacctaggagttgagattggatttattctggggctgctggcaaatggttatttgagtttcataattactgtaggccttcagctaattcgctgaagtcgtaaaacaatagcctttgtcacttaaactcttagaagtaaaactctaagtaactaagagcctatgtgtaccaatgaatttgtactacatgtaccaatacatgtaccaatacatgtaccaatgaattggtactacatgtaccaatgaaggttttttggaagtttaacataagaaaggtccaacactgtgctgaaaatcctgagccctcctctttcttgtcttccatgggctgaagatcactcctagtgcagtagcgttaaacttctctgcctcctgcctctccctcagtgtccttctccacactaacaaagccacagactgctgccatctaaagccgttcctaagcagctgttgaaagggtgtaaggattttcttacactcttctgataccttcttgagtttggagggagaaaattgggctcatcaccccacagtgcctgtttatgttgtggtaagcactgtttacatgaaagaaggtcagcaaaccttgttgattcttcatggatggcctatggaataaaaattccaagtttcttcccttggtttctgatagggactgctggaaagacttaaggaaaatacagttctgatcccttcagtacatttgagtgttctgcacatgcaggacccaggcatctttgtgtaaagaaagaatggggatggcacagttggtcagctgttgaaggaatccacactccctctgcccatctcgactcccacactccttcaagagttctgagtccagtgccttcattatcagtacaaatgaagcagttatattacatgtcttgtacagaagaggaggcaatataaaccagattgatacgatattgaagaaatagaaaaaatgctgtgagtaaacctagttatgtaatttgtattagggagtagatatggtactgtttttaatagagtaggtttgcttttagtctttttcttctccccagtatggataatatttttatttagaaaaaaacataaatacagagaaatccaggaaataatataatatacctatttacccaccactgagaattcacaaattggagtcttttaaaaatcattgttcatttcaggcctttttagaaaataaattattaaagttcagtttcctttgaaacatccccttggttcctttttccttatcatcccccctaaagataaccatcatcacgaatttgttgtgtattcttccagttcttgcttttatacctttatgacacatccatccatccatccataatattgatttgtgcatgttctaaaatttgtataagtggtggggcgtggtggctcacacctgtaatctcaacactttgggaggccaaagtgggtggatcacctgaggtcaggagtttgagaccagcctgaccaacatgatgaaaccccatctctactaaaaatacaaaaattagccaggtgtggtggcacgcacctgtaatcccagctactctggaggctgaggcaggagaatcgcttgaacccaggaggtggaggttgaagtgagccgagatcgcgccattgcactccagcctgggtgacagagtgagacttcgtctcaaaaaaacaaaaaaggcaatttgtagaagtgtagtcctgtacatgtattactctgtttcttccctctgtcacttgtcattataatggaagggtatactatgtctaggtatattgtgattgctgatttatttggactttttatgttttctattctttgttttcctttgttttttactttcctgctttttattggtaaatatgttttattccacccctcctgatttggaagtttatagatcctatttctgttcttacattttttaatggtaactttaaattttattttaacaaagtctaaaattaatctgtatctgtatcatcctccagaacaaaaccaggaccatagtatcctttaacttcttatctaccgaccccacttctatctttcatgattgtttttgtctaaagctgtgctatatggtagccattagctgcatgagtttattaaacacttaagaatgaggagctgaatttgttatttaattttaatcaacttaagtttaaaaactgatattagaatcagcgattggtaaattataaatgtttggagcaacctgggtaaaactactgtaagttttatgaattctaaatacagattagatgttcctgataaaaatttagcatttgaataaaaatgtgttctaagtataaaacgaacaccagattttaaagatttagtacaaaaaagtctgtgaaatatctcattaatctttttttgcattaattacagggtgaaataataaagttttagatatagtcagttaaataaaatattaaaattagttttacctgtttttatgcttttttaatgtggcaattagaaaatctaaaattatatgttgtatttctgtaggaaagaactgctgtagaatttctgttgaaacttaaaaacacaataggtaatgttgtttacgattagtggttaattaaatttattagtatattttttacatttttttcttacatagttttccttccttctagatttgtttttcttattactaaatttgaacctttagtaatagattcttgttgaaagaaatgctttgttggaagtgaactctctttatgtttgtattctgaaatggctttattttgccatcactcttgaatgatagctaggtatagaattctaggttggcagttttcctcaactccttgaatagtactctatattttcatacatttgtatttgttgttggagaagtaattctttataggtaatctgccttaactctgataactttacagattttctcattttccttgatgctttgtagttttattacaatatgtcctgttgtattattttgtttgttttgttttgttttcagtttgttccttggtgtgagtgttcaatctggggagtcaagactttactttgggaaaatagtcattatgtctttgccttcctactgatacctctttctctgcttctgaaatgcctattagatagttgtggagcttctcaattaaccacatcacctaacctctcttttgttcatccttttgttgttctttgttgcattcttaattcctcagcagtctatggcagttcctactgtgtctggtctagagtttatccgtgttttgagttttttatttcaatgagcctgcttttattagcttcaaaatttctattttgtatgaatcaaaaacattttaatataaaacatacatacgtatgtagtatctaaataaatattatttacataataataaaccaccatctagcttaagaaatataactcttaccaatgactttgtctttcccagtcaaattaccctccctttcctcagcaaaaggtaacctcagtcatgattttgcagttatcatttgttatgcttttctttatagacttttcttgtatttgtattttcaaactttatttaaaatcgtgccatgacttcccttttttgcccaacattacgtttgtgagattcatctctgttgatgtgcacacccgtagttcatttgtgttcactgctacatattatttgattatataccacagtgtatatatccttctgatgacatatgtttaggtcgtttctactttttaattaattttagctaagtatatattttttcaacatccttttattttcatgctttctatatccttgagtttttggtgtctcttttaagtatcatattgttgtataagtgttagttacctatattgtttattatttttaagtcttaaaatctaattgagcaagcattccttccctccccactccccattgttttccttcttggggtgtgccagaagggataagaaacaaagcctagggctggtacagggtgagagcatacaggagtatcctcacataagcagcttccttaaaaggcatgagaaaccaacaacaaaaagttaaaacgtctcttgcagacgtggatacgtgcatgagacctttttatttgaccatgatttgggccctcttgaccattcttggttcaaactggattagtgtaagcctgttgtgtcctggagagtggggcaagagccccctttgccttggcagtccctgcatcccgtctaactctcctcatctttcacatccacctgccaggaggttgaagtacatctgagatcccctatatccacccccagccttttgtttccctcctttctatgtttttattcttcgcaatcccttggcacaaaaagctttgggtttctgttttaatcccttaaaaccatgctctcttccttcctgtctccggcctgtggcttagtgttaattgatggagagggttatgtgataagacagcttataatggtaggtctttccaaaatagtctacctgttactctgtgcaacaaaaacagataaccagtttgcagggaatctggatgtaaggaaatgtgctcaactttaaggctctgttgaatatagtttcatactgtataatttagaagactaaagatcttttttattgcataacctctgtgtaacaatttacagtttatgaaatgctttctccagtatctcacttgatcataagcagtaccctttgagttagctgtcattatcatctatcattcatggatgaaggagactgagccaccgtgatcaagtcactgtcccagatcgtacagcttctaggtatagagccaagattcaaaccaggtgtcttgagctcacatcctgcattcataccattgtatcacactgatccccggtaaagattgattgttcctgactgcaggtgtattaaatgcttgctaatagaaagccattgtggtagattgccagagaaacgagctttgctagctctttacatccagagccttatgttcatttgtctgaaggcattcacattttcagtgtacctgcttttttcatgcagtgcctttccaagtttctcttttttgaataatttgcatcccatacaaacattattaggtcggtgtttagagattgaactccatcatattgcctgtcactaatccactgcatagaaaaatatgaaaataatgtcattaacatcagtttttcttataatagctatgtactgctgctttaactgcctatcaattataggtagagagtaccctagactgaaatctactgagtgacctgacaggtctgaatgaaagcccagcactcctagacaaccaagggtctgttgtgtggccagaagggttgagtttgtagccatggaagtgagcaaagaccagtggtccacctaggaattatcttcatatgctcagactaagattttgccatctctaccacaactgactgattaacacaagatctataaacgaaatattcctgtgcaagagagtggggtacaaaaaagagaaaactgtttcttcataattgagaaggttccacggaggaggggagatggttaatttggaaacaagagagaaatccatgacatgggaggttctggaaagagggcatatgataggctctgggtaacgggcagctctagggaatagagaaaggtcactgggtcctttgccttgaagaaaagcttttatctttcctaaagacttttatatatacttaggacctttgttttgcgtacatttttatgacctaagtttttgaatttagccttattttatgtggacttttcatgtatttacatcacctaactttttaattccattcactgttacataaatatgtaaataagtaatagtttacttaatcatttctctattatttactgatacatgagttgcttccacttattccatattagaaatagtacaaataaaaccatatttttacaaagagtttctttttctgagtccaggtaccaaaattaaaattactaggtcatcatattaattctctgtgtctttttcatattgccaagttgttctttgaaacgattatattaatttacagtgtcactagcctcaaacagtgggttttatgatctcttgaattttgttctcattttatcagatgaggcattaccacatagctgttttattttgctgagccaaacatcgtgtcaaatgtcagtttgctatttgtatttttttctaacaggagctctattcagatcagcagcctatttgtgccatagagactgagtattcactttctaactttatgtagtttaaaaatgttaaatagtctagttttctaagtagtttagttgttttaatattatttaataactcttagccaataaaaaatattgggacatgtgcagtgtccaataaatccaaagtacattttactttaaaatataaagaaaatataagatatgtttttcccatagtatacacatcctttaaaggaatcaggtttgagctgttacaagaggaggcaggtgctgccccaggggatggatcaaaacctggaaataaatcagctgagggtggcacgtagcctggctgtcatgccaaggctgggagtttagtagagatgctggagttgataatggaaaaatggtaatctatgataaatttgtcagttcatatcaagaaatgggctagaaatcaaggctaggcaaggatgggatgaaaatgtgcttttgtggttggcctgggctttaccagcatcctgcccttatcttaaaggaatggagtgactggaacaagcaaatggaacaagagggtggctcccaggcattcctgccactgacctctggcccctgttctttaactggaatcatcaaagataaatgaaagtcgcttagggtgaatgcacattgagaacagggaatcacatagttctttcaccatttctgctttaaaagtcgagcagttatgcagctatctaccgtgtgtgtgcatgcatgcacgtaggtgtgtaaaagacataccctgttgtaatttactttttctttgcaaaaaaatctgttggcttgtcttgtcctgggaatgagataactttttaaaaacatttttctaatgtgtgttttccaatttaaatacaattcactgaaatattttctttctagtctccagagaatacagagggcaaagatggatccaaagtaactaaacaggaggtaagtatatctttgacatcctatatttaattatttacattgaaatgtttaatattgttaggattgtctgcatctgaatgaaatgcggacaattgtatgaacaaagtttaatatgaatgatcaaggttgttaagactacctgaaagagcgataagtgtctatatgtagtctcgcttggcctaggtgtgtttcagttgggtatattgatgaggcattttccacttactgtgttgtttatgtttctacctgtcagccctgctttctgttaaagcagatactgagaattccttctgggcaaagagtaagataataggtaaattcatcaaggagaacaaagtctgcctttcacagcaagaaaatgaaagactgttgatctcataaattctgtgctccagtgagtggattataagtcactttttaggttctgaatattttgcctgagaaggatcatctctaaaatcaaaaactataggccgggcgcagtggctcacgcctgtaatcccagcattttgggtggccgaggcgggcggatcacgaggtcaggagatagagaccatcctggctaacacggtgaaaccccatctctactaaaaatataaaaagttagccaggcgtggtggtgggcgcctgtagtcccagctactcgggaggctgaggcaggagaatggtgtgaacctgggaggtggaggttgcagtgagccgagatcacaccactgcactccagcctgggtgacagagcgagagagactctaaaaaaaaaaaaaaaagaaaaagaactgtagagggatacacaatatgtcaaaatattaaagcttttttttaaattgggaacactcaggatattgggataattaattaggcaatgattcaaagatgttttgttttaaaattcagaaacctccaaaagtctagaaacttggaagagattcttggatttgaccatccacagttattattatgaacctctaaaaaaagatgggctaaacagtaggaaaagagatataactttgatgacaaccattccgtttgcacagggctttagaataggtggaaaactgcagctgttacccttgaacttatcaactaaaaggggtcatgggtgagacaaaaacaatatctagttacaggttctttgattgggtgattcataatgtggttaataattcagaggagtttatcgtgataccaaaacccctgcacaagatttgtacaaggaaattcattctgccaagtggaaaatcttaaacagaacctataaagaaataatttaaaagcaaaacaaaacagtctgtccccatcatccatgtacctagcattcactgtttgacagagtttggaataatcatgaagtttgttatccaaaacagagtcatcacacacatgcaagaaccaaccaaaaaatgataaatgcttgaattttcttgggaaatggcaaaatgtgatttttagaacagttggctaagtataactaaccttaaatgtttttaagatttggacaccaaaacaaaagcatttgggtttttccttagggactggcatttaaattgatttgtcagtcaaaaaacctagaaacaccatggcacccagtaatctttgattgtctttccaatcccactacaccaaaagtaaatcaagcttgtgagaatgtatatataaaggatatgtgtgtggttttgcttgtacagctgtcttatacatattattttattttattttattttattttttgagatagcatctcactctgtcatccaggctggagtgggtgaggtggcaagatcatagctcactgcagtctcgatctccctggctcaagtgattctcccatctcagcctccaagtggctgggactgtaggtgcatgctagcacacctggctaatttttttattatgtttttatttttaattgttatttttatattttattttatattatttctatatattttatgtatttttggttgttaataaaaatggtttctagataaggctctacctgtcatttaagccaaggccagattaaaactcatgataatgtcttcaggacatcaacacagttatttaaaaagtgaaaaggtcagttagtttgctgatggtttcgggtaaaaactgtcagtgtattgattgattgattttttttctttcccactggattgactgaattttccagttatgtcattgagtatgcaccaccttgactttagtgaatagataacagttactaagggggattctcttttgaaaatcctcttccactgccatattagaaggcattgtgcagaagatagtacttcaggggacttggacagtaaataaccaaaataatacattatagtcattacaatcaacagttacaaacccttttacatccattattttgtctggtccatatagtaactctaaaatgagaggaaggcagattattcctcaacgaaaacatataagcacctataatgcgccaagcactgttctaagctctccagatcccacagtgaacaaaagaagcaaaaatcgctgctttcatggagcttccttttagtgggagagagagtaaaataaaatgattgaatattagctatgaagaaaaacaaagtaaggaaggagaatagtgaatgtcagagaagtgctatttttgaggacagattgacagatgttatccctattttaactagagcaaagttctcagagaaacatgattttccctgggtgttagaacttgtaaatagcagaaccaggaaagatatctgcatctcctgttccaaaatccgctatccctatggcccttttatgacagtcctaaaaatctggtaatccagtatccatttttctgtcttgtctattcccagccaaggctctgaggtacaaacttttctacttcccagttttgaaaaaaaggcaatttctttttaggcatttttttttttttttagaattaaaagcaacttgacttttgggttttgcttggaggtacatggtcaggctcaggagcaacaacatctcataaaaataaaaatactcccacattccagaggaatagtccatgtgtttcaagcagtatccagcaaagtgcagtgattctattgaatctagctatccctgtgtactttgtcattgggagattagacttctatgttgcttttgcaaccaggatattaaagtagaagatttcatgtctttcagaataggcttcaccagaattttctccaacctaaaggatgatcatgcctatgggatgatgcctatgggataattccactgtgaccagcacctatataccatagtggcaaaccctcacatttgtcgtatctgtttgtcatatttatcaatgatgacttttcattctaaaagccctccttccctccctgagagctagtaaaataattggatattggcaattaaggaaaacaaagcaaggaagggaaatagcgaatgtcagagaagtgctgaggagcagtctctggaccacttttcctgaggattcacaattaaaaaaaaaaaaaaaaaaacaagagaaattcttaatagcttttttttcccctcgtagtcccacccaacaatctgagtctcaaatgagtacttcacatgttagtgttttaaaaaggaaaaaatagcagtctaatctatttcatatccaataaatatagtccaataatttacagattttaaggctgtgaaagctgatagaactttccaggaaggtgtccatacttgtatgcataatcagtactgctgactgagtgaaaggttcatctcagcctccactgtttgcagtgaaaacgaaaatctcttatgatagctactggaaaagaaaatgtaagaaaagtcttttttaatggcatagaaagaagagctgggaaattgtatgtagcaagtcataaaatgattttataatagaagataggatttttaggtactggctggtttagacagcttaggcattttttttttttttttttttttgcattaatttccgaggctttttattttggaactcctgtactggacctgaatttttaaaaggtattaagtcctttggatcagaacagctgttagtcccagtagagcagtgcttagattggaatgtctctggaaatcccaaagagctctctggcatcacttagtctatttggtatgttcaggtcttcacatggagaggaacaacattgtcgcagctggggaacttttcacatgattttgcctcacttcatggagattttattcaagacaactagatggcagatagggaggcagttttgagtaatggctaacatgtttggacccttttcaggccccaaactaaagagtaactgagtagtggctctaggacttcttcccctccctacaagttcacagttgctgtatgtttctggtgcttaccccttctgttcatctcaacacttattgagggcccctgctacatattggagccatagaaatataagagaaggtggtcctgtgcaaggaggtatggagacgtgtcagatgaggtgaacgtgaggcaagaccagcatggtgcacatgagttgacatcaagtggagagagagtcagataaggctctttcacctctctttagcatggagactgtcactttcatcttggaaggtattgttctgcctgctgtagtttatgagacatggatagtccttgaggccacactgaagcttcaaagctgagctctgttgggtaattggaaggtgctctttgctcctctatgctcagaaagtacattaaaaaaacacaagatacctcttattgcccggtttacttgaaaatgttgccttcagtatacttaatacggttaaccatgctgggaaaggtattgcaggatttggattctggttcccagggacttatgggtgcactgtcaagaatgcacccttgataaccatagcaggcactatggttcctatggagaatctgacacacactcctcctgtactaattcacagggctatgtgctgagttgtacaagcttttactctgtgcagtgagtgtatcccacccaatcacttaacctgcacagcctttcattctcagcacattctcctagctggccttaagtccagctctgatctttcttcgagactccagggttaaaagtattcatggaggctctggcccttcgtttccttctgtagtttaaagaaagatgagtttagcttctctggctattttcagcaagaaagttcttagatgtggagatggcaagaaatatttcttccagtttggcctgactggctgacctagactgaccttagccccacttcaagaattccatgattcctcataattatggcatggattcctactgaccatttttgctgtcccccttaggaagaattatttgaaacatttaagctattgtaatgaggcaaagtctgcataaggcagtgagaattagggaaaggcttggattcatttattcagcaaatactgagtttgtactatatgttggccagtaccctactgtactggagatggagcagtgaataaaacagacaaaaagtatggagtatttatttctagggcactttttttaaaaaggcagttatgcttttagaatgtgaaatcccttggggagccaccgtaggttggatggtaagtagaatatcaattttgtgtgttattgctgaaatgcctaggacagttctgttaatttagattttcttttcagggtcatttgctgttaacttgtaatatccttgaagaaaaaaagatttccccaaaatatcaatttctacacagtttctctgtaaattttctaaactttgaaattaaaagaaaaagtaatgcacttttaattctggttaaatcctttgaacatatactactagataaatgtgtttgttttgttataggtaaaaagaagcctttcttgttaactgccaagatttgtagtcattttcatttctaacatagcagcaagatggggaactcctgctattttggtttctacacaattgcataagtctcttcttgtattaacttaaaagctttagttccatttttaaggagctggagtcagactgaagactagctcttaaatagcacctcaatgttcttgctgttgattttgtcataaaagtagaggttttaatttgggataaagcctaagttgatcttcatttcccttacttattcaccacacccttagttgggagaagccgtttatttgaacagtatacctacccctttttagaaacacttcctcttgagtgtcatcgtgcccaggggacttgggatatgtttcactgtgcttacctggagaaggtgatgggaatcatacattatagtcattcaacaaagtaaggtatattaagaatagatttttaaaaatcaacttcgttttatataatcaccaaaaaatatgtatattttcccattccctttgtagcccacaagacggtctgccagattgtcagcggtaagtaccttagaaccacttcagtgttagttcttatgagtacatgttccctttgtccaaagtgaagcagcaaaaggaagattaacatggtttcccatgagcttattttctttttgaaaattacctagggtcctcatgtctagcaaatttgaccagtgttgccaagcaattcacttgatcaaatgtgtcagaaaaacagtggccagccccataacgaagaatataaagcaggatgttgtttgacattgctagatctctgaaacaaaagtagtatattaggcaaagttccagtcttcagattgtacctatgatgtgctgaagtggacagaattctgattctctgtccacaactcatactttagaatgtatgtatgagaatgttctgaaagttgtctgagtccatatactgtagcctcatttcagacctaaagaatctttgtaatagtaataattctactttgctatttggtgtctccttctgtgggccaggagattcttgtggggttaggatacaagctgagatgggcagatgtggctgagcctctgaggtggacatccttcagctcttcctcaccaacctgtgctccttactggttcttatgctcttctcttttgctgctctcctgagagattagctggactctagtggaggattttggttaaaattcctgcagcccagacttcccactgagaaggtagagggaaaggcattggcattttggctgacactatattagtatatccccatactagctattacagaagcttcatgctactttggtcttcaggaaagcatggatttcattctcaacccaaatctgtgcctgatacaatataaggaatcaaagcaaaaatgggtattaggaccactcacaagttcagaaatacagctgtttggatcaggcaagccagtgtttcacgtgagtctcgtaaggaagtatattagtctgttttcacactcactgctgataaagacatactcaagactgggcattttacaaaagaaggaggtttaattggacttatagttccatgtggctggggaagcctcacaatcatggtggaagacgaggagcaagtcacatcttatgtggatggcagcaggcagagagagagcttctgcagggaaactcccatttttaaaaccatcagatctcaccagactcattcactttcacaagaacagcacaggaaagacccgccccataattcaatcacatcccaccaggttcctcccatgacacatgggaactgtgggagttataattcaagatgacatttgggtggggacatagccaaaccatatcattctgcccccagccccgcccaaatctcatgtcctcacatttcaaaaccaatcatgccttcccaacagtcccccaaatcttaattcatttcagcattaactcaaaagtccaaagtctcatctgagataaggcaattcccttccacttgtgagcctgtaaaatcaaaagcaagttagttacttcttgggtaaaatggggatacagatattgggtaaatacatccattccaaatgggagaaattggccaaaacataggggctacaggcctcatgcaagtccgaaatccagcagagcagtcaaatcttaaagctccaaaatgatctttgactccttttcttgcatccaggtcacgctgatgcaggacgtgggtttccatggtcttgggtaactccgcccctgtggcttttcaggatacagcttccctcctggctgctttcacaggctggcattgaatggctgcagcttttccaggcacacggtgcaaactgacagtgaatctaccattctggggtctggagggcagtggccctcttctcacagctccactaggcagttccccagtagggactctgtgtgagggcttcaaccccacattgcccttctgcactgccctagcagaggttatccatgaggaccctgcctctgcaacaacgtctgcctgggcatccagttgtttccatacgtcttctgaaatctacgcagaggttcccaaacctcatttcttcacttctgcacactcgcaggctcaacaccacatggaagctgccaaagcttggggcttccacacactgaagcaatagcccctgtaccttagccccttttagtcacagctggagcggctgggagacagggcaccaagtccctagactgcacagagcagagggaccctgggtcaggcccacgaagccattttttcctcctaaactctgggcctgtaatgggagaggctgctgcaaaggtctgtcacgtgccctggagacatttttcccattgtcttgtgcataacatttggctcctcattactcatgcaaatttctgcagccggattgaatttctcctcagctcagaaaatgggattttcttttctttcgcattgccaggctgcaaattttctaaacttttctgctctgtttcccttttaaaactgattgcctttaacagcacccaagtcacctcttgaatgcttttctgctttgaaattttttccaccagataccctaaatcatctctctcaaattcaaagttccacaaatctctagaccaggggcaaaatgttgccagtctctttgctaaaacgtaacaagagtcacctttgctccagttcttaacaagttcctcatctctatctgagaccacctctgcctggatttcattgtcaatatcattataagcattttagttaaagccattcaacaaatctttaggaaaggtcacagtcattcagcaagtctctaggaagttccaaactttcccacattttcttgtcttcttctgagcgctccaaactgttccaacctctgtctgttacccagttctaaagtcacttccacattttcattatctttcagcagtgccccactcttctggtaccaatttactgtattagtccattttcacgctgctgataaagacatacccaagactggacaatttacaaaagaaaaaggtttaattggacttacagttccatgtggctggggaaggctcacaatcatggagaaagacaaaaggagcaaattatgtcttacgtggatggtggcaggcaaagagagagagcgcttgtgcggggaaactcctgttattaaaaccatcagatctcatgagactcattcactaatcatgagaacagtgcaggaaagacccacccccataattcaatcacctcccactgggttcctcacatgacacatgggagttgtaggagttacaattcaagatgagatttgagtggggacacagctaaaccatattaggaagaggtgtcagtcactaggaggacttaagagctggggttgctgttgtgaatctccaggcagttaagggaacagaccttgtaagtcaaatgaaaaccaaagtttaaaacaaagcttttcctgagcaccagaaaccagcaatataagcaccttccactgagatcattccctgtgctaccgaaacagagcctcctcagaggccagcaggattacagactacaaaacctcatttcctggtcctatcaaaacacttgaatgctgggtcagagggaaaggtctgtcctacagaaaataatataaaaggaaattgtttactgtaaatggagaaaacatgtatattaatacagtatatcaaagcttaggatgacaaaatgttttaaattctgaaaatgtaagagccatgaaagctgctgtatttggcctgcagatttagggtgataagaagattaataaaaacatttcttaacttttcaagctcgattttctttttttatttgaaaggtcatttctaacagccaatcttctgaaatcaaactgtctacaatttcactttatgcccttgatgaaaaggggcagattcagtgtgaacgtgaattacctagaggcactagggaggaacatgtatttttctccatagggggagaccctggccagtgttttctattttaaaaccattcttctagtgccaggagagatgtacacttttttctagttctatgagagaaatatttgccctaaaatatccacagaaaactcctggtgtaaaatggttatctttccccagttatccgcatgtgccacctggtctcaggcccctgggaagctggccagggctgaagcattgtgtggcagagggtccatggtcacacggtgtgcaggtgctgctcatgggaactggaggaggaccacatgaggcaagagaaaaatagtttcctaggggactgtttggctaataatatctgtgaaaaatttaaactttgggagctaacagtagacattttatcattataatgatgttctcaataaaaacctttagacacaaatgagcccagcatatctggttagacaagagattctcaccttgagctggcattggggagaataaaagtaggaagaagcttggcaacagaactcgaaatctacattagaagtggaaggatttggaagtgattttgaaatacttcacaggcagcagtcttcattaccagttgggctttgctagtgattgtgctgtgatttctagactgttaggaaggccagtgcaactgaattcattgagtcctttggccatgggcctgagtcattcctcttgctgctgtgctgtgataaaaggaagagcagacacattggagatagaagcttagacctgttcccggagagctattctggaccagggaataaggagtcggcttttcaatctcacctgcagttcccttgtgaacccagggtgaaaatagttatgaaatgcagagatctttatgctgttacctggtgctgaaaataggatgaaatactttttaatgaccaaagccatgtcaaaatggatagttgtctttgttagtccttttgtgtttcttttggtgctgatagttttttttttttttcagtatttgtgtaatttaaattatctttgcagaaacctgctccaccaaaacctgaacccaaaccaagaaaaacatctgctaaggtaagaagtgctgtttcccacttttggctttttaaacaatgaataaattataattccctacctcagaatcattcaaagaaaggccgtatttaatgatccaaactgaaaccattaccactgttacgggcttgcttaaaggcataaagcacagttttctgcgttaataggagtgtgttttccatttggtcagtgaggcacgggaagtcagagatgttgctctgagaagcctcatgtccgaagggggtttggcagcagcctcgtgaacatgcggttcatgcggcacacagcggggatgagtttgggccctggcagcactgccccactatgggaggaatttgggaaggggcttctgacttcatctaactggatttcgcaggccagtctgaggtctaataataataatataataatgccagcaggtaatattggcatttataaggcccttatagtatggcagataaggttgattgctttactcatatgaccttcacatcaactctgttgaagtagatacaaatatcctgttttgcagatgaggaaactgaggtacagaattcttagggaacttacccaaaatggcttttctgcactctgccctttggtattgtcccatgtgaattgtttaaaacttatgtgtatagtggcatgagtaggtgatttcagaaacagaactcacttttgttgtttggtcttaaaattaggaacttttcttcatctgggcttcatttccctgcaccttcccagctttctagtcatgcaagccacatgtctccacgtgaggggttcattggaaagcagccacagagccaccccctggctgggttcttccccagctctgcttcctccttccccaagtcctgcagctgctctctccatggcagaaccacttctccccttactggaggggaggtccactgaacaaatccaggagaggaatcattgtgttttccacagaagagaaagtacactggactttctgtgcaacctgttactacattttcacagagactcatatttgtgcagtgtaactcagttgaaacccagcaaaattaggctcccgtgtctccataaaggccaccatgatggtaacggttgtacttcaccttgtgtttggacagaggctgattgattttagccatcatcacaccgtgtctaacattctctttcactgtgctttgatcctctgttagaaagaacctggagcaaagattagcagaggtgctaaagggaagaaggaggaaaagcaggaagctggaaaggaaggtactgcaccatctgaaaatggtgaaactaaagctgaagaggtactttccataaatacctcccactgattgaatcagtgtctttaaagaaatttctcaatccttcagccggtgatagcacgttcttaatgtctctttttattgcctgtaatgttattgcagatccacatctctcgctcaactgttaatgtctcaacctccagaggcaccccacccagcacactgtcagtaaaggggcagattgaaacagtgagagttaagggtacagtagaaaattctgcatgtttgcagtgactagaatcagatagtagtgtggtggtttttttttttaatcattatgaagagtgggagcttgcaggtaaggcttctgtggtggtttgaaaagcagaaagcaataaatgaaacaaagtgtttgtgtaatatattcctgccttgtcttcttcactcagagttgaaataggttttgcagtaaagctggaaaaaaaaaagaaaacaaatgttcaaaactgtgtgtgttggtgggtggaatttcctttgcttatagtagtttcagtagtaactatatgtttttttttcctttctttttcacaggcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctgtgtgtaagattgattcagcattccatgcacttgctttaaaatttagtcctgtgcatactgtggtgtttttactgtgcatatttgaatttttcatgcagtttttctagagcaataatcagtggtgcttttgtacctaggttttatgtgattttaatgaaacatggatagttgtggccacctgctgactatttgtggtttaaaataaaaggtttacttgtctgcag

SEQ ID NO: 37217 - DNA, 189826 bp, Homo sapiens
cggggctggcggggatgtgacgggcggcccttcgtctcaccttccgtcctcgggcccgcaggtcgcagggcggcctgcagctgggccgcggccgaggaggcagcgcgacctccgcacggtgagatccgggctcagggccagagccggggccggggtcgcggcgggcgccgggggcagcccaagaccaggcacgcagtccggggcggggcggaggcccgaactcccgggctgaggcggtgtcgccctcccgtacccggcctccagggtgagcctctctagcccctcgcgagccgccggacgcggggcgggcgcggacccgggaggccggagggcgccctccctgcggctgtgacagcgcggggcctcgggccgcgggcgccgccgcctttcaggagaaatcagggcgaggctgaggcactctgatttcggagcctggttgcgtgtgagggtggatagggaaagtaccggggctccccgaatgagttcgattttttttttctttcaattactgggctaaatgaaagacacaccctaaaacacatcctgaggtgaaactttggtggggcacaccgttgccgtaggttcagatcttctctcttgtctttagacatgtattttcatacatttttaaataatgcacctactttcttgataaagtaaaaggaggaatgaagggactcctttgtggtggtccttggtggcgaagcttgtttccatttcagtaattgcatattcatctgtgtgggctccccgaccaatgaggctggctgctcccagacaaggccttagcggagtggaaatgactgacgcagggactctggtctcagattagagtgttggtagctcactcctgtaagagagaaattgagctttaagctttttaaaatagccatatgaaaagcattccttttctcctgagcattaaaatatgacggaacctattcatttggccagttgttttttttaaagcatcatcttttagactagagactttagagatggcagctgctctttaaccaaaaggaacttaagatgctctcctgcaaaagatgggttcaaaacatgtcttatccgtcatccatatgtgataaaaatgtaaatattcctgagtgtttgcctgaaatcagtcttcttcctcttggactttattactgtttctcttaatttatgaaagcttgttactgttattttttgttttcgtttgtgttctaaacaacattggcttcaaataatcttcaggttaaaaatgcacactttgttgaaccctttagccataattcatactgtcgtacttcagcataagccatagttaagaaagcactagaagccatcctgaaagcaagccgaaagtctctattaagaattctgtaaaaattctacctttccacattcagacctgcattttttgttgctttgactcaactcctttgactattttggaggaagggactttgaatccatatttacaagtccttcagtgactctccatagtctatatcgataaaattcaaagtccttcatgattagcggtatttgtctccattctagtgtcatcttctaccattatgcctgccctctctatataagactgttgcagttctctgaagatgacatcttcctctgtggtttttcagtgttctttgttgagaattctctacctagtaaacaacttgcccttgaagaccttacgaaagtagcacttctgaggcttgtctagacatttcatccctcttgtcttaactgattcgtacactctccagttagtatttgtcaactggtagttaatgatttgtttatgtgtctgtctccaccaggttttggggtttcttttgtgttttttgagacagagtcttgcactgtggcctgggctggagtgcaatggcctcatctcggctcactgcaacttctgcttcctgggttcatgcgattctcttgcctcagcctcctgagtagctggaattataggcacacaccaccacacctggctaatttttttttagtagagacgggtttcagtatgttggccagactggtctcaaactcctgacctcgtgatccgcccacctcggcctcccaaagtgctgggattgtaggctggttaggaatgaaaccccagttatgttaaaaaaaatccattttatgatacaggaataaaaagggcatgaccaataaagattgctgcttcattggtcctacaactttattttgaggcgcaaagtcacgcaggtagaaagggatggcggggattacagtccaggtcttttgaccatctgtgtatttcacttttgcccccagtctcctaattctaaatcttaattgttttacaatttgaatgggagttgtgagcgacttggatgtgttctgaaaaaagggtcaatagaatattgaacttgaaagaattaacagattatttggttcaactttaaaaattttacggttaaacaactcagcctaaaaagacaacttgtttgagattgcttaggctcacctacatctcatatctcctgacctcatcattgtgtgtttttcactactccatggtgctttggggtgaaatgaaggagctgccagtttttcagagggagtgcaaatctgcttgcactttctccctctttgaatacatggctgccactcctagggacttagaacccttgtggctgagaaacatgataattcatttggggatatgggagaaacctaaccttcactattcctctcagccagatagttttaacttcagtgcttggggcgctctctccagatgccccataacaagtggcttctgatcaccatatggacatctcacatacagttaagttttgatggtacaatgagattttaatataagaaggttgcagctggctaatagcatggctaaaattacttgtgtggcttgtctgtgagaggagcctatcttactcctatgtgataggattttgggggaaaaaattgatgattgtggctgtctctaaaaagttgaaatgtgtacttagtggtgtgggcctgaccaattccaaaaggctttttatcttacaaacaatggtcaaagaaattttaaaaatcaaaacaaacttaatttttcttcttatttcttgtcatatcagtggttttatatgataaagcatacacataatgcttaatatttgctttcatatttgatgttttatttttgctatagtttttatacctttagatgattatacagtgttacaatgtcatttcttaataattggacatctagattgtttactattttgcagataatgccgttagtatatagctgtttatcattttgcttcttccctttgggctaaaggcccaggagcagtattacaaagtcagagggtatgaaggttttgttaattctgaaaaatattactagatttacttctaaaagatattgatttacagactccagtagagtttggttgaccatttctatcatactttataggtttttgcttttaaaagtttgttttttaaaaatgaggataaggttccttgcagtttaacatcatagtccataatagacaagcaaatgcagtattcttctagttttattttctcctttatttgtccatcgtccataaatttattggaatcttctcaccaattttcattagcactaacatcataaatatattaatctcttgaaaaacatttctgatctattttttcttattgtaggctttatagattttatattattaaatttatttttttatatatatatatatatatatatatttttttttttttttttttttgagacagagtcttgctctgttgccaggctggagtgcagcggtgccatctcggctcactgcaacctctgcctcctgggttcaagcgattctcttgcctcagcctccccagtagctgggactacaggcacgcgccaccacgcctgcctaatttttgtatttttaatagagatggggtaatccctatattatatatttttttaaaaaatcagtgtggctgggtgtggtggatcacacctgtaatctcagcactttgggagggtgaggcgggagaatcgcttgagcctaggagttcaagaccagcctgggctgttaacatagtgagacccccatctctattttaaagaaaaaagataaaagaaaaaagtcagtgatttttgtcctttgattgtgttttttgagaatgaatgccatgtacctgtttgatgcatacttttattttcttaagcttctagaattcattttgttatgtatatatatttggaaagttaatatacaactgagataaaatttcatttatgtgtattttatattatagaaaactacattattatgttttcattcttttttctgaacttaaataggaaaacaaaataacctaactttaatacaaatgtgtacttgttttttaataaattatggtaagttttagttaaactaacatttttatgacagcaatatattggttaattgaaatttttgtctgttcaagattaaccagagggttgtctttaactcttattgctaatcattctaaaatatatgaaaggaaaccttagtaatctgctcccactggggagcaggttactcccattctagatagatgagacatcccaggataatagttaacattgagtgctgggtgttttgctggttcttggcatggagtttcttacctaatcttcacagcaaccctaggaggtaggttcttttagtatcctcattttgtggatatgaaaatatagagactgtgacctgccaaggataacataggtagtaagcattggaactggaactcagtcagcctgcttttaaaagatgctatttcaaaagtattatcttattatccatgccaaggatttggacttcatttcttagacattggaaagattaggtgttgcaaagcaaggggatgatatggtatgttatctcttttagggagattgctcatgtgacaatgtggctatatattgaattatgtttataataggaagtggttgaaatattcatgtgagaaatgaaggctaaaccttgaggtggaagtggagatcgggatattttggaaatatataggaattagtaactgatacacaacagagtgggaaggcagtgtattgatttggaagacattgagtggggtaatgacagatgaatatgtgctcacagcactttgttatatttctttcacagcgttgactgtgatgtattgtacctattctagtaacatatctgtctcccccactggattgtgtgcttgtcaaagatagggactgagtagaggaatgagtgaatataggatgaaataatacagaaaggtcaagagactgaactgggaaacaccaaattaccaaaatgaaagagtgggtggaggaagagtagctctagaatgtgacagctgtcagggaggatgggggaagagccatcagggaggaggcagaggggtagggaagtattagcacagacatgagcatgtagaatgctgccacctcaggctacaaacagttgtggttggtgtgccctgctgtcataagctgattgtggttgtatagggtgaacttgtctttccgttgttattgactacttaagttttctctgagtatctgatggctttctgcctctttggcttctgacttctgcttgctacaggtgctgatgctggggtgtgattcagcctattgagatcaaccaatgagaacagtcctttctttttaagtgaattgaccaatcatagtatgtgagatgtaatttctgagtttttagctcttctctgatgagttgattggtttggaatgtcctagagttacttctctacctttaaagacttctggttgattatattaaggtttggagccattgggaagccagaggattcttaaaggttggatccatgagcactgaagttttttacctgtttattttttcaagttgatcagtagcttagtttcagtatagttggatcatctttgaagactgttggtcttaaaaatgccacagattattccaaataattaagaatctctgttttctttgtactttatagctacgtaagacaggggcttgttttaaattttcttggtcagctcctaacttacttcatatgtctgtttttcaaagagttacttggtaaaggaatttgctattgatttttttctacaaccatttgcttcaggccatccttaccctctgttctctgccttctcctgttttcatctaccctgtttctgtccttgataaggacagtgggaaagggaaaagagaaaaagcatgagggattactccttccttccctttgttatggtagttgttactgctctcctccctgccatcgctgctcccagctgttcactttggcatggtctcctaccctgtatcttgagttctgtgtgtgagaatagaaatgcaaggcatggctctttagctgaggaacgatgggcatctcagggttttggtccttctgtgatctctcttttggtgcctggtattgaaaagcccagtgacatcttgtatctgagcaagtgttttctgttccccagcattctacttctctctctctctttttttttttttttttttttttgagacagggtctctggacccaggctggagtgcagtggtgtcatcatggctcactgcagccttgacctcctgggctctagctatcctcctgccttggcttcccaacctgtactcaacctgtagctgggactacaggcatgtaccaccatgcctggctaattttaaaaattttccatagagacagggtctccccatgttacccaggctgggctgaaactcctgggctcaaatgaccctcctgcttttacctcccaaagtgctgggattacaggtgtgagccaccacaactggccctgcttttctttaaaatgcaaaattaaattccagtcctgtttttttgagttgcctaccctcctccccaacactgcccccatgtcaagattgcaaaacctttgatgacgaaggccctagtgaatacgctagggacaaagaagcaagacagataccagaaggtactttgaattgttgttgtcatcatattaatgatatttcgttgcagcctgagtgctttagggcaatttgagagctttctctgaccattatctcttggcagccagtgttagggttgggagttatataataattttctctgaagatcttagcttagaaaaacagggactattcataatagctatttaagtctgtagaatggacttgatgatattttggtcagagttggtaggccactttataggaaacatccaggtgatatttcttttcggggtggggaggcagggatggccatctttctgttttgttttgtttcttttccttatttaaaattttttctcaggtatattttcctcattttaggagtagtatggtatggcttgtcaacctttatttattattggtactagctagagatgtagacttggccattgttgtggcctttcttgcagtcatgtttttccaggacttgagatgttttacattctaaattccttcaatcctggcttagagaatagattctcagtctggatttttctcattcattcattcaagaaatgtattccgagcacttgctaggaatagttcagtcaacaaaacaaattttctgcctttgtggagcttacattctaatgacaagatacagaaaataagtatatgtgtaatatgtcatctattacattgctgtggagaaaaagcaggaagaggtgaaaagaacatgtgagggtgatgctgctgttttatctaaggtggttagggaaggctgtaataaaaactagtatttgaacagagatcttgaagaaagaatgtgatctatgcagatattaggagagagagagtacttgatgaagatagaactggaatacaaagatcctgtggctgaagcttgcttgacctgttctaggagtggcaagtaggccagtgcaggcattgaggggaaatgattggtagatgaggtcagagaggtgggttgggttggggggatatgcctgatcatatatggcattgtaggccagtgagactggcttttaaaaggtggggagccaccagagttttgacttgttataagtagaactctcagctgctatgtaggggtggcgcataatgagattatttagcaggcgcagcagtaatcctaagtgggagatgatgattttaggcagggattgggagaagtgcccacattttgtatacattttgaagccagagccaacaatttaatgatggattgaatgtgggctgagtttggcctgaaaaactggacaaatggagttaacatttcctgagatgggtaagagcgcagaagaagcagggttttagcgggggaagtaacgagttcagttttggacattttaagttagtaatctgagtggagatatggtgaagagagctgggtatgcacaagtctgcagttcacagcagaggtctgggttagagatatataaatttgcagttattagcagagagatagtatgtaatgcctcgagaatggattaaaataatttagggagtgaatgtggctggagaagtcccacaagttagccttgggatcctgtaatgttttcagagggagagaaactagcagaggagaccaagaagccgcacgcctataaagaaggaagagaattaagactgagttgtatcagtgaagccaagtgaaatgttgtaagaaggagcgagtgagtaatcagctgtgtcagatgctattagattgaggactaagataaagcaatatgaaaatcattggtgaccttaacaagttgtttctggtttagtggtggaagtgaagacttgattggagtgggcttaagagagaattggaggaaaggaattgtagactgctgggatagacagtttcttcaaggagtatgctgtaaagtaaagctaaataacagggtggtagctggaggggatgtccagtcaaggaattgttttttaaaagatggatgctcttctttttttgtattcttatttacatactgtaaaccaaaaagtatctgagacaggtctcaatcaatttagaagtttattttgccaaggttaaggatgcatgccagggagacaagtctgtctttctccaaagatgattttgagggcttcggtatttaaatggaaaaagcaggctggaggggcaggagagagggtattatcacattactgaatccacatgttgcgaaggaaaaggagcaggtaggggaatagttggttatgtatttgttaaggtgaacactgagtagttacccgtggacacatttaactttttatctgtagctatcagcttagaaacaaaaggagagggggctgggcacggtggctcagcctgtaatctcagtactttgggaggctgaggcagttggatcacctgaggtcaggagttcgagaccagcatgaccaacatggtgaaaccccatctctactaaaatacagaattagccgggcatggtggtgcatgcctgtaatcccagctacttgggaagctgagttgaggcaggagaattgcttgaacccgggaggcagaggttgcagtgagccgagatcacgtcattgcactccagcctgggcaacaagacagaaactccaaagaaaaacttaaaaaaaaaaaaaacaaaaaaaaaccccaaaaacaacaaaccaaaaaaaccccaacaaaaaacaaaaggaaaagcagcttcttttgtgactcagcttccagcttacttttttttcttttggcatagtgaaattagggtcccaagtttttactttcacaatacaaatatatgtagttaacaaaatgtttcaacagagaaaaaaaatgcaggatctacgtcgttgaaacgtaaatgaaattaactttatcctcatctgtgcactcaaggtccatcatcatcatcatgatggactgtactgcagttttgtgcagtgcttgccttgtagtagcttcaaaattttgatttagcaacctatttgttatggtagttttacctttttaaaaataaaagttaaattgcagaacaaatgagcaacttttccagggaaattttgacagctactcttctctaccacccctttttttcctaatgtacctgatctcattttactgtaactgcttatgattattgagttgatgtttgagatgaattcagaaactgtgttgaaagcacatattacagttatagcactttatatgcctcttttcgtggttcatttatgtttaagtaaatagtagtcaatatttagtgttggagcatcattacagttgcttcttaaccctcttcattggtctttctccagattttcttcccttagccactgatccatgccccaagttttggatttccgaaacacagatctgaccaggttctgtttttgctaaaaaaaaatcttctgtggctccctattctctacagaagttaattttttcttttcttttcttttttttttgtttttttttttgcctgtttacctaccttttgcctgcacatgctttaggggatctggagtgctccctagggtgtcttgctgtgttggccaggctggtcttgaactcctagtgtcaagcaattttcccaccttggcctcccaaagtgctggaattataggcgtgagccactgtgcccagcctctccaggggattctaatgcacatgtgatgtttcttaccataggactacagagtaaagatcagattttttattagcatacagatagtactccaagaggagattccatgaaaatgagaaatgctttgacatctctctgcttttgcacatactattactttttttttttttaaatttattttttattttttgagacggagttttactcttgttgcccaggctggagtgcaatggcgtgatcttggctcaccgcaacctctgtctcccgggttcaagtgattatcctgcctcagcctcccaagtagctgggattacaggcatgcgccaccacgcctggctggttttgtatttttagtagagacgaggtttctccatgttggtcaggctggtctcgaactcccaacctcaggtgatatgcccgccttggcctcccaaagtgctgggattacaggcatgagctaccgtgcctggccactatttctttttttgtagaataccattcatcttctcagccttctcattaaatcactttatcttttttatttttttatttttttgagacggagtttcactcttgtcgcccagtctggagtgcaaaggcacaatctctgctcacagcagcctccgcctcccaggttcaagcaattctcctgactcagcttcccgagtagctgggattacaggtgcatgccaccacgcccggctaattttttatatttttagcagaggcggggtttcactatgttggccaggctggtcttgaattcctgacctcaggtgatcctcctgcctcggcctcccaaagtgctgggattacaggtgtgagccactgcacctggccatcactttatctttttaagagcccaacatagatgcctcttcttccaggaaagctgctagacatatgttcattatgcctcttccatctgtccttcattatattctgttacttgtgttcctgttaacattatgaggtttttttgttatagtatttgctgtattttactgtttgttttcgtgacaggttgctctcttgcccccacttatagacactcaataaattttttgttgaatgaatgagtaaagcaaataattatccaatgttgacccagttttgattgacccatttggttgggaatttacgccattcaatttgtacagaatatacataagcaattcgaatagtgttcttaaacacagtcatatcctaaagtcttaggaaattcatatttattaaatatttcttttcatgagcaaataatgagacttgttgatgatttattttctatcccatatctctatttttgtctgaatttttttccttctctggtttttttttttcctctttgacgtctctatttggatgttgaccttaaccatcctcttaccctgacactcatcccctaaacttgatccccctcttggcttctccattagtgttttctctgtcaccatcttacaagttatttaggtttctctgtagtatctgtaggtcttacttctacatctgatgagttactgagttcaacaaacgttttttggccacttcctgtgttcccgacttgttagtgttagtaataagaggctgaacaagagaaggtccgagtccacaaatgattatgatacaatgtgataagtatggtaatacagtaatagtggaatatttagggcactattagaagataggaaagaaaaacagtgtttttcctactctcatgtaccactcaatgtaacactttttttttttttttttttttgagacagtgtcttgttctgtcacccaggctggcgtgcagtggcttgattataggtcactgtagccttaacctcctggactcaagtgatgtgccctcccgagtagctgggactacaagcgtgtgccaccatgcccagctaatttttaaacatttttatgtagaggtggggttttgccaagttgcccaggcttgtctcaaactcctggcctctaggatcttcccaccttggcctcccaaagtgttagaattacaggcacaagccactgcacctggcctttgtaactcttttttttttttttttttttttttagaggcggagttttgctatcttgcctgggctggtctcaaactcctagcctcaagtgatccttctgcttcgacctctcaaagtgctgggattacaagagtgagccacatagcacttggccacacagcacctcttacactaaatgtatggagattgttttgctggacaccaagcaattctgacaccatagactccagtgaagaacagctggttgccctatgatttagttccaatctaacactgtctacctgtagatagtgttaaatgctgtaggataaggtctcagtcccacaagatggcgccatcccccccaccacttcagatgcatgctccaggttgtgacctgtgtctatgaccagccataaattggggttcccatgacccccttcttgggttcagttaatttgctagagcagctcatagaacttagggaaacacttcacttatgtttgcccatttattaaacagcatattttaagaaatatagatgaacagccagatggaagagatgaatagggtaggtcatggaaaggggcatggagcttctctgtcctctctgggtgtaccactctccagatatctccacgtattcagctctctgaaccctgtccttttggccttttgtggaggttttattacataggtatgattgattacatcattggccattggtgatcaactcagccttcagtccccttcccccccctggaggttgggggatggggctgaaaagtcccaacctgtactcatgctctggtctttctggtaaccagcttccatcctgaggttaactagggctccccagctagcagtcctcattagcatacaaaagacactcatcactctggagattccatgggttttaggagctatgtgtcaggaaccaggggcagagaccaaatgtgtatgggatatgatatcatatcacagtatcacaggcagcctgggaataaagaatatctctgtcacatattccttattttttactttggctactgccaatctctttcgggtcctcattactgtttagataattgtaagaccttttagtagctactcctgccttaactcttgtcattccagttcctcatgtaccctgtcatgtaccctgtcatccaattttctcagacattttgagaaaattgtcttaaaaagggggaaaaaaatgttacatgcctttccttctcctgttcacagaataaactccaaaaataaaatctagaattcaaagcccttgactcagacttccttttcttgtcttctgctacatgaacctttcatgcagcaaaaccttctacattctgttccaaacacacttcacacattctttttttttgcgttgtgtactactcattcccccgcaacattttacttttgcttcctctgttcacagaaactgtatctatctgttgacatagttcttaattgttaaatccactgtgaaccttagaccatcatgcccatgttcttgaactttctttgccttccaaagcatcgttctcctgtttctctttctctttcttttttcttttgagatggagtctcgctctgtcgcccagtgcagtggtgtgatctctgctcactgcaacctctgcctcccgggttcaagcaattctcctgcttcagcctcccaagtagctaggataacaggcacctgccactacactcagcttatttttgtatttttagtagagtccggggtttaccatgttggccaggctggtctcgaactcctaacctcaaacggcccccttggcctcccaaagtggtgggattacaggtgtaagccattatgcctggccctgtttcttgttcatacctattcttttccagctgtctttactgtctcttgttcatgtagtcagctaattttcccatcttagttaatgatactgccagtcattcaggtgcccaaagtataaacctgggagtagtccagacttctcttatctctcattttccatttgttgtcaagtctttgtgaggtatctcttctctcttcattgtctttactgtttccttgggctaggtctaatatctagagtagaccactataagaagccccgtcagtgtaagtactctacctggtcctgggtattatacaaaacaagtattcaggaaatgcattttggttatagccagtaggaacgccaaacacaaaatatagttttgagttgaccaccctagaatagtgcttaaaccatggactgattattctgtatccattaaaggtcgatttcctaaatatctcaattagatgatgttgttatgaagtaatttttactttttacaaaaaatttacttaaggcttaagaagatgatgtgttagtattacagggaaaaggcaagaaaagttgtatggaaacggctctggctgggatatgtgccagaaaggatcttgtagacattttattaatgggctagaaaagagattaaaagtttgcaggtaacgtttggtgcttatttatccacatgacagtaaaagagcagttaactacaggaagatcttgagactggaatagacaaaatttgagtattagtgtgtggaattgtaacctaatgtatttgactagtactgtgaagatgctgtttaattgtcagttaatacccaggagaagctcctgatatcaatgtgtcatgttcctggaagatactggcataatatgctgatgcttgagatgtggtaacttaatcactgtacctctgcatcatttaatatgtttcataagcacaagctgtttagtattgaagaattattttttgaccccagacatagtcatagaagagccctttagtctcttgaaattttttttggtttgctaatagtagatcttagataggatttgtcttatttgtgccgtcaaagaaaagtccagatttgcagtattttctactttaaaacttaagattctctcattctaaatgtattttgcacatatttcaaaatatctgaatttatattttgtgaatattttacaaaagtattaaaggttttttttttgttagtttttgctgttgctttatttttttcttttttaatgttatcttttgaatatatgtttctttattgttgatctttatttacctctgatgaatttaggggtttatgaggctggcattagattgtcacatggacattaccttggaaaatctatttgagtactctgtattatagcattttgaagttgatagtgggatgtatgtatcattttggcttatgttattctgtccagaggattttccctagggaaggtgggaaagaaaggaagaatgctttggagagaattcccacggtggacaagtggcattttgagtcaagggagtagtgtgcactttggtaaggagtcctgaaagagcatcttatgattacagatcttgaggtggtttggtgtggttggaaggcagggtttgttggttagtggtgagagggagcagctgtaaaggaataccaaagccgcaattcgaaggcttgggtaattttagctgcacgcactcactagctatgtgtctatatgtgatttccctaagtttcaatttccttaaatgtgcaaaatgagaataataaaaatatctacactgtaggattgtgaggtttaaattaggtaacatttgtacctggcacacaagtacttaataaatatcagctgctgtttttaggtatttgtacttcagagagttattgaaggattttaaaattgaagagtgatatgatcggaattagaattttgaatactaatctcaggaaaagtgtaaaaaatggattgaaggggaagaaactgaaggcggaaaattaagtaggcctgtgctagaatactagctagtaagattctagattaagaaatgaggagaggacaggacgggtttgagaactattgcaaattatcacgtgcattatattccatgagttggggagatcttaagggaactaggagaattgacagcaagaatatggacaggatacctagctgagtaagaaacattgtattttcctcctcttaatacaactcagaaacatactttaaaagcatttagtattttgacatttggtactgggacattttgaatgttaccatctaatcattttggataaagatacatgtctatttacacagttttgtttttggagtactttatgtacattcttgttgagtactcttctatttggcaagtttcgttgtggcatttgaaaaactgccctttcccagtaaaatgattagattttaatttgtttactcagttgaatgttcttaccttacataattttacttagattattttataatagagaacaaaggtctagattatgacatgttttcttgtcactgaagtgttccttacgttgtattgaccaattgaactgtgggttaaatataatgtactttaattttaaggtgtggttgagactcaggcccaagatattttactttttattaatcatattttataaaattataatgataattattgaagtaaacaagattttgggattgtgtataaggtcataggcattttcacttgtttgtcagcaacccctagaagttatgtctcctttgctattgaattagagtaagactttctacatactgctgtatccaagggcaaaaaaagtaatgtttagtagagctgcaatcataagaaagatttttcagtgatatttatttcttcacccaatagcttttattaagtgtctttttatgtattagaataatcttttttgagacggagtttcactcttgttgcccaggctagagtgcagtggcgcaatctcggctcaccgcaacctctgcctcccgggttcaagcgattcttctgcctcagcctcccgagtagctgggattacaggcatgcaccacctcgcctggctaattttgtacttttagtagagacggggtttctctatgttggtcaggctggtcttgaattcccgacctcaggtgatccgcctaccttggcctcccaaagtgctgggattacaggcgtgagccaccgcacccagccatgtattagaataatctttaggaattaaaaaaaaaaaaactaaatattttgtgctgcttgtcttcaaggaggtctcagtctagtggagaaagtagaacacaggaaaacatgattttaaaaataaaatagtgtaataattgctatacctagggatacccagctaaaccatgggcatatgtaggaggaacatctaatctgcagatatcacatgatcatgctaatttggtagatttattgctatatattacatgagaagagtagatccagaactgaaaggagtctatcatccagccatctgttacagatcaggacatagtacatttcagagagcacatgctacttcatgggagatggaagattgcaagaagcctcttggcaatcctcatttctttttttttatatatatatatatatttatttatttatttgtttattttattgatcattcttgggtgtttctcgcagagggggatttggcagggtcataggacaatagtggagggaaggtcagcagataaacaagtgaacaaaggtctctggttttcctaggcagaggaccctgtggccttccgcagtgtttgtgtccctgggtacttgagattagggagtggtgatgactcttagcgagcatgctgccttcaagcatctgtttaacaaagcacatcttgcaccgcccttaatccatttaaccctgagtggacacagcacatgtttcagagggcacatggttgcgggtaaggtcatagatcaacagcatcccaaggcagaataatttttcttagtacagaacaaaatgaagtctcccatgtctacttccttccacacagacacagcaacaatctgatttctctaacttttccccacctttcccccttttctatttgacaaaaccatcgtcatcatggcctgttctcaatgagctgttgggtacacctcctagacggggtggtggccaggcacaggggctcctcacttcccagaaggggcggccgggcagaggtgcccccccacctcccggacggggcggctggccggggagggggggtgctgaccccccacctccctcccggacgggtcggctggccgggcgggggctgaccccccacctccctcccggactgggtggctggccgggtgggggctgaccccccacctccctcccggacggggcggctggccgggcgggggctgcctcccacctccctcgcggacggggcggctggcctggcgggggctgaccctcacctccctcccggatggggtggctgctgggcggagacgctcctgacttcccagacgggcggctgccgggcggaggggctcctcacttctcagacggggcggctgctgggcggaggggctcctcacttctcagacggggcggctgccgggcggaggggctccttctcagacggggcggctggacagagacgctcctcacctcccagacggggtcgtggctgggcagaggcgctcctcacatcccagacggggcggcggggcagaggtgctccccacatctcagatgatgggtggccgggcagagacgctcctcacttcctaggtgggatggcggccgggaagaggcactcctcacttcccagactgggcagccgggcagaggggctccttgtatcccaaacgatgggcggccaggcagagacgctcgtcacttcccagatggggtggcggccgggcagaggctgcaatctcggcactttgggaggccaaggcaggcggctgggaggtggaggttgtagagagccgagatcacgccactgcactccagcctgggcaacattgagcattgagtgaaggagactccgtctgcaatcccagcacctcgggaggccgaggctggcggatcactcgcggttaggagctggagacccgcccggccaacacagcgaaaccccgtctccaccaaaaaatacgaaaaccagtcaggcgtggcggcacgcgcctgcaatcgcaggcactcggcaggctgaggcaggagaatcaggcagggaggttgcagtgagcagagatggtggcagcacagtccagcttcggctcggcatcagagggagaccgtggaaagagagggagagggagaccatggaaagagagggagagggagaccgtggggagaggaagagggagagggcaagggcgagggcgagggcgagggagaatcctcacttcttatgccatttatttatatagagtatgttgtgtatgttccttgtctccctgatggggccactactctgtgtaatggatgagacatgatggagtaggttgaggagggagatacatatgaggtgagtttaaaggaatttgaattatttggcatgaataagagaaatctgggactgtcttaaaaaaagttttgggtttttttggtaataattttatactcagagaaatgttgcaagaccaagattagtacaaaaaatatctaaatactctttatccagatttacttgttaatgttttttgccattttcttaccatttgctctctttcatatatatgtatatatgaataggtatatatatgtttatatgcatattatggccctttatctcctaaatacttcaacatgtatttcccagtcatagggatttaaaaaaaaattgtacagtatggacttcactaaatttaacattgacgcaatagtttaatctaccatttgtattccaatttttttttcaattggcccagtcacctttatagtatttctccttccacagactgctttttaaagagcaaagaatgagtcatgagtaatttttagtagaaactttctattaagggcctaaacacaatcatggtgacttaaagttggattcctgttttgatccacatccatgcctcccacaaaccttcctgtcgcagaaaatgacagcacaatcccattaattgttcaagccagaaacctgaagcttatttggtttctcttttaactttatcctttgagtttaacccatcactgagtcctgtagtttctctctcccctatatatcttgaaacccatctattggctgggtgcagtggttcacgcctataatcccagcacttggggaggcaggagggtcacttgagctccggagttcgagaccagcctgggcaacatactgagaccacactcccccgcccacccccgtctacaaaaattaaaaagttagctgggtgtggtggcatgtgcctgtagtcccagctactagggaggctgagatgagaggactgcttgagcccaggaagtcgaggctgcagcgaactatgatcaccccactgtactccagagtgggacgacagagagagaccttgtttcaaaaagaaagaaagaaacttgtttgtacctttctatccatctacttcaaccagcctagtctatcattatttctcatctggactcctaccgactttcctacctgattttttcctgcttctacattttcttctttcctattcattctccacataacagccagaatgatcttttagaaatgtaaatcagatcggccaggtgcagtggctcacgcctgtaatcccagcactttgtgaggcccaggcaggcggatcacctgaggtcaggagttcaagaccagcctggctaacatggtgaaaccccatctctattcaaaatacaaaaattagccaggcatggtggtggcacctgtaatcccagctacttgggaggctgaggcaggagaattgcttgaacctgggaagtggaggttgcagtgagccgatatcatgccactgcactccagcctgggtgacagcgagattccgtctccaaaaagtaataataataacaaaaagtacatcagatcgcatcacgctcgtttatacattaagtggctttccactgcgccagagcactctctgcatagcttaactcttctttagtccacaactttaaaatattctccctctgagaggccttacttgatgcccagtttgttatttttcctaaagcatttcgttttcctttatagcacttatgatttgtaattatttaattgtttttttttctttttctctatttcctacactaggttgtaagtgcaaaatgcatagggaccaggtctgttctgtgcatttttgtatacctagcacattgctaggattatactagctaggtgattaataaatatttgaatatttgagtgaaaggaaacctgagaggttatctaatcttacctcccaccaatttaagagtctgcactatctctgtcaagtgcttatctagcttattttttaatgctttcacagatggacagcttagtgttttatgtagtttactttgttgaataattttgatagtttgaaaagttttagtttttgggctgaaaactgcccttttcttatttctattcattgatcctagttctgcccgtttgtcacaacttaaactattttgaccctacatatagtatcttaaactatttgacagcaaccgttatgtgtgctcttggctttgttaggctaaaccatttataagcgcttcagcttttcatcatgtgacatgtttctttacccttacctcctttgtatcccttttgccagggtagctctaaaagtggttaatgaaggataaagatatttataatctttggtccagtcatctgtgattaaatgatttatagcacattaattcaatgtaatatattgtagcccttaaaataacaaatataactgtagaactgtgggatatatttataaaacaatgatattttaaaagtagaacattaaattgtacctagatagttcatatagctgactctgtgtgtgtagatgaaatttagaagggtacatgaagtaatgagaatagttgtatagttgtgttagggtggtggaattatagggagaagtttttttgttttttgttttttttttcctttgagacagagtcttcctctgtcaccctggctggagtgcagtggtgtgatctcagatcactacctcccaggttcaagcgattcttgtgcctcagtgtccagagtagctgggattacaggcatctgccaccatgtctggctgatttttgtatttttagtagagatgaggtttcgtcctgttggccaggctggtctagaactccttgcctcaagtgagccactcaccttggcctcccaaaatcccaaaatgctgggattatgggtgtgccaccatgtctggctttatttatttatttaagagactgggtctcactgtgttacccaggctagactggaactcctgggcttaagtgatcctcccactgcagccttccgaatagcttggactgtaggcatgagccaccatgcctggcccagaagttttaaaatatagagtattttataattagtttaataagaaaggagaaaatataatgcttggaaaagtcattccaactagaattaagtgagatttcagtagtctgcattaagactgtatttcttttaatgtagttaaagaatgcttattttgtggccttaccacattataataatagccacatttggctagtggctgctgtattgacagggcagatatatgtattgggtaagggcaggtggagaacatttcttttggtacagtgttctatggatagtgccagaataagagattgtgtgggatggatcactcatgagagcaagataggcaaaatggtgacttgtaggctggccgcggtggctcacgcctgtaatcccagcactttgggaggccgaggcaggcggatcacgaggtcaggagatcgagaccatcctggccaacatggtgaaaccctgtctctactaaaaatataaaaaaaaaattagctgggtgtggtggcacacgcctatagtcccaggtactcgggaggctgaggcaggagaattgcttgaactcaggaggcggaggttgcagtgagccaagattgcgtcactgcactccagcctggcgacagaggaagactctgtctcaaaaaaaacaaaaacaaaataggtgatttgtgtccatacaatccttctgaggctcaatcttgaaggtagaggagccaaggtgaggtgtgggaacagggccacaagacatagttcatggcactggccattaggtggcagtgtctcctcaggcctgctagttattggagaagctcttggggagtaggaagaatgacgggggtggggagcagtcttctcggtgagtgggcaaggtttctgtatatataaaagtttgttggtagtatctttatatttcaaagagtacctatcaccaccaccaccactgccgccgccaccacctcctcttaccatattaagtgccactgacaggttcagtggtcctgattcctgactctctatgtgaacttggacaaattacttaactttcctaaagctatttcttcatctgtgaaatgggaataaatatacctatctagtagttgttaaggtaggaggttaaggttaagatgcgataattctttttttttttggagacagagtctcttgtcacccaggctggattgcagtggtacaatcttggctcactgcaacctccgccttttaggttcaattgactcttatgcctcagcctcccaagtagctgggattacaggcatgtgccccccagacctggctaatttttgtgtttttagtacagatagggttttaccatgttggccaggctggtctcgaactcctgacctcaggtgatccacctgccttggcctcccaaagtgctgggattacgggcgtgagccaccgcgcccagcctaagatacaattcttataagtgaatagcacagtgctacacatatacctacttggtaaaaattagttatcgttaagggccctgacagtcatgttctcctcttttgttttcagcagggacggttaagcctttccaccctctggttgcataggaaggacagtttcttgcctcggtcatggagatcctgtatagcctgtcttccatgggtgttcctgtctcttgagatagcagcccgagccagccccaggacattattcatttgtatatactaacatctgttatatgccaggctctgtgctagatgctgagtattaaaaaaacgagtctttaattaggctattgagtatatgttgtagatattttcattatgcttatgtttttgaaattacttgtattgctcaagttctgtatgcttttgttggttgagtttgctcataacgtttagtaagaccgagtccctacttcctgcagccccattcagctgcaggtgtgatttccacacccttcaggtttagccaatcctgacttaggtgggtgaatggggcctgcaattagcatggctaccacaggcacaatgtttaccattcccatcaagctgccactttcttctggacttagctgtaaatcagaacttctgccttcttttcccctttagcattttcagtctcctaatgggactggaagcccatgttgatctcatggtgggatcttgttccaaatattgtccccactattttctttatttttaacctcctctttgagctcttttcctgcagaaaagagggtacaaaataaaaacaaaaaaacaaaaaaacaaaaaaacccaggccaggcatggtggctcatgcctgtaatcccagcattttgggaggctgaggcgggtggattacttgagctctggagttcaagaccagcctggacaatgtggcggaaacccattctttacaaaaaatacaaaaattagccaggtgtggttgcacacacctgtagtcccagctactggggaggctgaggcgggagggttgcttgagcccaggaggtcgaggctgcggtgagctgtgtttgcactacttcactcctgcctgggtgggtgacagagggagactctatctcaaacaaaaaacaaaaaaacaagattacgtctatgttgtctcaagttactttttttttttttaaatagggtttgtttgaaagaatagagtatgtttcctgactgtttatctctttattcttgaacctgctgtagtcaggtttctgtcctcatcttgtctcctgaaactgctttggcaaaggtgaccaaatttgtaaactactaagcccaattattctttttggttcttagtttacttatatgtggaatttgacactactgcttgttatcttcaaagtttcttgcaaattacttttttatttctcttctttactcttggatcatacgttctctgtgccaccccccgccccccgccccgcttccccctcatccattttttaagtgttggtgataccaggactgtgcctttctctccttgttgtacatcttctccaggtgacctcacttgtttttggtgggaaatttgaccatcgttcctgtactgataattcccaaatcatcatcttcctttcagattttgcccttgcatttcagactcctttgaccggtaaacaccctcgcgtatgctctctagatatgcacctcaaagttagcttgatgtgctaagtttgtgatgtttttccccagacataatgtttgccctcaatcaaaggcaaacattatgcctggggaaaaacatcatgtccagtcagacaagcccagaattttgagctctttcctcttatctcccacatctaatcaatcactcatccatttatttgctaaatattatgttctcattttgtgcccattattgtgacaaaaattctttagatttaatattgctgatatcttttgtacctttttgctacaatctttgttgtctttctcatgttgtaactaacctcttaacccatctccccttcttaacccatctcctgcgtacttaaatcaaagtgacttttcaaaattcaggtcagatctttttttttaatggtttaaaaccctttagtttcctaattgcccatagtaaagtccagacttcttagtatggcacataagccactctgtaggctgtatttttccactattcttcctttcttcttatgcatttctgaaaccctgttcactaccattgttcagccaacaacagttttctgaatgtgtcatgctgattctatgtttttgtttatgctcttaggctgtattgttttttcacattcagtgtctttatttctatttaccatttatcttttgaaactcagctcaagcattgcctcctctacgaagccatttatgttatccctctctcccagttaagcactttcttttttgttcccccatgtgctaccccatatactctgctctagcagttatagtacttcattccccttctcttgtctacatgtcttttcccttatattggaaggtcttattttatccacaacctctatcttagagcctgattcataataggctttcaataaatgtttaataactaaatgaatgtattttaagtcattggtgtaatgaaagcatttcttcctttaccagatcataagctgcttatggcaagtactgtatgtaccttctttatttttcaggatcttgtcttatagttactttataaaaaagtgttgtggctgggcactgtggctcacgcctgtaatcccagcacttttggaggctgaggtgggtggatcacctgaggtcaggagtttgagaccagcgtggccaacatggtgaaaccctgtctctactaaaaatacaaaaattagctggatgtagtggcgggcgcctgtaatcacagttacttgggaggctgaggcaggagaatcacttgaacctgggaggtagaggttgcagtgagccaagatcatgccattgcactccagcctgggtgacaagagtgaaactgtctcaaaaaaaaaaaaaaaaaaaggtgttgtattaatctgaggtggaggtttgcagtggattaagtgtggcctctctacaaaggaagaagttgagttctgttagtcctaagcacaatgagatatttgatggttattataattaattcatagaggcaaacattgcacctaactttagtcactttggtatttggcaaatcaagcagattctcagtgtcggtactcgggattggttaaatgctgttaactattttaaggatttttacttttaaaaaatgttaaggtatgggtgtcctagttgctattaagagttgtgtgagcaattatctaaaacattttgtaactaaatcatacagggagccagtatttgaagagcacagtcatactgagactaaaactgcgctatactctatttcttttgtaatttagtatttttttaaaaaaatgttttatgccaaaagttttaagttccttcttcaaaaaaatgaaagaagtaggtgtcgtggatatgcgtagagattgagattctaaattagaatacattattaagaaggaagctatcagggaagagatcggtttcttcattagggttagtaacccaatatagtttgtggagaggtggaaaaaaatcaatatcatgcattagtacctgttttacttacgtaaacaggaacctatgaataggagcttataaaccagttctataggacctcagatattaattgaaatatactgccaattgtgtgataagctgttatacattatgtgtgtgtgtgtatatacatatagatgtgctgataatgtaaatttgaggtaaaaattagtaaaatacctagcaagacactgttaaggaatatgctgtttattcttgcttttaacctacatttgtaaaaaaccagttaggtgccagcctatgtcttagggcttgactgaggcagcagatgattgaaagtcagtctgtgttctcaaagaacttggcctccagtggagggaaaataaactttgagtgtctgaggggcattacttggtgtgttgacaagaaatgagagcccacatctgaggctggtgggtttggcttctgcaaagacggtttgataccatgaagaatgtgtgaagggtgaggggtagtgcatttcagacacaagactatatgtgtaaacacatgtctgttaaccccagaactcccaacaagtcaggcataaacctttacaattagtcgaataattggggctgatgactaactacaccgtccatagaaaccttgaaaattccctagctcccttttccctccattggacttgcttcccagtgtatggcctcatatttcttttttatgacatttattatatttttgtgttttttttttttttttgagacggagtctctctctgtcaccctggctggaatgaagtggtgtgatctcggctcactgcaagctctgcctcccgggctcacgccattctccagcctcagcctcccgagtagctgggactacaggtgcctgccacctcgcccggctaatttttttgtgtttttagtagagacggggtttcaccgtgttagccaggatggtcttgatctcctgacctcgtgattcgcccgcctcagactcccaaagtgttgggattacaggcgtgagccaccgcgctcggccatatttttgtgtttttaaatgtctagtctttgctgggccattagctctaggagtgcaaggttcatatctgtctgtgacaactgtatccacaataacttgtgcagttgctggcacataatggatgttcagtaaatacttagtagacaaataatgcttctatgggtgacataatggtgttatggaaagcatatagtagttctgttgaagaagagaatgtggtttaatgcatgattttaagtatgattttcctttcccattaggtggaatttagccatctagacagtaaagaacacacatgcctcttgagttgctcacctctgttttcccctgcctacagtggtttggaagacatagataactatgaaataggacattttgggtgaggttagggtctaaagttagcatggagtttaaaaatcttgtatagttgccgttgagaagccagatggtgacttaagtttaacctggttatcttttcttgcagctttggttgagtaccaaagagttggtcagttcagagagttggcttctgcaaaaaatacccattttcagatagtagtatatcactgttggtaatttgttcatactgtgccaagcatgtataaactgagacttactgagagaggaggagattcatgtcttttcctatatgttcactttgtaagtatatttttatagagtggaatgatgggtggaatcacctataccattaatgttcctctagctctggaaagtaattttactttgtctaaattcaaatatatatgtgttgggaggctgagatgggaagatcacctgagctcaggagttgaggctgcagtgagctgtgatagcaccactgcatgctggcttgggtgacagtgagaccctatctaaatatatatatatgtatatatgtgtatatatatatacatatacatatatgtatatatatatacacacacacacgtgtatatatatatttattaattatacacagacacgtaatgtgattgcctcaactattccctcctccaccatctccactcttttcaggtacagaagttcatttatttacaaacagttttaagttctgaaaggctgttcataaattctttttgtaaataatcgctaacattttcctttggtgtcaggcattgctgagaaactttcattttgattggttgccttgttcatatgtacagaagcttatgagttgaaagtagaggagtttctgtatgtgggacctgtgaacctaggcatttactgtctcctggtcctaggaccctgctttgcttagtgaagtttgctcttcagaaagattcctgtaaccttctcccactggaaatgactcaagaccaggaatatctaattttcaggacatacacttttttgtcccaacttttttttttctttttaaaaagtgctttatgtccaaaggattacttaattcccctaggatgagttaattcaggcattactgtatcaatagtattttatacagttgtggaattgggaggggacttcatttatctccccctggtgcacctgcaactctgaagggtccattgtatctgggggaaacagaatggaatgtaaaaaatgtttagttgatttatgtgagggtcaggtcaagaacaggttaaactaattacgataataggggttaaaatagagcagtggttccacagtgtttgtgtgtatcagaatcacctggaaggctttattaaaacaagatctctgggctctacagaattgctgagcactatatctaaggtaaggccttagaaaatctatttttaacaagtttctaggtgttattgatgctactgctgatcagccttggtcagggtagttagaagtttatgattttgctaattcaagagtcctttgtcttttgtaggaggagttaaatgtagagatccagggtttgggagttctctgaataggggtatataagtgctcctgagagagaatgaaaatgaatgctaagagaaggaggataatgtggaatgtgctgaaatttatttcctatctctttccctgatgaaagcatccttatttggggtttacttttttatttttattttattttttttttctgagacagagtctcactctgttgtccaggctggagtgcagtcgtgcaatgtcagctcactgcaacttccacctcccgagttcaagtgattctcctatctcagcctcccaagtagctgggattataggcacctgccaccacacccagctgatttttgtatttttagtagagatggggtttcaccatcttggccaggctggtctggaactcctgacctcaggtgatcacctgtctcaaccacctaaagtgctgggatgacaggtgtgagccactgtgcctggctggggtttacttttttaaatggaagttttatatggatgttttcaaacatcatgtgtagagaaaacagcataattaatccctggtgttatttaccacttaccttttaatagtttcagttttaactgtcacactcccttttttgaggggtgttttgatatttaatggagtgtttcagattttcttactttgtgattctatctttttttctgtatttatcagttgtggttcttctataaagaagattttccatcaattttttggttactttgaaatacaagaagagcaggatacatgcttatttcttttatcaatttgtagaataagttgtctttgcagtaaggcttatttttactatttataggagtagaagcagtttgaggcttttaattttttaagagaagctttaaaaaatgaagtataacttacatacaataaaatacataaatcttaaatgatgtactcttggtgaattttacaccatccagatcaagttgccaatgtctcagtcaaccccttttcagttagcccgctcttgcagagttagtctctgtcccagggatttccaacgtatgaattccagatcggcagaatcaacatcacctggaaacttgttaaaaatactttttcctaaggccttacctttgatatgttggttcagaaactctgggagtggagtccagagatcttgttttaatgaagtcttccgggtgattctgatacacacaagcactgtggaaccactgctgtattctaacacatattatcataattactttaatcagttcttgaccttactctcacataaatggatcaactgaacatttctcccattccattctgtttcctccacatgcactggatttttttcctgtgcccctgggtgagaagtcttgctgctgcttccccagcagtttaaggcttttgcttcagaggacagaaggaggcagggaagtgagagggtttgtgtttgttccagtgcaggctttcatcacctcctgcatgcctgtgccgttaagagggggctttcttatatgtttctcttgaatgctaggttgaggcccatgaggaagagcttgctgttgtgctagtccacatttggcttttaagcagacattaaaatgttagcttattactcctttttatggtggtcatttctgtcttttatgctcagccaaaagtgaaactgttaaatgtcccgtctctcctgggaggggcttgtctccctttggaatttggttgacttgcttgccttacaataacagctttctgatgggcttatgaaaggttatgattttgaagattatctggctcttccaggtttttaggtaggagtgatattaattgcagctttttacatcgaaaatggaaatctgaccttcatataaatggaatcacactatatttatcctcaagtctctggattctcttgtttaaaggatcctgttagttttatctgtattgttgcatatagcaataattaggtcttcattaccatgttgtattctattatgtagaaactaccactaacatttttcttttttttttttgagatggagtttcgctcttgttgtccaggctagagtgcagtggtgcaatctcacctcactgcaacctctgcgttttggatttttggattctcctgcctcagcctcccgagtagctgggattacaggcatgcaccaccatgcctggctaattttgtattttgagtagagacagggtttctccacattggtcaggctggtcttgaactcccgacctcaggtgatccgcccacctcggcctcccaaagtgctgggattacaggcgtgagccaccgtgcctggcctcactaacatttttctatgaaactataattctaacgtatgtagatgtttacaaaatgtttcatgtttaggtatttactgtttgtcatatactgagcaagctggggcttgagtagtgtattctggtgaatcaaacccagtatgtgccattagtgaatttatggcctagtagtcttccatccatgttaatgttactcctgttactgttcttcctgatgctggatctcctatggccctgtccctactgcccatttaatttaatatagggaactttgctcaagcagatcctgtatagactgaaatgttaaatgtttgcttgttttgatttgacctggtgtttgtaaaatgtctgtacttaattgttataggtgtctactattttaaaaggcagtatatgggtcaatattgacgtagtttggcatgtgtcatcttttcctagccctctgcacattaatgacatttgcatgccccacaggtatttgagttttgtgttcctgtaccaactggtaaaatttggagggagaaatttttatggtttggccaggggaacttctggttcctcttgttagtatttttgttcttttaagtttaaatttcaggaagtaatatacattggatctgcataataaccttatttaatgttcttaaaccacaaattccttttgagcttaacttttacaagttactttgaactccatttatgtgagtgaaaatgaagttgtagctggagcacagaaaggtcatattgatacaataaagaggctttgtgttgagcatggcatgtcctctttaaaactttgaagaatctggaagtaagcgcaccattttaaacctttactttggctaaagttgtcatttttgcttatttaattggtattttattttattttattttaatttattttattttatttttgagatggagtttcactcttgtcacccaggctggagtgcaatggcgcaatctccggtcactgcaacctctgccttctgggttcaagcaatgctttagcctcagcctcccaagtagctagaattacaggtgcctgccaccacgcccagctaatttttttttttttttgtatttttagtagagatggggttttaccatgttggccaggctggtctcaaactcctgacctcaggtgatccacccgccttggcctcccaaagtgctgggattacaggtgtgagccaccacacccagctattttttttttttttttttgtatttttagtagagatggggttttaccatgttggccagactggtctcaaactcctgacctcaggtgatccacctgcctgggcctcccaaagtgctgggattacaggtgtgagccaccacgcctggccacttatttaattgctataatcaagcctttgaatcagcttatgccacagatgacagccaggaaaaaatgggaaaaggggatatgaaagaagtagttgagtaacacaaggttaaaaaaaattactttaaattctgatctagttgtctgaacttgaaagcagatttccgaagtaactgcttatacgtgtgtagtcatcagtattgttgttcagttaattgctcttgtacttagtagtgagtttatgtctgtttaaacccctaaaatgcagacaatttataccttctaaaaaactatttgaaaaactaaaaaaagacagtgagtgggtggttcctcagatgatgaggtaatggatatgaaaggagtttgaaaaagtgacagctcttactgttcttctgctaaatttctgtaattaatatctaggtcctttgcagtctttatggttttcctctgacattagccattcagtcccttccttcattcttgtcccttgttgttagtaggcttctcagaatacaggcagcatcgcttaacgaaggggatctgttctgagaaatgcctccttaggccattgttgttctgtgaacatcatagagtatacttacacagatgcagatggtatagcctactacacaccaaggctatatggtatactatcttgcttataggctacaaacctgtacagcatattactgtattgaatactgtaggcagttgtaacacaatggtaaggaattgtttatctaaagttatgtaaacatagaaaagttacaataaaaatactatataaaagagaaaaaaatggtataccagtatggggcacttgaatggagcttacaggactgaaagttgctctggatgagttagtgagtgagtggtgagtgaatgtgaaggcctaagacatcattgcacactagtatagactttataaactctgtacaaacagatacaataaatatgtaaaaaataaagtaattgcattacaatgttacaatggctagcatgtcactaggctataggaatttttcagctccactgtaatctcatgggaccatcgttgtaaatatagtccattattgactgtaacatcattgcttggctcactgactgtatttcattcctttgtcatgaaggcagttttcattggccctggaatcaggtaaacttgaacccgaatcctctttgacagtttatgaatttgtgactttggacaagtatattagcctctctgaatcttggttttagctatttaagatgggaagaaatctactaccttataatgttatgaagattaaacaaaaagtatgaagtggtaagcatggtacctatcatgtaagtgcttaataatatttgctgctgcttttcccttatccaattgtggatttcttttaaaagcgagaagcttgatttacagttttaaaaaaaggcatttataagtatttttgaatttttttttgtttttttttttttgagatggagtctggctcttttgtccaggctgtagtgcagtggtatgatctcggctcactgcaacctctgcctcccgagttcaagtgattcttgtgcctcagcctcccgagtagctcagattacaggtgtgtgccaccatgcctggctaatttttgtatttgtggcagagacagggtctcaccatattggccaggctggtctcgaactcctgacctcaggtgatctacatgcttcagctgcccagagtgctgggattataggcgtgagtcaccacgcccggcctgaaaaaaatttttaaatattaaataccaatactgtaaatttgctatactttaaaaaattattcttgcagaaactaaaaaaaaactgacattttcaagcactggtccagatattagtcttagttcaccactaaattaaagctcacagatggtattaaagtgtctcagagattatatcattagatgatgtaggcaacatatattttttcaaattgttaatgaatggattttttagacacctaacagattacagtttaggtaaagtgcatcaaagacagcatggctaccaaaatgaagcagactcacaatgtctattttattttatttcaaaattataagcaaatataagggaaaatttcatgaacttttaaagacagatggtagctcatcaacgaatgaagtgataatattcataacgtaaacttcatagtggagctgtcagactagtttatcttaagaccaaagttcaagatgattgatgtgatttgtgttgcaattatttgtacatttagaaatcgttattcttcatagagaatagcacattcaggttctaacattattcttttcccccacaaactggtggaaccacaaacaccagtaacagtgtgtctctcttgtgggctcatcttgtgcctctaagttattaatactgaagatgctcttgggagataacatgtattaccctcatcttaggcaggaaaatagaggcatagagaaaggaaagaatataattttctttccgtggtctacttgtgacaggcggggaaatgttaaagcctttctgactcacaggctctttaatctttaacatgtattatttattgatttgcaaaatgaccctaatatgtaatatcaataccagttttcttatgtttataccgaaagtggttgtgggtatggtagtatgttttgtggaaaagaccattatcaaaaatgaggaagacagttgtctggcatggatattgccactgtcccttgctctgctcctggcaaacattgctgcttgatcatgtcactacttcagaagctagatttgacctcagcatcctttttgttttttaaaaattttaatgttaaatttttagtagagatgaggtctcactatgttgctcagtatggccttcaactcctgagctcaagcgatcctttcgcctcagcttcccaaactgttgagattacaggtgtgagccactgtgcccggcctcggaatccttttcaacatattgcccaagggagctattaccagtcaatcacaggtccacaaaacaaagttcttttttagtctttccttactgttgaattaatttacattaagagattatgaatttacttaaaagttgaggatctattaaatttgtagtcctgtagctggcctcaaagtacagtatataagacttagtttatgttctcagcaggtttactttcctgtgggtcaaatagacatgcacacaattagaagacaaactcagctatattattgctgtgaagagaatagagaatgatgtaagattaattttaactggaaatgttggtggatgtggtgattttggactttgaggatagaatcttccaaggggtctttagcaaaggcaaagaagttagaaaatataggatggattttgggcaatgacaaataacgtatcttggcttaagtatataacaaggataaggtagaatcaaatagagtagcttgctccctgtacaatgagttttgggttttattttgttgttcctagtctcacagatggtttttaatcagtagaatgacgtgatccagatctttgctttaagaagataactgctgacagtttgaatagaagtaaggttggaatcttgacaaatgtaggaatccttggtagtagtacaggaagaaatgatgagcataagaactagaattgtggaatggaagtggtgaatttagaataaatttttaatggtaaaattaatgtgattcctacaggattaagttatccccagaggctccagcatttctttggaaggttatccagttatttcctttgtatattccaagtttaaaaaattttttaaaggtgattttttttctctacttgtatttctggagaattatttctttatccttggtatttcattaacttaaataggatacgtatttgcatctgtgatttgatatattttttctttccctccatagattttttttcacctttattttagggatattttctattatgtcctcctgccttttctcttccatttaattagttattctacttcagggatactaattatctttctgttcagcctttgtcctacattttctttctaattcaatatctttgtcttttttttctcctcgatacttttttttttttgaaacagggtctcactctttcagccaggctggagcgcagtggcttgatcacggctcactgcagcctcaacctcgtgggctcagttgatcttcccgctttagccttctgagtagctgggacaacaggtgtgtgccaccatgcctggctaattcttgtattttttttgtagagatgaggttttgccatgttgtccaggctggtctcacactcctggtctcaagtgatcaacccaccttagcctcctcgatatactcttgttaccttaagatttttctccttgccatttgtttaagtctttgcttcttttccttgcttttttttttttttctttcaaattcattgttcttcttaattggtttccttaacgctgaagcctttcttttcaatttacctgttttgtcttttcatctttgggcttttgtttcattagatgcatgttcttattaggttgttctgtgttacaagaaactgtttatatgattgtatgggcatttctttttgtcttgctcaggcttaatttggatacctaggtcaagacttcgcttttgcccttctgtggccctatgctttcccatctccttagattgcgttaaatgtcctataccagtctcatttcatactgctgagggtacagtacatgtctatgggcttcagatccttccctcaactcagtatagggacttagaagttggcagatcctggtgatgcctctgcctaggttttgaagcctctgtgctcgggatatttttcctcaacttttgtagggcatggcaaatcaaattttttctatccaaactagaggtatttcttaaaattttcaagttttttagttcacatttctttctcactactgcttccaggcagtaatcaggctgccagtcatactgtaccatacagaatttttttctgtccgctactttttaaactttataagttcttagtttaaatagttttttgtattacagtgtgtaactgataggttttctgctgaaaaaaaccacatacacacaaatatatatatatatctcttagttgttggtaacaggacgttctttagtcttttttcactctatacttgaacatttgtacgattttctaaatatttacttttgacataataacatgtattataggaactctacttcttaggccagggttgacttggaatcagttgttttaaaaataaaaaaaaattctcatgactttagtaattaaggtttttcgaatgtcttctagcttttataaaaccatgtatttttttaaaaaaataatatgttctttaattaccttttatttcactggctttaagggaacaggtgatttttggctgcatgaatgaattgtgtagtggtgaagtctgagattttagtgcacgtgccacccgaatagtatacattgtaccctactacattgtgtagtttttaaaaaatctctcatccctctcccatcatccccctttctgagtctccagtgtccattattcctctctgtatgcctttgcatacccataacttagctcttaattacaagtaagaacatgtggtatttggtttttcattcctgaattacttcagaataatggcctccatctccatccacgttgcttcaaaagatattatttcattcttttttatggctgagtagtattccatggtgtatttttttaattcactcattggttgatgggtacttaggttggttccacatctggcaattgtgaattttgctgtgataaacatacatatgcaggttttttttttttttgatacagttttcctttgggtagatacccagtagtgagattgctggatcaaatggtagatttagttctttgagaaatctacatactgtttcccatagaggtagtactaatttacattaccaccagcagtacctaaatgttcccttttcatcacatctatgccaatatctattgttttttgactttttaataatagccattctggctgggataaggtgatatctcattgtggttttaatttgcacgtccctgatgattagtgatgttgagcatttttttttcatgtttcttggtcattgtataccttcttttgaaaaatgtttgttgatgttatttgcccactttttgatgggattatttttttccttgcagattagttggagttccttatagattctggatactaatcttttgttagatgcatagtttgcaagtattttctcccattctgtgggttgtctgtttactctgattattttttgctgagcagaagctttttagtttaattaggtctcatttatttttttgttgcatttgctttttgtgtcttagtcgtaaattctttgcctagaccaatatccagaagagtttttcctaggttttcttctagcatttttatggtttcatgccttggatttaagtcttaaatccatcttggttgatttttgtatatggtaagagatagggatccaatttcattcttctacatgtggctatccagttttcctggcaacatttattgaataaggcgttcttttcccaattttcatttatgtatgctttgtcaaaggtcagttgattgtatttggctttatttctgggttctctactctgttcctttgctctatgtatgtacttttataccagtaccatgctgtttttgttactatagtagccttgtagtataatttgaagttgagtaatgtgatgcctccagatttggttttttgtttaagattgttttttggttccatatgaattttaggattgttttgtctaattctgggaaaaatgatgttggtatttcgatacaaattgcattgaatctgtagactgctttgggcagcatggtcattttcatgatatggattcctctaatgcatgagtgtgggatgtatttccattcgtttgcattgtctgtgatttctttcagaagtgttttgcacttctccttgtagagatcttttacttccttggttaagtatacctaggtattttattttatttttttgcagctatggtcaaagggattgagttcttgattctcagcttagtcattgttggtatgctactgatttgtgtactttgattttgcaacctgtgactttactggatttatcaaatcttggaatcttttggaggagtccgtaggattttctagatatataatcatatcattggcaaacagagatagtttgacttcttcttttccaatctgaatgccttttatttcattctcttgcctgagtgcactggctgtggctttccatatgttcttatttttaaaggagagacttttacccaaaatgaaaaaattatttggattggaaattggaagaagtactctgtaagtattattttttacatagtcaaatttggtggtttaattttatttctagattttgctgtcattcatagcatacatttataaaagtttataaaaatgttctttattttcttccaacataaagttattaatttaattagtgcattcggtatttgccaggagttctgtaggaatcatgagtagcttttgggtttttctgcgtataaaagtgtaagtatcatattatgtaataattcatgtaattatccttatttaggaatgtttaatgtacttcttttttctcttcacagattctttcaacttttaagaacaaatgcaccttatagctcatggaagaaaaaacacaaatcaagacatttttgggttccaagttgccaaagtatggaacaaaatctgtaagaagtacattgcagccaatgccaaatgggacacctgttaatttattaggaacttccaagaatagtaatgtcaaaagttacatcaaaaataatggctctgattgtccatcatctcattcatttaattggaggaaagcaaataaatatcagctttgtgcacaaggtgtcgaagagcctaacaatactcaaaattcacatgataaaataattgatcctgaaaaacgtgttcctactcaaggaatgtttgataaaaatgggataaagggaggtttgaaaagtgtttctttattcacatcaaagttagcaaagccatccactatgtttgtgtcatctacagaggagttaaaccaaaagtctttttctggaccatctaatttgggtaaattcaccaaaggcacattattaggaaggacttcatattcttcgatcaatactccaaaatcacagttgaatggattttatggaaaccgatcagctggtagcatgcaaaggcctagagcgaactcctgtgccaccagaagcagttctggagaaagcttagctcaatccccagacagtagtaaatctattaattgtgaaaaaatggtaaggtcacaaagtttttcacattccattcagaattcattccttccaccttcatctataaccagatcacattcctttaatagagctgtggatcttacaaagccttatcagaaccaacagctatccattagagtgcctctacggtcaagtatgctaacaagaaattcccggcagccagaagtactcaatgggaatgaacatttggggtatggatttaataggccttatgctgctggtggaaagaagttggctttaccaaatggcccaggtgtaacttctactttaggttatagaatggttcatccctctctactgaaatctagccgatctccattttctgggactatgacagttgatggaaataaaaattcacctgctgacacatgtgtagaggaagatgctacagttttggctaaggacagagctgctaataaggaccaagaactgattgaaaatgaaagttatagaacaaaaaacaaccagaccatgaaacatgatgctaaaatgagatacctgagtgatgatgtggatgacatttccttgtcgtctttgtcatcttctgataagaatgatttaagtgaagactttagtgatgattttatagatatagaagactccaacagaactagaataactccagaggaaatgtctctcaaagaagagaaacatgaaaatgggccaccacaggatatgtttgattcccccaaggaaaatgaaaaagccttcagtaaaactgatgaatggatagatataagtgtctctggtaaatattacttaccttaagtttttttgctttcttttaaataatataactgaacttacatttaggattatcttcagatagatttcaagatattatcagtttcacggagggatagatctagacaaaattgaggtgggttaacgtttattttcctgtgacttttgctccataccccatttttcaccctatccaagacaatattaataaaaccactcttaacctttgttgttctttggctgttatacacagcctattcctgcttagtatatgcagtgcttctaaatgacttcccctgcttacctcaaccagtgtggtatgccattaaacaaaccatctcttctcttaggatagcatttcattgctatttgttaagagtaaagctgtaccaaagggtacaatgagataatataggttatgtctaatctcacggatttttttatcctagaaaattcttcttgtttagcaattttttagatacacttcctgagagagctttatttatttattaaactgaagaaagtgaaataatacctgttaaacatttcctcttatgtttggttatcctgttactaaatgctggataaaatgtatttggtatttgtatgcccatatacctgaataaagaacaactaaagggattagatatagacatgtggtataatcaggggactagatcgtgcatagaaatgcatgtacaaacccttgattgtctataggtcttctaaaagagactgccggaacaagtttatttccttatagggaggcaattatgagtaccctacattatttaatctatgaagttaaatagtgtacacagaggaaaaggagtttcctggccagtgtttaaaaataaatatcttgggaaatataggaatatgagggtttatttacatttttggaaatattacagaagtgaaagatgactaaatgaattttcttttcctctattagaaaatatttcagtaggttattttaaagattttggctcttgatgtttttattgcttaggatatagaaaatgctacagttatgagtgctttttttgagccagcttttttgctatgatatatcaaattattagcacttatatttttaggacacgagaaacaattatatttttgtgaatcagtaaccttttttctcttgaagacaggagtgaatgtacaaaacatacttctgggaataatttggtttcaccagatacagactacagagctggttcttcgtttgaactctctccatctgatagctctgatggaacatacatgtgggatgaagaaggcttggaacccattggaaatgtccatccagttgggagctatgagtcctctgaaatgaacagcatagtatgtatggatttatatactcttggaatattttgtttaccctactatagagagacttgtgatatgattgattttgtaaaaaatttatgaattaactttactactttgagaaatggaaattcatatttgttaagagcctataaaatatctgactctaatatgaaataaagcatggagaatatatgacatttgacttaaatatactcaacatgtttacatatatattcctcatacatatgtgcatactatattagtagtttaatctatgccagtggttctcaaagactgggggaggaggtcaatgactggaggtggttttggttgtcatattgatgagtgcttcttggcatctagtgggtagatgccaaggatgttgtttaacatcccacagtccacaagacagagaccacaatgaattatctagcctaagatggcagtactgctgctgttgagaaaccttggcctgtgctatactgaggtaacattgaagtgccaactctcagtgggataatacaatacaagtgtattattttactcttagaaagtttgttgtgggtctggacagctctctagggcagctgtctttagtgatctaaactactttgattttggggcttgaccatcttttgaggtcccttcttttcactatggcagaggaagagagtgccagagggtctcacacatataattacttgcattggcctgcaggcaacacttggcacttccgttcatgatctgttgaccagaactaatcatgtggtcccatctgagtactaaagggacaggaagtgtaatctttgtgtgtgcctggaaggcaagggaatcagctatgggcaagtgttagaagacctgccatgaatttatatgtgcatattttaagaaacatggcaagtaatgtggataatatgccatatgggtaaagtgtaattggtatgtttaaagtgactcattgcagttattcagtatataaaatacgattttccagtagttgtatgggaaaattggtagtctgtggatatattaaattccaagtggatttcaggcaatgtaattttctatactcctataaaccttttacttaagccattgttaacggaggcttaaattgcacaaacattttttttaaccgttgtcaacaccttgcatacaaacatttaatttagagacagtgtcttcatctcattagataaaggaggctcagaaaagataacagtttaagaccttatatgctgtcttactaggagttttaaggcaaatatgattgaagtgcaaatgaaaaaggtgtccagcagatggcagcaataaaccacttagtacctgacagtttttggaggctaaccaccttgattcagttcattgttcctgtaactaatcacaaaatagctttctgtcaaagatttcagaatgcatctggattaactgttagtccttaagatccatgagtttcctccttgttcagtaggtttatgtctattggtatgggaagaaaaaaacatccattctgtgctttggaacaagatggtgtttctgtctttctcttctgatctaaggagaagatgacaaagtctgagaaagaatagagagttgatggcaaaagttgagaaccatgtgttgagttctcgtacagtgatgtaggatttaccatttttgctctgaagttacgtgaattttttgttttgtataaattttaggcgtgtacctgttcagaattgttggtttgttttttttttttttttggtgaattggactttccatcattacttagtgatcttctctatctctaactatgctttttgttttcacactcctttttttccaaatattaatataccttaccagttttatttatatattttctcttcttttactatcagccttttttatgtatagcaaatagtttattattttaaaattttcagtttgtctttttcttttgactagtgagtttaatccttttatgtttgtattgttatacttggactgtatttactctgccatcttattatttttatttaaattgtcttgctttttttttctgtttctttttcttttttttttttcctacagtggttcaaagtagtatctcttacttaacccctcaagacctttagcatattctcacttttcttgtctctgcaacactgcttctaccagtccaggtaaagataaggagctttcactagaatgtacatcaactgtgtcacttctaacacagtttagttccacccactgttcatttctgctgacattgtttttgtagtaagtcttcctttttgaaagaaacaatgtgttgatatacattctgatgcaatctcctaatcatgtcaaggatcccaacaaatagtttgtagactgattacttttcataacaccagtctagaatcctggctatttatttgtttacatgctaccagtattatgcagaggtctgatttacgtacagtaaaatgcacaaatcttctgcagacagaccagagaattttgataaatttgtatgcttgtttgacaatcatccatattaagatatagaatactcccatcgctccagagtgttccctttctgttcctttcagtcagtcattctcttactctgcaatcactgttggtttcggtcactataaattagctttgactgttcttgaactttatataaatgaaatcataaaggtgctggtttatatctagcttcttttcattaatattatgtatttgtcagttgtagtttctttactcttgtatcatattcctttgtgtgaatatactacaacttatcttattgttcatgggcatttaggttggttccagtttctggctattagagtattgcatgattgtgaagattttgatatatgtttttttggtgaacacttattcatttttgttgggaaaatgtgtaggagagagattcctgggttataggctatgctgatggataaagatgctgtcagtgtttcaaagtgattgtgcctgtttacactccccactggcagtaaatgaacattccggaaaattcaccttcttgtctattcttggtgctttctgcctttttgcatttttgctattttgtgggtatagtagtattgcattgagattttgtcttgtattttttgataactactcacagagcaccttcacatatgtttattgggccattaggatatatcctcttctgtgaagtgtcttgtgttgggtttgttttcttaatgatttgtaaaaattcttcatattttttgacataaatatttattttatatcaatatgtagatgtttgtattcatgtgtatatttacattttatatatgtagagtgtattctttactgtgagttgcttttgaaatctcttagtgtctgttgatatagaacttaccaattttgatattgtccagttttacaagttttccctttaccgttaccactttttaaaaaactgtttgtgaagtcttttcccaccttaatatcatgaatatatgtttcaatgttttgctctaaaagcattatttatttttaaccttttacctgtaggtctctagtccccatctggaaattatttttctgtatggtgtgagatagatgtcacgattaatttattttagtcatctttcccccactgtacttcagggtcatctttgtcataaatcagtgactgcatatataaatatttcattgcatagacaaatatttctgtttattttgtcagttatatgttattttcattatcgtagctttaaaataaattttgctgcctggtagggtaagtcttccagctttgttcttttccaagatttctgtagcacttcttaaccttttgtatttccaattaaatattagaatgagcttgtccgtttccaggaaggacctgcagggattttgaatgggattgcattgaatttatagatgattttggagagaattgacatatttatgatggagatatagtcctccattaatttcagactttagaaatacttcttgctaatgttttgtacttttctataaaatgttatgcatgtttgattttgacactgtaagtggtaccatttttataattttatgagtttttgttgtatatacaaatatacctgatttttatcatgtatattggacttttctaataaccttgtaaattcatctactagttataataatttgcctttggatgattttggaacttgtatatacattctataatcataccatttgcaaaaaagttgcctcaccaccccagcgcttgccctattacacaagttaggaccaccaacgtgatgttgaattgaaatggtgatagaatttcagagagaaagccttaatagttcaccattaaagtttttgggagttgagagggagtttaatcagagtatggaaattctcttttattttgtttgctgaatttttgttgtgaatgaatattaagttttaccaaatgctttctctacgtctgttgagataatgaagttttttttgtgttagtgtggtagattgcatggcttgattttcaaatagtaaactacctttccattcttagaatacattcacttggtcgtgatgtattatcttttcaaatgttgttaaactagattttctaatttttatattttaaaattattttttaaaattaaatttttttttttttttttttgagacgaagtctcgctcttctcacccaggctggagtgcgatggcgcaatcttggctcactgcaacctctgcctcccaggttcaagcgtttcttctgcctcagcctcccgagtagctgggattacaggcgcctgccatcacgcctggctaaattttgtatttttagtagagacagggtttcaccatgttggccaggctggtctcgaactcctgacctcaggtgatccacccgccttggcctcccaaaatagtgggattacaggcatgtgccaccgcgcccggcctaaaaattaatttttagaaaagagatagggtctgtctctttttgtccagtctggccttgaactcctgggctgaagtaatcctcctcccacagtctcccaagtagctgggactacaggtgcatgccactatacccagctctgctaatagtctatgtttttgcatgtatgttcatgagtaagattgttctactctgtaattttcttgtttttctacttgttcttgccatgttttggtatcaagatcatgctggctttataatgagttgagaagtgtttcttatttttctgtcctttgaaagaatttgtgtacaactaatgtgcttattccttaggtatgtaaaagaatttgccagaattcagccttctggacctggagttttctttatgagaaggtttttaataacagttttaatttttagatattggcatattaaaatttgtatgtatattcgtgttggtttttgaaaatttgtccatttcatctaaacttgtcatttgttggtgaaagttgtttaggattatcctctttttaacatcttatagggacgtctgcttttcattcctaatactggttattggtgtttcctctctttttcttcatttccaagaaccaaatttgggctttgctgatttttctatattgtgcttattttctgtttttattgattttggtttatatctttatttcctttcttctacttttctttagtttaatttgttttttcttttccaaagtttttgacatggaaactagataattgatttttagcctttctcccttctctggcatatgaatgaattctcataaagagaagcctttattatttgggaaagaatgcattcagtaaacaccctagtagtaaatatagcagttagttctttttatgtgcgttgttttaaaattgtgaattctaaggcatgttgtataggccattatccttaatgcatttatatatccatgaacaatatacagtatgattttgtacgtattttacaacttaggtaagtgatatgtaatattctacaggtttcttttttaactcaattttatgttttttgtgtatatgtgtatttgtattgtagttctaattcatatttattactttataatattctgtcatttgaatatacctgtatttttctctgttcccctgctaatctacatttcagttattctttattgctaataataatgtctacatggtgtagcagtgaacattcggattcaattctctttgatcatataagtcagtttctttaggatataaacctagctatagcgttcctaggatataaaactaggaatagtgtattttcaactttaatgatattatcaaacttctccctaaaatggtcctaccagtgtataccttccagtagaggatgagaatttctgtcacttatcatctgaaccccatatgtcgtcatctgacttcaacattttaatcagtctggtgagtgtgagatgatacataattttaatttacatttatactattattgattttgtcatttttttcacacattttactggcagttttgtttccttttatgtaaatttttacttcagtgatttttcagttgggttttgccatttttcttattgatatggaagagttttttatgtggttggaatttaattcttgttaaatgtgttgcagtaatcttctctgagcctgttgcttctgttttgttttttgtatctttttaccgttcatagtttttgcttttgacaattaaatctagtaatgttttacttcattgtttttgcttcacatgctcatatatggcgtgtgtgtgtaagacacccattcccatcctaaggccatagaggtattttgtttacagagagatgttattgcataatgattaagagccagggctccggaacaagctaagttaaaacttcacctctgtcatgtactagctgtgtctccttggattctctgtgttccttttctttttttttttttttttgagacagagtgtagctgtgtcgcccaggctggagtgcagtggcgcaatctcgacttactgtaagctccgccttcctgggttcacgccattctcctgtctcagcctcccaagtagctgggactacaggtgcctgccaccacgccaggctaatttttttgtatttttagtagagatggggtttcaccgtgttagccaggatggtctcgatctcctgacctcgtgatctgcccacctcggcctcccaaagtgctgggagtaatcccagggcgtgagccaccatgcccagcctctctgtgttcctttttaaaaaatatagatggtaattgtacgcacctccagggctgatgttaggaagtacatgcctgaatggtatgacagtcatgtgattccctggtgatactggttgttgtgtattttgagtatcatctctcactaactcatgggattactatgaacattaaatgaggtcatatatataaagtacttattaatgccagggatataacaagagctcagcagatgtttgttattttgctttctaattgttttgttttacatttaagacttcatccgaagttggtattaggcacaataatttacactcattaatattcttccacaatatgcttggggtgctatgcagaaaagagttaatgtcgcaggtctaagattgcctcttcttagataacccgcttgaaaggttggcacttggctggtaaacagttccttagagtgctataaaacttttcataaatgataagagcacagtaggcttgctgtgcctaaactgtttgcacagataatgtgatttatgctgactacctgctttccttttgggagtctagaattttgatacatgcgaggcagagggtacccacaagaccatcccccagtgaaaccttgggagctgagtttcttaagaacatccacggtgggccgggcgcggtggctcatgcctgtaatcccagcactttgggaggctgaggcaggtggatcacctgaggtcaggagttcaagaccagcctgaccaatacagtgaaatcccgtctctactaaaaatacaaaaataagccgagtgtggtggcacgtgcctgtagtcccagctactcgggaggctaggagaattgcttgaacccgggcggcagaggttgcagtgagcccagatcatgccacactccagcctgggtgacagagcaaggctttctcaaaaaaaaaaaaaaaaaaaagaacatccgtcgtggacaagactttgcactctttgcatgtattgtcacaactggttgctggaggtattaagcacatcctgtgtaactccattgggagaggactcttggaagctttcacctgattttgccccatgtgacttttcctttcttattttgctttgtatcctgctggaataaatcttagttgttaatattactgtatgctgaatcctttgactccttttagtgaattttctattttgggagtgggcttggggactcctgacacaggtactgatatgaagttatctttctttacttcatgatagcatctttttttgttcctcatcttttatattagtcctttgaaatagctatggactacctactacctttggtttcagactaggatgaattctagaggagttgagtaaattggcactaataggttaggaagtagtttactacttgttacactctcagtctcagaatttttgaactcaataaacttttaactgatatttaactttcttgattaaatatagcattttttctgataaatattataatcattgtatgtgcacaatcttaggcaaaaacatttttttctcttgtaaacacagtgagccatactcagaatcttctttgcagcaatgctaggacaatacaagagctctcattgaagaatagttgaactacaatgtcatgatgattgattttctaacactgaaatatttaggaggtgataattttaaatcatcacatggagtgcctttatttttggaatgatttttataggaggcccaaagaagtgtttgaatcagatcatcactgaaagtatctggctttatttttgttttatcagccttgccttatcttcacatagtggggaagtttaactccttatttaaatgagattcttgttcactttaaaaggtagatccaaaaacttacttgtatgcttttgacacaccaacaagtaggtatgccttcattttcatgaggctaacacattttatttacattttttaatctgtgttttactaagaggagagctggctagatttgggtttctaccttgtgactgatacagctagactttattgagatttaaatgtctgctgaatgtcataatattcttagcagtgtttgcgtgggtatatgagttccctagattatttgcactgaaatttggaatttctctagtccaaaaatatggaagaagaatataaaaatatcaaacctggtttatatttgccttacttggttttgagttttagaatgaatttaggaagtttttaattgctctctaattttgtatctgtgacattttacttcgcttgggttatttaactctaaggaagagaccagagatgctttgatctttttatttatttatttatttttattttgagatggcgtctccctctgtctcccaggctggagtgcagtggtgtgatctcggctcactgcaaactccacctcctgagttcacgccactctcctgcctcagcctcccaagtagctgggactacaggtgcccgccaccatacctggctgattttttgtatttttagtagagacggggtttcaccatgttagccaggatggtctcgatctcctgacctcatgatctacccacctcagcctcccaaagtgctgggattacaagcgtgagccaccgtacccggctgaggtgctttattctttctaatgtgtattcacatatactatctcaggtggttgcaccttctctacattttgctagtttttcactttatttaacaatattatactactgtcaaactgttttcattaaactctggtgagatcatattgttgttgctttaaatctgtatctgaataacaaagatcagagcagaactaaatgaaattgaaattaaaaaatcataaaaatgatcaatgaaatgaaaacttggttctttgtaaggataaacaaaattgacaggctgccagctagattagccaagaaaaaaagaggaaagattcaaataagcatgatcagaagtgataaaggtgattttacaactgatgccatggaaatacaaaggatcatcagagactgctatgaacatctctatgtgcacaaactagaaaacctagaggaagtggataaattcctgcaaacataacatcccaagattgatccagtaagaaataaaaataatgaataatgaaattgaattagtcattaaaaaaactaccaactaaaaaaagcccaggactggacagattcacagtcgaattttactaggcatgcaagagagctggcatcaatcttactgaaactattccaaaacatggaggaggcggaggaattccttcttaactcattgtatgaaaccaatatcatcctggtacccaaatctggcatggacacaacaaaagaaaaaaactactggccagtatccttgatgaacacacatgcaaaagtcttcaacagaatactggcaaaccaaatcaaacagcaactcaaaaagataactcatcatgatcaagtgggttttattttaggaatgcaaagatgtttcagcatacacacatcaataaatgtgacccaccacataaacagaaaacaaaatccatatgatcatctcaatagatgaagaaaaagcatttgataaaatacagcatcccttcatgataaaaaccctcagcaaactaggcatcaaaggaacatacctgaaaataataagaaccctatatgataaacctgtagccaacatcatactgaataggcaaaagttgaaagcatttcccctaagagctggaacaagacgaggatatccactcccatcactcctatcagcatagtcctagccagagcaaacaggcaagagaaagaagtaaaagccatccaaattataaaagaggaagtaaaattatctgtttgttgttgatatgatcttatgcttagaaaaccctaaagattcctccaaaagacttttagaattgataacttcagtaaagtttcaggatacaaaattaatatacaaaaattggtatatccatacaccatcagtgctcaaacagaaccaaattgagagctgaaatcaatttacaataaacacacacacacacacacacacacacacacccaggaatacatttaaccaaggaggtgaaagacctttacaaggagaagtacaaaacattgatgaaagaaatcataaatgatacaaacaaattgaaacatttcattcttatggattagaagaatatcattaaaatgaccatactgctcaaagtaatctacagattcaaggcaattcccatcatattaccaacatcacttttcacagaattagaaaaaacaatcctaaaattcaagtggaaccaaaaaaacaccccaaacagccaaaacaatcctaagcaaacagaacaaagccagaggcatcacattacctgacttcaaactatactacaaagctgtagtaaccaaaacagcatggtactgatataaaagtagacacattgattaatggaacagaatagagaaccaagaagtaaagccacatgcatacatctgactgaacttcgacagaaccaacaaaaataaactacggggaaaggacaccctattcagtaaatggtgcttggcagattggctagccatgtgaagaagaatgaaactgcacccctgtctctcactatacacagaaattaagatggattaaagacttaaatgtaagatcgaaaactataaaaatccgtgaagaaaacctaggaaaaactcttctggacattggcttaggcaaaagatttatgagtaagacctcaaaagtaaatgcaacaaatcaaaaatagataaatgggacttaattaagcttttgcacagcagaagaaacaacagagtaaacagacaacctacagaatgtgagaaaatatttccaaaccatgcatctgaaaaatgaccagtattcagaatttacaaggaactcaacaagaaaaaaaatgtataactccattaaaaaaatgggcaaaggatatgaacagacatttctcaaaagaagacatacaagcagccaacaaacataaaaaaaactcaacatcagtaatcattaaagagatgcaaatcaaaaccacagagagattctacctcacaccagtcagaatggctattattaaaaagttaaaaaataacatatgttggtgaggatgtggagaaaagggaatacttataacactgttggtgggaatgaaaactgaaaattagtacaacctctgtggaaaacagtacagagatttagcaaataactaaaaatagaattaccatttgatccagcagtcctactactagacatctacctagaggaaaagaagttattatatcaaaatgatatctgcacttgtatgtttatcacaataaatataaattatcaaaatagcaaagtcatggaatcaacttaagtgtccattagtagttgattggataaagaaaatgtggtgtatatacaccatggaatactatgcaaccataaaaaagaatgaaactgagactgggcctagtggctcatgcctgtaatcccagcagtttgggaggctgaggcaggcggatcacttgaggccaggagttcaagaccagcttggccaacatggctaaaccctgtctctactaaaactacaaaaattagccagacatggtggcacaaatgcctgcgatcccagctattcgggaggctgaggcacaagaatcactcgaacccaggcagaggctgcaatggcggaggctgcggtgcgctgagattatgtcactgcactccagcctgggcaacagagcaagactctttctccagaaaacaaaacacaacaacaacaaaagaagaatgaagctgtattctttgtagcaacatggacagagctggaggccattattctaagtataataagtcagaaacaggaaatcatatactgcatgttctcacttgtaagtgggagctaaacagtgggtacacatggacataaacatggaaataatagatactggggacttcagaagtggggaggatgggtgggggataagagttgaaaaattacctattgggtacagtgttcactgtttgggtgatgggtttctagaagctcagacctcaccattatgcaacatgttcatggagtaaacttacacatcatgaatctaaaatcaaaaaaaaatctgtatccatgttcagggcctttttcatactactgctaccttgcctacattcccaggctaagaccatttgagattatttatatttttcttaatgctcccatctattcctcctttaaggctgtattcagacttttattttctcccctccctctaagggttaactgttcaatgatgagaccccatggcactttaaatcacaccctggttttctgcctttctccttcctgttgtatcgtgaggacagcctcttttcatctttctgtgctgtgatactgacttagtgtgtttaggtgctcgataaatggctctttcccgttagaattaattactcctttcttcgtacgtctaatcatgttgcttcctcctacttttggcactttatttcagtttatagtatactactttgtattgatcttcatacctgcactgaagtaattttaatttttttttttttgagacagagtctggctctgtggcccaggctggagtgcagtggtgcaatctcagctcactgtaagctccgcctcctgggttcacgccattctcctgcctcagcctcccgagtagctggaactccaggcgtccgccactacgcctggctatttttttgtatttttagtagagacggggtttcaccgtgttagccaggatggtctcgatctcctgacttcgtgatccgcccacctcggcctcccaaagtgctgggattacaggtgtgagccaccgcgcccggccacactgaagtaattttgaagacaaggactggacttttcttttcttttgtttttttgagacggagtcttgctcttcacccagcctagagtgcaatggcacgatctcggctcacagcaacctccacctcctgggttcaagcaattctcctgcctcagcctcctgagtagctgggattacaggcacacaacaccatgcctggctaattttttgtagttttagtagagacgtggtttcaccatgctggccaggctggtctcgaactcctgacctcgtgatctgcctgccttggcctcccaaagtgctgggattacagcgctcctggcctgggcttttcttcagtaaaattctcattttctgatgtttatgcccctttaactcaggttttatcgtacatcctgcatcagtattaagtttcttcttagtatgaatgtttagattctattgctttgggttagaataaagtctcaaagtttggtttgtgatccataaggttatttcatggctggactttgccttgtttacatttgtcctttcactgtgaatacatagccttttttatcttttctactgaggccactgtagaatgttattttccacattcattcatactcatgaagtggtgggaagggttggatagatggtgttgatgatctctacaaagtgatgcagaaaccagtgtacttgtacctattaaaaagtgacagcaaaaagtacaaatgactccctcccacccccttgagccatttgcacataagcttcctacctgaagccctatggccttcagatactttaatacagtaattcccaaactttctggcaccagggactggttttggggaagacagtttttccatggactggagtgcagatggagatggttttaggatgaaacccttccacctcagatcatcaggcattagattctcataaggtgtgtgcaacctagatccctcatgtgcgcagttcacaatagggttctctctcctatgagaatctattgctgctggtgatctgacaggaggcagagctcaggcagtaatgctcatttgcctgctgctcacctcttgctgtgcagctcagttcttaaccagccatagactggtactggtccatggcccaggggttagactcctgctttaatgtatacttcttggaaacaagaacattttcctatataatcacagaataaccattcgcatcataaaattaacatgaatgcattactaccaccaaatcctcggaccccattcaagtttctccatctgaccaataataactttttttttttttttagttgtcaaatgatcctttattgaaatattttcctttgtgcttcttaactagctggccattctaccgcaccactgtttatgtcatctatgatgtcatgagggtggcggccatcagcattgcagcccacagactaggcagtccccaggatctctttaatcgttccagagagttctctggctaaagatcagtgccacatctgtcgagcaatgttgacaatctcatcaaaagtgatattttcaccttgtttaatattttcctgtttctttctgtctcctggcagttccttgagggctttgatgatcggtgcagagggagaaggtaccacgtcaatctgggcctgtctattctgaatagtcagtttcactgtaattctcagatccttcgaggtactggttgccctgggggccgatcttgggggccagtgcagatgtggcattgactttacctcgatacacctcagatacacaactttgatctcaaagctggggtggaacttcagcagcatggtggaggcagctggtgttggatgaacctggatttggtacaaccaaagagagttgcaccttggcctcttctgagccaaaaactgaaggcagtaatatcttctatagtaaaaagatccgtgttagaatcacacgttggttttgttaatcagggactttagtctcttcagtctcctggccagtgagtgctccttcaaacagactcctgtgtgtttttcttctctcataattctttgagcactcccttgctcttttgtacaagatgttttagtctcatctttcatttttttctgccctaggcctggaatgagtgatttctcctagagcccttgttctttttattaggaaatgctgtttcagagccaagttttgggggctagatgtgctcactgctattgaaaagttgctgctcataggcatcttcagtggtgagagctagggaatatatttatatatatacatatatacttccacacacatgtatcaatatttatgtccacattatttatatattttgaaaaccgtgaattcaaactaataccaccaattccatcctaacaccacaggattcaattctagttttttccctttctatatttgcagtccccatctctgacggtgataaacctgacttccattattatccttaaaatatttacagttatgcattatttaacaatggaaatacattctgagaaatgtgttaggtaattccattgttgtgaaagcatcatagaatgtacttacacaaacttagaagttgtagcctactatacacctaggctatgtgatattagcctattgctcttaggatacaaacctgtatagcatgttaccttactgaatactgtaggcaattgtaacaataacgatatttgtgtatctaagcatatctaaatatagaaaaggtaatgcactgcactatgatgttatgatagttatgacatcattatgttactaagcaataggaatttttcagctccgttataatctgaagggaccagttttatatgcagtcagtcattgaccaaaatgttgttatatggtgcacgactgttcttatttgattaacttccatctttgtaacccacttcacttctgccaccgtatccttttccacatcaatgtctttctcatcctacttgggctctgaaacctctatactattaatacatggattatttgaaggaggatttatggagatgatcttggacatcttaatcttaatcatacagacacagtataaatattctaagaccttaacatgtatctggttttgctgcctagaagaggaggcttgtacagcacctgttactcactttgcttatatacttgataccctggtctttgcatttagtaaataccagcataagaacctgctcgtgctttacaatgccttaggaacattagcagattcagtaggacatcattcaaacaaaccagaatatattcagatgctaatgcctccactgacccagaaatggaacatgttaaatggtgaagataaggatctcttccctttacctgagtgcctatcttcagttgccacagcactgcagtctggctttcttccatactgtgaacctgtgtaagagacaatgaggaaaacttgcccaagccatgctaaacaatgctcaaccagatcaatatgaagctccagataaagattttatgttagtgtctcttgatttactgagtggcctggctgaaggacttggaggcaacattgaacagctggtagcccaaagtaacatcctaacactaatgcatcagtggatgcaggataaaatgctagaagttcgacagagttattttgccctgttaggtgacctcacaaaagcttgctttcagcatgttaagccttgtatagctgatttcatgccaatactgggaatcaacccaaatccagaattcatttcagtctgcaacaatgccacataggcagttggagaaatctccattcaaatggatatagagatgcagccttatattcctatggtgttgcactagcttgtagaaatcattaacagacccaacacaccaaagacattgttagagaatacagcaataacgattggtcgtcttggttacgtgtgtcttcaagaggtggcccccatgctacagcagtatgaagaccctggtgcacctttctgagaaacataagagacaatgaggaaaaggattcagcattccgtggaatttgtaccatgatcattgtgaatcccagtagtgtaatccaagattttatatttttttgtgatgctgttgcatcatggattaacccaaaagatgatctcagagacacattcggtgtaagatccttcatggatttaaaaatcaagtaggcgataaaaattggaggcatttctctgaccagtttcctcttcccttaaaaagagcgtcttgcagctgtttatggtgtttaatacacttaagctgcagtcccaaaattaggggtccttcagtcttggagactatgagggagcctctgcacccagggaaaatactaccctttacggggggaagggtaaaccggtagggaatacactacaatctcaaccctactggaaggggcaggagggaggtgttgctgtcactgtattaggttgatgttgggaaacgttttaacatgtggagcctttgtgggttgaaatatgtctccagctacaactctgcactggatctgaagaagcaaaaaaaaaaaaaaaaaaaaaaaaatctgttcagtctactcacaaaacagcacattgtggaatattatggagaattgtaccaaaacaggaaccatataaatgatgcatagggacaagaaagaggaacaattctatagcgcacaataaaggaaacctaagaatgggagttacaaatagtaaagaagcttttttctttttttatttaaagttttttttttaatccaagttttcccacatgatggggctttgttttgcatattgatgaagaactgcacaaacagaactaatatagttaaaatcagcttgccttcccatagtagaagcaggttcttggaagttacaatttaaggtaccccaaaaaagttggaaatagaacaaaacaaacatgaacaatgaagcaccctgtgaaatgccaaatgagtcactccttttaccttttttggggtgtgcaggctgggtggaataaatggggcttggtatatcaaactaaagatgacatcttaattttgcattgaacattaatgtagcggatataatttgatggttgcacttcattagatttaatttctaggccaatatgttattttttaaagtgcagtttaagggttaggcatgctttctggctcatagtggttgaaagtaatttaaattagtggggaagtagcatgcttgcatcacatagagtgagactggtattcatttacctatgttgcagcaatttgtgttgcagtttaccaatttagtgtagccctgctacactaaattgttccttcttaagatttgtgggttttattttcattaagaatatagacatataaagtactgtagtttacagctagtccttgaaatgtcttttttaggatctgttaggaataagattgatattgcattgtgtgtaacctgcacaatgtggaaagctgatatacctgtgcaaaatctttgcctctgtgctgtcagtgtgatgtgctttctgcatggttatatactactcatgattctatcaaaacttctaaaatttaaattacgtggtaaaagatgtgtaaaaggctgcgtaaatgtcagttggcacataaagacaattgtagaagttgaaaaatgattgctgtatttcagtgttttatccccactcaacatactgccttctaagctttctttttttttgttcaaagcatgatcttaaagatatgtttaagttaatgggtgtaatgcagggttcctacgctgtattttggtgcatgttggtggccctctgtgccgtagatgtatgcacataggttgcaagtgaaaagctacagagtgaaagttggtttggatcctcttcatttcatttgtttagcttttctgttatttttctctacttacatgtattcctgtgaataaatccttgttaacctttaaaaaattaaaggtactgtttaatacttttcacttagttttgtatacacattatgacataacctatttacaaagtaagtttctaaggtatcacgtgtcataatagcaagctgcaagtaactaaaaatgtgatgctagcatagatgtggtagtggagggacagcttatagaaagttgagatggtcctaatgtaggtaaatagaaatctcaaactgatattgatactttcaggtatgctttgacattgagttacaaaatttgaacgaatagaagggagctactccaactccagtagtgaatcttccatgtacatttaattatcagtatagatctttttgtcctattaatataacttttaggtgtgaagaaaagtttaaatgtatgaaatgtagttgttgtgattctttaaacataattatatttttcttcattcagcattaatgtttcttatagattatgttacaatatgaagttcagttcaataattcttgagcttctactatgctccaggcatactcttaatttctgaggacactgaggtggataaggctgtccttgtccttaattagttcaaaatcttgtttgataggcagataaattataaacacatgatcgtagtatgaatttataaatgattagtatgcatatgctcttgaaataacaaaaggaaagtatgtgtgtgtgtgtgtgtgtgtgtgtgtgtgtgtgtgtgttgggtcattcagaagcttttgaagaggaagttaacttgtgagttgagtgttgaagaatgaatgcaagttttaccagttggccaaggaaattagatggtgagcattttagcatacggaacagcatgtacagcatgagtatatcacaaaatcatgatgtgtgagaggaacatcagcattgctgagtatagggtatggggtagagggtagttagaaatgaccccagggaaataagatggtggaaaggaagaaaaattcagtatctcaaactgaaaggacaaattatatttataaatcagatttttaaaataagatataacattaaatattataaatatttctgtatcagatcttcatacaccccacctatgtatgagaccatgaacagagtactttttttctgaacattttttctcataaaaatgaagttactggattacctaaactccttcttgatcaaagcctgtgttgcagagaaaaagtcagtgaacttaaaagtaatttgttaataaacagagtaggcggggtgcggtggatcatgcctgtaattccagcactttgtgaggctgaggtggtaggattgcttgagcccaggaatttgagaccagactgagcaatgtaacaagaccccatctgtacaaaacactaaaaaattagccaggcatggtggcatatgcctgtggttccagctacttgggaagctgaggtgggacgatcacttgagtccaggaggttgaggctgcaatgagccatgattgcgccactgcactccagcctgggtgacagagtgagaccctgtcttaaaaaaaaaaaaaaaaaaagaacagagtgtaatatgttccttttacctagcatagtacctggcatagagtagatgtataatgggtaatatttttggagaaaatattgaattctgcaatttggatcaagtagctattataaaattgttatagttaatgaggacactgaagctaagagtctttcactaattgaatgaattttaggagttgttgaagttgctattctggcctgaataagtaattaaatatttttcaatttaggttatttggttttattgtcccgtggtgattataagtattgctttcaggctcttcaacttctagtggcatttgtgtggtacttccgcaatcttttatccctttcctggtcctgggagtcaggcaacctgtattagcagaagctgccagcttggtagcttaagttgggttgcatggagacacagataggaaagttggtctgtggaacctctttctaccttttagtacatggtgaaggagaaaatagcatgataacattagaccaaccattgggaaacccagatttcagccgtagctgaataagtagtgtctcatatgaccacaaaatattccaggcttatcttgtattttccctgccctagcccttgagtcattatgtctccaaggaagatttttattggagaatgagatttagaaaccaagatctggggcctaggtgtgttcgttgctactgaggtgtaattacttttagttattgtggcagacagaactgacaattatatgtatacacacacacttctcttctatatttatttctgtatccatttccgtatatattaaagaccaagagctcacacggatacctttgactccaatcaaatgccacagaatttgttctagcctttcttcttatttttaagccttttctcagaaagtgagaaacttggtttctcaaccacaatatattttcttagttattcaacactgtgtgtgtgtgtgtgtgtgtgtgtgtgtgtgtgtataaggattatagtatatattcatacatagttatagatatagtatatatagtatattatataccataactatactatatttatactatattatatacacacagtttcagaattgctaacttacaccctatgaaaaagatttactaacttacaatatttgtttagcattttttttttaaaccttaaccttacagaatacaataagtactgttttccaagtttacttacgttagttgttttagttctcaatcctttcagcgtgattgtattattcatttgtaatacttttaggttcatttgttgctgtttgtatttcgttttgggttctgcccacatcgtggtttatttaaagtactcatttatttcatgttacttcatagagatcttcccttttcttctttttaaaaaaatattttatttttaaattttaacctatgtatgtatttgtttgtttattttgagactgggttatgagactggctaatttttgtatttttggtagagatggggtttcaccatgttgccaaggctggtcttgaactcctgggcttaagtgatcgacccgtcttggccttccaaagtgtcgggattacaggcgtgagccaccacacctggccgagatcatccttattctttttgtaccgctgtatactacttattttgtagattgtgcattgtttattcaattactctcccaacaatgggcatcaagattgtttccaatattttacagttataaactgccgtaatgactatgctagtatagagcagtattatttttgtaatttagataaaaaaacacatctaccaccttacttgtgtccataccagctcctattcagttgtgtagaaacttctgcatataaaagtgctagtcagtattactatatgaaagttgctatgcatggtattctattttcctagaacattccagtgactttctactcttacctaaagcttactggtaaatcttaagtgcattgattaataaatctctggtattaccataatctactcataaaatcatcctatgatatttttattaccacctcccccaaagtataatgtccttaagatatgaaattctgcagtaaaacagaacaaaaagaaaagcttttaaaaaatgttactgaaacttcatttgatgtaatatacaaaaatgtgatggggctgtcctcaggttaaatgggcactgatggatgcactgtaacttgactggtttgaggacagaaaattgaacctaaaataaggaaattctgactgctaaaggaattgaggtcactcaatacattcattttctctcatctaacaaaaagactacacataccactaatgcacttggcattttgatttattaaatatatatgttaactgaagtctgccaccgactgttataatcagtatagctgaaattactcatctgaagcctgtgaaggctgaagtaaaaaagtaaattttaaaaggcttaagtaaagtccagtcaagcaaaacttgatttgagcttactgctgaggtctacaacatattacattactgcaaccattagaagtcccaccagtcacacctgactcttctcctttttcaggtgctaatgtgcttctgtagtggcctatttctgtttcagcctttgtaaggcatcacagaaaggaaggaacaaatatttaaattatagaaagtgaatgcagtaagtataggattgactctaaaacagtagaaacaaataagcctaattatagcatttgagaaacagggtgtattcgttttctctggctgctgtgacaaattaccacaaatacaatggcttaaaacaacacactgtttgttatcttactatcctctctagcttacaagtcagacacatgtctctgcaggctaaaatcaagatgtcagcagggctaggtgccttcctggagactcgagggaagaatccatttccctgtcttttccaccttctaaaaactgcctttggttcatgacttccttcctctgtcttcaaaccgagcaacaccgcacctctttgaccattctccttctgtctgtcttctgcctccctcttccattctgagtgattattatacattgggccccctcagataatccaggataatacctctattttaaggtcagctgactggcaaccataattccctctttgctatgtaagctatcatatttacagggattattctgcttatcaggaaaattatttcatttctctgaaactcctgtttttattgtagtagaattcttaaaatattttgagaagccataattttagcatggagacacgccaaaatgaaacaatatttgtttgtgccttttgaaaggagctacatgctttcctactcatttcttcctctttatttctcagattttgaatttattcctgtttatttttaaagttcctgggtgttaaggtaggtttgttccagggaaggatagagaaaaatctaagatcatttcttgagagcagaagagaaatttgtaaagaattgagctatagctgaagtctaccctctttggttaataattcacagggaatacaatgatgaacagacttttttttttaaagtaataattttgtttcatagggtattctttgtgaagaatttatgtagacatattcacagagccttgttctgttttcttggtctgggaaccagtatattttaaggaagtttcttctgtacagtgcctgtattctggtgatgttttgtaagcttgtttaaagttgttcactcttaccacatctggccatttgagttttacagagagttagagtcatggcctgagcctattttccagaaagattttttaaatttaatttttatatattttgggaatacagatgcagatttttcacatgtgtatattgtgtagtggtgaaatctaggcttttagcatacccatcacctgaataatgatcattgtacctattggtaaattctaagccctcacctccttcccatcctcctaccttttgtagtttccagtgtctgttattccactctgtatgtccagctgtacccattgtttagctcccacttataagtgagagcatgtggtatgtgactttctgtttctgagttatttcacttataataataccctctagttccatgttactgtgaaagacatgatctcattcttttttatggctgagtaatattccatggtgtatgtgtatttcccacacttccagaaacagtttacctgaaatctctcggagtaggaatttttgggtgtcacaataagagtcggagataggaacactggattagaagtcgggatgagtgttagtctggatttatttattttcactaaatatgttttgggtacctaccagctagtaattttaaataagataatggcatttttttaaaccttcctggagaatttgttccattattcttttaaatctggaaaatgttcatatttaattattatatcccctccattgtttctgtgccccttttctagaacttctaataattggctgttatatctctgttgagcctctttttcattttctctttgttttcatttattttttaaacctttgttcttttaccttttttggccttttttttttttttgagagatttcatagagtttatttttaaaccaggcaatcacttaaccctttatggaaatttcaaatatattcacttgttattttctgtctttttttctttctttctttctttaagtaaccatcttactgggcgttaagtggtattttattgtggttttgattcgcttagtctcaaatgaggttgaacttttttgtgtgtttattgtctatttgtatatctttagagaaatgttttttcaagtcttttgcccatttaactgggctgtttgtgtttttgttgttgagttgtaagagttgtttatattttcttgataccagattcttatcaaatgtgtgaattgcaaatattttctcccattctgtaggcttcttgataatgtcctttgatatacaagtttttaatttttatgaagtccagtttatctatttttgttgtcattgtttatgctcttaatgtcgtatcaaagaattcattaccagtccaaagtaaaagtcacaaagacttatccttatgtttttgtttcgttttgttttttaaaaaagtcggggttttgctatgttgcccaggctggtcttgaactcctggactcaagcagtctgcctgccttggcctcccgaagtgctagaaatacagatgtgagccaccgcacccagcctcttttgtttttttcctgagagttttatggttttagttcttatattgaggccattgatccattttatgtttttgtatatggtgtgaggtaatgatctgacttcattcttttgccattggttgacagtttttttctttcaccattttaaaagtgccatctgagaccaggcacagtggtgcatgcctgtaatcccagcactttgggaggctgaggcgggtggatcacctgaggtcaggagtttgagaccagcctggccaacatgacgaatcctcatctctactaaaaatacaaaaattagcctggtgtggtggcgggcacctgtaattcaagctacttgggaggctgaagcaggagaattgcttgaaccagggaggtggcagttgcaatgagtggagatcgtgccactgcactccacttgggcaacaaaagcgaaactccatctctaaataaataaataaatgccatctgtagccgggtgccatgtctcacacctgtaatcttagtactttgggaggctgaggcaggcagatcgcttgaactgaatgagaatgaaaatatattttatcaaaatttgtagaatgtaactaaagcagtgcttagaaggaaatttatagtgatgaatacttgcattagaaaagaagaagggtctcaaatcagtaatcaaagcttgtaccttaagaaactagtaaaaaatcaaattaattccaaatcaagtagaaggaaggaaataatcaggaaaacagagattaatggaattaaaagcccaaaagtaattgagaaaaagcaacgaaattgaaaggtggtctttgaaaagatcaataaaattgataaacatttagcaagactgacaaaggcatagtgaaacaaagattacagggttgaaggaaaaagataccgctacaaactccacagacattaaaaagataatgagagaaaactatgagaaattaagcacataaatttttactacttgagtggaccaattccttaaaagcacaaactactaaacttcacccaagttgaaatagataatttgaatagccctataaccattaaagaatttactctgtggaaaaaaaaattccaaaaaagatcttgtccacatggtttcactggccaattttaccaaacaattaatgaagaaataacagtaattctacatagacttttcctgaaagtagaagaaaatggaaagagatccccaatttattttacaaatccagcaataacctcacactaaaaccagacaaataaattatatgaaaaggaaactgcagtccaatatccctcattaacatcgtagtgcatgcttgtaattttatgtggcttcagcagccatttcaaatgcaggtttaactttctagtgccagaggcagaggcaggccatagtcacccttgacacagtttccagttctatactacacccaaatgacaagctggtggccagaggtaagaattgagaggcatgactcctgcctagcagacagcgttctctttcccacagcttgcattaaatggaccattcacttatttgctaatgaacttaaagtgaccacaccctatttcccaatagtactagttgccaaactctttttctctctacctgcttgtgctccgcatgtggcctcaaggcattccctgtatgcttcaagttctgtaagtacttaaaaactcttaaattttcgcattgtgtgtgtttcattgaagccatgtccacaatctgacccataactgcaatgcctgccctgaagcgatccatgcaagtgaataccgtatgagcactcttttgtctgggcctctggtggctgctggtgacagtagctcccagcctgtgttgacagagaaacttgaagagttttattcaaaataaagatagtcttaaaagtcttaatataatgtcagcatattgaaactaacatgtaaaaacaaaacaaaacaaaaatataatgtcagcaaattgaaaccaacatgtaaaacaatgaaacaaaacaaaaaccaaacactatttgccaaatgggcttatcctaggaatgcaaggttgaaaatcgatcagtataatctatcatgttaacagtcttatgggaaaacaaatcctaacaattgttggagaaaagacatttcatttagcaaaatataacatcaattaatgacctttgcaaactaatagaaaataacttgacatcttcaaaaaacctacagctaacattatgttaatacttaatgaagaaagattaaatgcttttctcctaaattcgagaacaagacaaatatgtccattctcaccactcttattcaatgtagttaatgaagttcagccagtgttataagccaagagaaagaaagaaaagggatttttattttcagatgacattctctacgtggaagactcaacatatttaagatgtcacttcttcctaaatttataaagacttaatgcaattttttcatcaaaaccctggaaatacttttttgtagatatagacaggcttgttctaaaatttatataaaaaagcaagggaactagagtagcttacacaattttgaaaaataagaataaagtggcaagaattactctacctgatgtaaagacttaatagttacagtcatcaagagagcgtggtattggcagaagcatagacacatagatcaatggaacggaatagagaaccctgaagtagacctacacaaatatgcccaagtgatttttgaaaaaggttagaggcagtttaacaaatagtactgaaacaattggatatccataggtaaaacaaagtaaaacaaaataaatctcaacctaaacctctcaccacctattaaaattaattcagaatggatcatcgatcatataaaatgtgaactatgaaactttaaaagaaatatagaagaaaatcgttaggaactagggctaagcaaagagttctttgatattaaaaacataatccataagaaagaaattgacaaattgaacctcattaaaagaaaaaatgtttgcattgcaaaaaactctattaagaggatgaaaacaagctacagcgtgggagaagaactttgcaaaccatatatctgacaaagttctcgtgtccaaaatatctaacaaactctgaagttgaacaatacaaaatatcagcaatttaattagaaaaggagtaagagactttgacatttcaccaaagaggagatatggatgggaaataaggacatggaaagacattcatcataattaacccttaggaaattgcaaattaaaatcacattctatacacctatagaataaccaatataaaaaattgtgataaaaccaaatgctagtgaaaatgccgagaaacaacatttcttatatttctgatggaaattaaaatggttcagctggaaaaaatatatacaaatgctccaagctaaataaattgggctggaaaaagcctctttgtgctctagaagataacaaatgagagacagagtttgtctttgttcagattatggaaaataattcaaaagttacagatttagagagggaatacaccttgaattcatttctaaaccaacaatctttgaaaatagggttgccatcttgattttctggtccagatcacaagggagtaagactagctttaaatttaacattcattacccaggttgctctgtagccagatgccaaagggtcacatcctgtggcacacaaggagccacctctgttctgatttcattaaactcccctgaaatccacaggatacacagggggctccatgccttgatcctcagtatcaaatgactgtaatttcactatgccaaccccttcgaaacaaacttacccctccagttccttttgttgatggggaagcaggttggagtattctcagcttactaacaaagttgtttaaggagtcttcttagtcctttgacctattgctcccattttcttgattttaagtgttgtttaatattggacaggattagtcatgcaaatacttaaaagtgagtggacaggaagcaagcatatgccactggtacaaacgggatatggagctcaagctgcttgattttgtttcacactaaatgaaattagtgcttgtttaggacaaacctggtgggccaccacagtcgagcatgtttgtccgattagctagtgaactactaaatgtgtgttctgttccaattggatcattgtcctcaaaagtcaatttttaaaagtttgacttaaaaaaaacaagattcctataactaataagtgagtttagcaatgttgcaagatacaaaatcaatgcacacaattcttgtttctctgtatcatcaatgactagttataaacttgagtaaatataacaatgttgtttataagatctaccaaaacacttaggtataaatctaacaaagtctatactgaagagtatagggatcttatgaaagaaattacagaagatctaaataaaaatatgacctacataaatacataaagtaatgtggtgttcatgaattggaagactcagtgtagtgaagacatcactccatcccaaagtgatgcaataccaatcagaatcccagcaggagtaccaatatgttttgttggaaaaagcagaacaaagctggaggaattgtactaacccattttaaagctacagcaatcaggacactgtaacattgacaaagggacagtcaggtaaatcaatggaacgtaatagaggctccagaaaagaaatggaaccacataaagatggcctgtggatctttgacaaagatgtaaaagaaactcagtggagaaatctttcaacaaatgttgttggaaccatttgatcgttcatatattaaaaaacaaaaattgaactttgactaaaattttacatcttattcagaaattattccaaaatcgatctttggtgtaattgtgaagtgtaaaactgtaagaaaacattttaaaatactatgacctggagattaggtgaaaagttattagaaattatgccaaaagcatgatccataaaaaattaactggattacattaaattaaaaacctttgttataccaaagatactgtcaagaaacaataaaaagttaaattacagactaggagaaaatatttgtgactcacatatctgtcaaaagacttttatccagaatgtataaagaactcttaaaagtcagcaataagtaagtagacaacccaaataaaaaaatgtataagagacctgaatagacactttatcaaaaaggatgtaagagtggcacataaacatgtaaaagtgtgttcaacatcattagcaaattcaggccatgctgagacaccactgcacacctattagaagagctaaaataaagattactgacagtaactaagggctgttgaggatgcggagcaactagaagtctcattcattgctgattgatatgtggaatgttacagcaactctgggaaatgacctagcagtttcttgagaagtaaacatacactcactgtatcatctagcagtcctactcctgggtatttaccatagaaaaatgagagcttatattcacacaaaaagttgtacatgcatgcttataataacttcatgtatagtagttaaaaactagaaagaatcgaaatatccttcattagtaaactggtacacaaactgtacattcgcagtggaatagtactcagcagtaaaaagaaaccaatgaaccttaaaggcattatgccgagtgaatgaagtcattctcaaaatgttacatgctgtatgattccatttatatgatattcttgaaagacaaaactatggtgatggagaacagatcagtgtttgacagaaggtatggatgggaggagggtgtaactataactggatagtgtgagggacttcttcgagggtgaagaaactgttctgcatcctaattgcgtaggtgtttacacatctatttgtgctttaaaatttataaactataccccccaaaattaattttacagtgtaattaaactaatgatggtgtcattcatttgtcagaaacatttgtagtggaggagatatgtgtgaaggaagcactgacccaccgtctcacagttcactctatttgaatagaaatgtgttctcaaagtccaaggaagttctatggtaaacctgctcatatgtgctcagagttttaattccagtcagtcttacgggaagcctctggaagccagagaatatacatatttgggttttcattgtcatactcccaagtaatgattgcattttaatggtctactaaggaaaacaggtctatatggatgttggctcccaataagtgcaggactgccagttagagaaagaggctgccacaacaaacagggaatagaaactctttcccacattaaccaatttccgcactgcgtggtttcctcttttcctgtaaaaatgcagtttctaccctgtgcagatgatttctaagctggtgaagaaaagttagagtaagttaatttttttttctcctattacctgaacccttactctaattctaatgatatctgtgatgtcactcttctcaaaatctgatgttaaacatagacctccccaaaagatggacaagggaagaattgcctaaagcagatgttagaattcagtaatcttactctacggtgttttgtcagacttactgttcaacatcttctggttgtcatctatttggtaatgactcccacaatttaaatctctttgcttaacctagacccctatattcagttgtcctttgaatttgtcttctcaaagatgcagcatgcacatcaaaataattgggcttcaaaactatgtattcttttacattctaccagatttggccttcctttttggttttgcttccattattgttttatttatttaatcttttccagctttattgaggttgactttcctttttttgttttgcttccatcatttgttttatttacttgtttaatcttttccagctttatttaggttggccttccttttttatgctatattttagttaataagcatcatacatttgtttctcaagccaggagctaaggagtcatccatggcttcttgcttacttctcagttaactttcgtcctgtagagtctaactcctcagtgtgtttcattactgcttattctttgttctcactgacactgattagtatcaggccactgacatatgccacatggattctgcaatagcaacaaaactggtttttctgtctcacttaaatccattctctgcactgcagccagaataatacttctctagtgcaaatctcaatttgtcactttttaaaactctttagttttgtttacctgggcatatcctgtacccaggttagtgctttgcatatattagtagtgttatttgtaaattattgagaatgttattctggatcaatgcctagccccccaaattggctggctgccaagactgatggtaccacacatgtaccaaaagtatttgaaaagacttaactcacaaaatgagactttctggggagaacagggcagtcacccacactggttcacaatggtttgcatggaggggaggggcgggtggcactgatatttgtcatggttagtgaatgggctgggttgaaggttcccacatggcaggctggttttgtgtgatttgaacttcccaggggtgccaggacttaatccaacatgaagttttacttattataaaagccctatgtcctttttacataaaggaaaaatttattattacagaaaagtaaaaaaaaaaattaaaaacataagtatgtgattacgttgtcacatattggaagattatacttgtccttcagtttatcacctgccagatatttgaatgtatttttcagcattaaaattgtagtcatattgtgcatatgtaatctgcttattttcttctcccccattttacagagtggatctttatctaatgagaggaatgtttgaaacatcataaataaggatttatttatatatgtttgattttctttttttcctctctctccctccattttttgcctctcttccttccttccttctttccttccgtgttcctcttcccctttccttttcgactgggcttttttagtaacttcatagagtgatataattattctgtcacctttacattcattagagtaggctcactcccattctttgaggctgtattttttaaccattcattataaaatgaaaggtacagaaaatcacataaaatgtagcatttagttggttattaaaagtttggcatctttttaacagtggtgacagttctcctttcactgattcagtgctgctcagcaggccctgctctggacttagagcacaacactatattgctttggattctttgccgtggccttaattgtcagatctggcccagggtacccaacactgtcttgtttcacacatactcagacacacatacacaaacagccaaatgtttcttgagaggatatgattttggggggaatgaaattacttataatgcttattgtgataaatgagaaaacataggtactgtaaatcaaaaaaataaaaatctcatttcttctattttattttattatgtttatttatttatattttttgagacagtctctctctctgttgcctgggctggagtgcagtagtgcgatctcggctcactgcaacctccacctcccgggttcaagagattctcctgcctcagcctcctgagtagctggaattacaggtgcctgccacaacgcctggctaatttttgtatttttaataaagacggagtttcaccatgttggccagggtggtcttgaattcctgacctcaggtgatctgcccgccgtggcctctcaaagtgctgggattataggcatgagccaccgcgcctggcctatttatttatttaaaaaaattttttttttgtagagatgggatctccttatgttgcccaggctggtctcaaactccttggctcaagcgatcctcctgcctcagcctcccaaagtgctgagaatacaggcattagccactttgcccatccagaaatctcatatttctaaaagttaatctgtattttggtttctttccaagtattttctatgtatattatagtgtttttattttcataaaatggttaattctgtacatgctgttttagataactgcttgattgctctctttttttttttcttaaaccagttaacttctagttctttaacacagaactatgttcaaatggaaaacatttgtgaagaagcataaggaacattttggagttaatgtatatgtttgttgtcttgattttgatgatgtttccgtaccatgactgtaatgtcaacatttatcagtttatttttcttcgacttttatttaagtttatgggtacatgtacaggacatgcaggtttcttacacatgtaaatgtgtgccatggtggtttgctgcacagataattctatcatccaggtattaagcccagcatccattagttattcttcctgatccaatccctcctcccaccccctgccctctgctaggtcccagtgcatgttgttccctgcaatgtgtccatgtgttcccatcattcagctcccacatgtaagtgagaacgtgcggtctttggttttctgttcctgcgttagtttgatgaggatgtcttccaactctaatgatgtccttgcaaaggacatgatctcattccattttgtggttgcatagtattccacggtgtatatgtaccacagtttctttatctggtctgttattaatgggaatttaggttgattccatgtctctgctactgtgaatagtgctgtaatgaacatatgcatgcatgtatctttatataatagaattatttatatttcttcaattatatatccagtaatgggattactgggtcaaatggcatgtctgcccctaggtctttgaggaattaccacaccatctatcacaatggttgaactaatttatacttccaccaacagtgtaaaagtgttcctttttcttcacagccataccagcatctgttgatttttgacttttcaataatagccattctgactggtgtgagatggtatctcattttggtttttatttgcatttctctaatgatcattgatgttgagcttttcttcatctttgttggctgcatgtatgtcttcttttgagaagtgtctgttcatgtcctttgcccatgttttattgggattgtttgcttattttctagtaaatttgcttaagtttcttgtagagtctagtgactagacctttgtcagacggatagattgcaaaaatttttctcccattccataggttgtctgttcacccttatgatagtttcctttgctgtgcagaagctcttaattagatcccatttgtcaatttttgcttttgttgtaatgcttttggcattctcatcatgaagtatttgcctgtgcctaaatctttacctgaatggtattgcctagattttcttctagggtttttatagttttgggttttacatttaagtctttaatccatcttgagttaatttttatgtgtagtgtaaggaagaagtccagtttcaattttctgcgtatgaccagccagttcttccagcaccatttattaaatagggtgtcctttctctgttgcttgtttctgtcaggtttgtggaaaatcatatggttataggtgtgcagtcttatttctgagttctctattctgctccgttggtctatgtatctattcttataccagtactgtgctgttttggttactgtagccttgtctgtaaagtgaggtagcatgatgccaccagaatctgggtgctcctgtatataggctcctgggtgcctatatatttagttctttttgcttaggattgtcttggctgtttgggctcttttttggttccatatgaattttaaaatagtttttttctaattctgtgaagaatgtcaatggtagtttaatgggaataacattgaatctataaattcgtttcggcagtatggccattttcatgatattgattttaccaaccatccatgagtgtggaatggttttccatttgtttgtttcctctctgatttctttgagcagtggtttgtagttatccttgaagaggttctttacttccattgttagctgtgttaatacgtacgtattctcttctttttgtggcagttatgaatgggacttcattcatgatttggttctcagcttgccggttgttggtgtttagggatgctatccatttttgcacactgattttgtatcctgagactttgctgaagttgcttatcagtttaagaagctttggggctaagatgatggggttttctagatatagaattatctcatctgcaaacaaagataatttgacttcttctcttcctatttgaatacctttcatttctttctcttgactgattgccctggccagaacttccagtactatgttgaataggagtggtgagagagggcatccttgtcttgtgctggttttcaaggggaacgcctccagcttttgccctttcagtatgatattggttgtgggtttgtcatatatggctcttattattttgaggtatgttccttcactgcctagtttattgagtgtttttaacatgaagagatgttgaattttatcgagggtcttttctgcatttattgagatagtcatgtggtttttgtctttagttttgtttatgtgataaatcacatttattgatttgcgtatgttgaaacaggccttgcatcccaggtggataagctttttgatgtgctactgccttctgtttgccagtattttgttgaagatctttgcatttatgttcatcaaggatattggcctaaagttttctttttttttattgtatctctgccaggttttggtatcaggatgatggtgacctcatagaatgagttagggaggagtccctcctttttaatttttttgaatagttttaagtagaactgctaccagctcttctttgtgtacctctgatagaattcagatgtgaatctgtctagtcatgggcttttttttttggttggtgggctatttattactggctcaattttagagctcgttattggtctgttcagggaatcagtttcttcctggttcagtcttgggagggttgttggggtgatcagacccaacagcaggtcgtggggggacgaagtctggtggaatcaaaggaatgagaaaaagacagtttgagagagaaagtgggaccagggggccattgtgaatgtggaggctgtgaaggccctgagttctgggagcccatgctatttattggtgctcaaagagacaggtggtgaggatgtgggggttgaaaggaaatggtgtatcaagtgaaccagaaacatatgggtacttgagataatgggagtgctagaagcaaggagccagcaagtctagcagacatgtaagccctgcctcagcttctcttccagctactcagcttttctcccaaaaaaggtgtatgtgtccaggaatttatctgtttcttgtagattttctagtttatgtgcatagaggtgtttatagtattctctgatgattgtttctatttctgtggggtcagtggtgatattccccttatcatttctgattatgtttctttgattcttctctcttttcttctttactagtctagctagttgtctattttattaattttttcaaaaaactgttcctggattcattgattttttttttttttttgaaggatttctgtgtctccatcttcttcagttcagctctgatcttggttatttcttgtcttctgctcactttggggttggtttgctcttggttctctagtccttttagttgtgatgttaggttgttaacttgagatctttctagctctttgatatgggcatttcgtgctataaatttccctcttaacagtgctttagctgcatcccagagatggtggtatgttttctctttgttctcattactttcaaagaacttgatttctgccttactttcatgattttctcaagagtcattcaggagatggttgttcagtttccatgtagttgtgtggttttgagtgaatttcccaatctcgagttctaatttggttgcactatggtccaagagactgttatgatttcagttcttttgcatttgctgaggagtgttttacttttgattatgtgatcaattttggagtaagtgccctgtggccatgagaagaaatgcatattctgttgtttttgggtggagagtcctgtatatatctatcaggtctacttgatgcagagctgagttcagatcctgaatatctttgttaaatttctgtcctgatgatctttctaatattgtcattggggtattaatgtctcccactattattgtgtgggagtctgcgtctctttgtaggtctctaaaaacttgctttctgaatcttggtacttctatgttggctgcatatatatttaataagatagttagctcttcttgttgaattgaaccttttaccattatgtaatgcccttctttgtcttttttgatctttgttggtttaaagtctattttgtcagaaaccaggattgcaacctctgctttttttatgttttccatttgcttggtaaatattccccttccctttattttgagcctatgtgtgtctttgtatgtgagatgggtcttttgaagacagcataccgatggatcttggctaattatttagcttgccattttgtgtcttttaattggggcatttagcccatttacatttaaggttagtattattgtatgtaaatttgatcttgtcatcatgatgctagctggttattttgcagacttgtttatgtggttgcttcatagtgtcacttggtctgtgtacttcattgtgcttttgtagtagctggtaatggtttttcctttctatatttagtgcttccgtcaggagctcttgcaaagcagacttggtgatgatgtattccatcggcatttgtttgtctgaaaaggatcttatttctcctttgcttatgaagcttagtttggctggatatgaaattctgggttggaaattcttttctttaagaatgttgaatattggcccccaacttcttctggcttgtagggtttccactgagaggtctgccattagtctgattggctttcctttgtagatgacctggtctttgtctctggctgcccttaacatttttttttttcattttgaccttgagaatctgatgtttatgtgtcttggggttgatcttctcttggaatatcttattggggttctctgcagttcctgaatttgaatgttggcctgtcttgctacacaggggaagttctggatgatatcctgaagtatgtttcccaagttggttccattctccccatctctttcgggtatcccaatcagttataggtttggtctctttacataattgcatatttttcagaggttttgttcatttattttcattcttttttctctaatcttgtctgcttgttttatttcagcaagatagtctttaagctctgagattctttcctctacttagtctattctgctattgatactggtgattacattgggaagttctcatgttatgatttttagctccatcaggtcagttatgttcctctctcaaccagctattttgactatcagctcctgtgttgttttatcattctgagcttctttgcattgggtaataacatgctcctttagctcagcgaagtttgttgttaactcaccttctgaagcctactgtgtcagttcagccatctcatcctcagcccagttctgtgcccttgctggagaagtgttgcggtcatttgcaggagatgaggcactctggccttttgagttttcagcgtttttgcattgattctttctcatatttatgggcttatctaccttcaatctttgaggttgctgacctttgaattgggtttttgtggggtcttttttgttgatggttttattgctgttgttttctgtttgtttttcttttaacagtcacgctactcctccaaagggctgctggggtttgctggcattcttcttcagaccctagttgcctcagtttttttcttacctggagatatcaccagtgaaggctgtgaaacagcaaagatggcaacctgatcctccctctggaaactccattccagaggttactgacctgttggcagcctgaaggaggcacctgtgggaagtggctggagaccctgttgggtgatctcatccatttaggagaaacaggatcagggacctacttaaagaagtagtctggctgctttttgttagcacagctgtgctgcgttgtgggggacactttcttgttcggactgtctggactctcctgagccagcagactggatcagctgagttgaccagacggcagagatggcggctgcccctcctcctggaaactcagtccttctcaggcagactccttgttactgctggctggctggaattccaagtcagtgggtcttaacgtgtaaggtgccgtgcaagtgggcctgcagatcgatgctgcttggatccttggattcagctccactcctagtggtatgtagggacagatctgccttgctggtaatcccgggggtggaatatgcaaaactcatgtatctctgtgtgtgtgcccaagctgctgctctacctggacgccacacagctctgtgtattggtgacatgggcttatgagaggatctccttatcctctggttgcaaagacctgtgggagaagtgtggtttccccaggtgggattgcacaatcactcaccacttctcttggcagaggttgggggttcctttggctccacattgctcccgggtggactgttgccccaccctgcttttcttcattttctgtgggtcaggctgtttgtctagtcagtcccagtgtgagaacctggatatttcagttgaaggtgctgagttcactcactgctttcattcctctccgtgagtgccgcagactgtaactgcttctaattggccatcttggcactctctcctgtttgctttaaatgtgtacagtttaattgcatgtcaaacattctgcaatggagtttttaaaaatgaaaaaaaaatttccagagattttgtttttcaaataatttttctagttacttttagtctttggagggcccaacacaaaattgaatgtatttgcatggaacacccaacataggaaacagttttaattttattcatattgtctgtaataaagtagatatttcccttctataagagtttttttggctgggcgcggtagctcaagtctgtaattccagcactttgggaggccgaggcaggcagatcatgaggtcaggagatcgagaccatcctggccaacacagtgaaaccccgtctctaccaaaaatacacaaaaaaattagccaggcatggtggtgggcgcctgtagtcccagctactcgggaggctgaggcaggagaatggcgtgaacccaggaggcggagcttgcagtgagccgagatcgcgccattgcactccagcctgggtgacagcgagactccgtctcaaaaaaaaaagagttttttatgaccatgatgtctcagtcttttaaaagtttgttggacttttgatctttttacttgtatatactaaggaaaggtcttatgatatttggattcattcttggattgtaaggacgcaccagtgggctataggtcaaactgagtttattaccttaaccttagtttttgtttattcagttctttaggcttcagaacaacagtctttgaaaataaaacactacttttttaagaagagataatagctagtaaggttgcaaataaaagccagcagggactgcatatgctaggttgaatagtctagtcttatcatagaaaaagaacaaattgagtcaagccaaggaggtgacagagtgcttaatggtaacaggagatgggtttggcacaagaaaggaaatggaataaccacattgttaaagacttattttattatttatgtaagtggtccaatccctggaaataatagaacagcctctcacctcttataccaattatgaataaattttgggcaattctttactatttttgattcttcagtattttaccagggaagatgttaaaaacatggacttaaaagttttttaatatgaaaataaaaatctattggggaggaaagactaggaggaagactaggagaaggatgttagaaatagcttaattaaactagttgaatctatttttatttttaaaaaacttgaaaacctattttattctttcagtgcagataatgagtgaattcaggatatcatatagttcgattttaaaaaataatggttgacatatccttagagctagattatggtatattttttactgcttttgttcacaggatattttgaataatcttgaatcatgtgaccttgaggatgatgatcttatgcttgatgtggatctgcctgaggatgcacctcttgaaaatggtaagttgagacaatattgaaccttcagaggtatatacttgagctactcgactgtagccaatttgatatttgttacttgcagacttcttaatcttaatggagcctttcagactgagaatcagtcttaagtgaggtaaaataggttcatttgcaaactaacttaaatatttaaaacctgattttgtaagtcttagatataattctctatcatccaataacattgtataccataaagtaagttgcagataagagttgtctttttttctgtgtatgtacccagtttttcctccctttatctcattttgattttaggaagaaatgtatttacagaaacataccatcttacttgtgaaacactataatatcttaatttgataaatattttatagagattaattctgggaatgtgatgaccttctgaatggatcattctgtacattttactcccaattctagtctatctttctctctagagccaagtaactgctggggtgaggctttaggtaatccatatgggagaggggccttaggttcttttcactccagtgacatagcacttgtaggattttttttatcttaaagactgttggagaaccagaaaccagcataaaaaagccctggaggcaaaggttgaaatggggatactcctggggagagggctgcccttagaaatctgagaatttcctgtcaatcaacatttgcctggtctcacaggcctccatgggctggaaataaagtgaaaatggtgagtgggatccttttatccatggtgctagaaaaatgcaaggaatatttcagagaggggaggtgtctgttccagtgcttcactggggtgttagtagcctgctttgctgctttactacaagcttatatttgtcatactggtgaggcttttatttttcctgccagaatgctgtatggcattctcaaaatctcagttgctttcaaaataaacgtgtatttttctcattcatggatctaaggattagctgggaagctcaggctatgggactagcttgaggtctgttccatgtttcttcattttgagaccaggaccactgtggggcaggttgttctcacgacagcagaaatgcaacaggatgagcagaaacatgcatattatgtctcttaaagtcttagctaagaactagcacattttttttttagaataacaaaaaatattttactaaaacgtaagatttacagaagtttccagataagccatacgaaatggtcacaagattttttgaagaggggaatctacacttgacagcaaagtcacaatgttgttagtgagggctgtgatatttgtttaatgttcccattttagttcaaacagtcaagcttgtccatctacattgtctaaataaagttagatttggttagagagcgtattctaaagaactgcttagctgcttttaaccaatgcagttagatcaccaaaaaacgggagaaaggagcccataaaattaaaataaaaccagctcccttctcaaaaaaaaaaaaataaaataaagaaaaacacccacacccctggagctaacctgacaactatcttcattcacagaggacacttatttctaagcacattcttttggccaaagcaggtaacatggccaaacctaacacctttgagactgggaagtgtactcttcataatgaaggctctgcacatgatagaggacattgcatgtataattctgtaaggagagaatgaaaagttgaggacaatatccaccactgtctcacagagacagagaatgttacacctttttgtggttctgctgtcgcttagtatgctctggcaaacagctgagttctagtgctgaaaaagaaaaaaatcacaggcaacactgaggaagaacaaggaaaatgacagaaccctgaggattagagtagtcaaaggagataatcacttagattgaattgcagcacaattctttctggagttaaaagacaagacttcccaacagaacagtttattcagtaaatgacagaaagcatcactgctattgaatctgaattagtgacttgaaagatcaagtagaaaaatattgtagaacacagaggaaaaacataaaccattggaaagttataggggaagaataatgagacttgatgatctgggaaatttaatggtaatttttagggctggtagtgaggagtgagggatttacttcctcggaataaatcacatgctaggtaatgcattttactttgacagaattgtaacaacttctcttggaaactttatgccctttctgagtggaagtagaaagaaaggatcttagagcctgccttatctttagcagacaacagaaagttacccaaatattagataaaagtagaatcacagggaaatttagtctttgaggtcttgattggggacttgtgaaaagtaggagggaactcttgggaacatcccacataaacagtactttagatttttctagaagaaggcaaacaactattggctattttgagtaaaggaacattaaagaaagcatgtaagaacatggatctaaaatatgtagcctcctgaggcaccaaagataaaatagtatctaggtttggtactataggaaagtgggaaatttttctttttatggctcttaagtcccgaacaattatacacacccattacagttttttggctgggaggatgagaatgttacagggactgatagagatttagggagtctaataatgtgctttccactacaggttttagtcctttatagcttctggttgttgatgatattatgcaggtttgataaagatttagatgggggccaggcatggtggctcatgcctgtaatcccagcgctttgggaggccaaggtgggcagaacacaaggtcaggagattgagaccatcctggctaacatggtgaaaccctgtctctactaaaaacacaaaaaattagccgggcgtggaggcacgtgcctgtagtctcagttacttgggagactgaggcaggagaatcgcttaaacccgggaggcagagattgcaatgagccgagatcacgctactgcactccagcctgggcgacagagcgagactccatctcaaaaaaaaaaaaaaaaaggtttagattggtcactatgaactataatgaattgccactaattctcccagtatcagtggagttttggcccacagaagagtggcacctcactgaaatctttaatttggatacaagtttgctgtgacctcattatgaatgacaattgtcagattatcatttcatggaagaagccatgaggagagtatttttctggtgaatgcatttgtgcagttaatctttccctattaaatgtggcatatgtagtagcaaaaataaggagagaatgttggtcaaatgttttctggactttcgtgagttaggatttggagactgttattggaggaaagtttttggagattgtattaatccattctcacgctgctataaagaactgcctgagactgggtaatttatacaggaaagaggtttagttgacttacagttctgcatggttggggaggcctcaggaaacttgcagtcatgctggaagggggagcaaacatgtccttcttcacatggcagcaggagagagaagtgctgagcaaagggggaaaatccccttataaaatgatcagatctcatgagaactcactatcaccagaacatcatggaggaaactgcccccatgattcaattatctccacctggtcctgccctttacacatggggattattgcaatttaaggtgagatttgggtagggacacagagccaaaccatgtcagagaatgtaggggcagaaaagtatgatactttttctcaaccatcttaagggtcatgactgacacacctataacaaaagacaggttaacaaaaaaagtggaacacatttatttaatcaaaatggtacatgacacgggattcttcagaaatgaagacccaaagacctagggaaaaccctgattttatgcttaggcttggtaaagaatggacagctatatagaaatgtgattggacaaaaggttatgatctaatggtgatagatggagggcggggagggtgacccagcaaggcctgtctgttcagattctctgtagtattcctgcctcccaggtatggtgcagaacccctctggaatgagagtcttcaaggaagaaaggaaaagagagtgagtgacctttctaggttttagggcttcctttgagggagaggatttttagtttctatgacctgccttggggagaggaattctggtttctgtaactcactttgcagaaggaagaagggcaggaaacaggaggataggtagatctgaaagaccttgcctctgaggcatttccagtttccctcagttcaaagtactcatcttgccaaagtgccacactttgtagtatcatgttctgatccccaacagagaagtccacacctgagtgttttggtgaccctgagtgtaagctaacacttgcggggtctaaggttgatattttagtgcctgtatcaataaaacatttgtaaggttgtcctttaatatttagagaaatttatttttgagcttaagggtaaaacagaaaatttggtgcttgacttccccctcagaatactttgctaatcacacttttttcttctttatttcttatctcatgctaaagacttccttcagaaggcctatatttttctctagctggggttctcaactcatagttagggcccagtctcacctgcatctgcatctggttgtgatcagcacattgggtttttgaactgggataccttgaagttcaccagtttttttctttagtttgccacaagccaccatcattccttatggtattacacacattcagagggacttttctttcttaatcttatctgtcctgttttaaatttaaatttatcagtctctgggtcaggggcggtggctcacgcatgtaattccagcacttgggaggccaaggcatgtggatcacttgaggtcaggggttcaagaccagcctggccaacatggtgaaaccccttctctactaaaaacagaaaaaattagccaggcgtggtgatgtgtgcatgtaatctcagttactcgggaggctgaggcaggagaatagcttgaacctgggaggcggaggctgcagtgaggcaagatcatgccactgcactccagcctaggcaacagagctagacttcatctcaaaaaaaaaaaaaaaattgtctctggaaaccgaatttgtctctgtcttgtaattttgtttgctttctcatttcttctctattgtttcagttattttgtcagggaacctttaatcttttctaagaaaccatcagcagtgttattccacattatcttcttaacagcgtttaaaaatatataaacacgtgattgatggatgccttgagaagttaaacatgatacttcctgcagaatcttggagcagtcatttctctagagtttaagcccaccttgtctaagtttgaacattagtcttttgtggttatggcaaatgtttgcttctaatgcttacttaccattatgtccatgtttgagttcaagtttcaataaagattcctcaatttggagtctatatgtggagcccataacttttagcaaatacaaaagcaccacatcagtttctacattgtaattgctcacaatatttaacccatctcctggcctattcgcccgatttgcttgcttcttcctctgtgtggactactgtgtggatatcattcaaataacctatcaagtggttttttggacaatatttcttgctttgggagtgagtggaatttctctttcctgaattgaggaaaaatatgaattcagaacagttaaatgtagattatcccttcgttatatagagttacttaaactaaagaaacattttaataccatgtagaaatacttaactgggtcttaactgaatctatgaatataatacaaatatgaatttatatatgatgttgctaaaggcactaagctaaaagcaattttaaatcttgaagcctgggcatggtgattcatgcctgtaagcccagcactttgggaagctgaggtggaagaatcccttgaggccaggattttgagaccagcctggccagcatagcaagtccccatctcttaaaaaaaaaaaaaaaaaaaaaagactctccatggcggcttgtgcctgtagtcctagctgctgtggaggttgaggtggaaggatcacttgagctaaggggtttggggttacagtgagctatgattgcaccactatactctatcctgggtgacagattgagaacctgtctcaaacaaaaagaaaaaccttctcgagatgattactttaaattttcttttgctatcttattttctacttctgacatttttggacataatggtcaccatgcctttatttgtgaagttttctataactgaacttaaaaaaaaaaaaaaacttggtttattcctgtaagatgacaacaaattgaaataagttcaaatgtaaggcttcttttaaaacatgaacaaaaattcttttttcacattattaaatgtatatttcttcttcctcaaggtgactataatgaatataaacaaaatttcagtgtccttttaaaaatgttttaaattgttatacatttagaggaaatacattaaaatgaattcagtatatatgagaactgaacatctatacttttaaaactacaatatccttttttggaatgccaaagtttgtttttatctggtatactgtaatgaaacactcgtcatgtttcaaattcaggtttttggttcagtgaaacagtaatttaaataagcgaggtttttttttttaatggggattatgttgatttttatagctttttattacaaggaattctgaacatgcaggacttgaactttctcatgtagtagttctcagactagagaaacctttcctgttttgtggcttgggttagtgtttagcagtatttttagtaaccgtcctaagtcagtagctatgtaagcactgagtgaagatggagtcacagggcaaactgggcttgcttcccacagggagggctgggttttgagcaggaaggaaggcctgttcagcagtgccttgggtacaactatgtctgagtaggcagccggtaacacaatgtctcccttgtgcaaagtaactctcttagtgagtgctcagatatgtgaggaaaaagtatttgggtaagtgaagaagcttggggtgtttcaaagagattcttttcgtgtttttgtggtatttgggtttaagggagtgtactgtttgttgctgcaaactactggctttgttttcagtggcattttagactttttgaacaagctcttactgcaggcagattgaagcgtcttactttccgaaaatgtgagcttaattttaaaagtgtgatttgtttgtgatgaaaagttaatttgtgcttcttgagatcagtgaaaattaattgtagcagtcctttataggaatgagttctcttaaaaatctgctgtttcctgtcattttcattctgaaatcagagccaacttgtgacagtgatgaaaaccacctaaaactgattatgagtgtttaaaatgtataatgttgatttcaaggttaatttgcctgttttaaaacagtgtggcagttaattgtttacatgactgtaatgtaaaagtattataatttacttcattttgaataatattaagttcagttttcaccagaagaactggttatgcttttagaaatcttgatattgtgattaacataaatggctgatatttttaaactattatttttatttgatttacagcatttaattatcaagctataagagtcaacttttatggagtatgtacatgtttatagtcttttgcttttgaatctgtctagtggagtgtgacaatatgaaccgctttgaccgaccagacagaaatgttcggcagcctcaggaaggtttttggaaaaggccaccccagaggtggagtggacaggagcattaccacctcagccaccctgaccactatcatcaccatggaaaaagtgacttgagcaggtaattactgttctgacttagatttcatttgctgtcctctgattttgaattataattctccctttcccagaaccctcaaaaaacctgtttttgtctggtttgtttttagaggcaccaaaaagcacttcaagttttatgtggtactaattggaataatatgtctaatttgttctttttggcccaaatattttttcattagttttatcttaaatataaatactctatttatatctgctttttggacttcaagttatggtatgattttctagctgtcatttggaaatgattaaatgttaactgtgttaaatttcttagtttttccaaataatatttaaaattagtgccaagtgattggtcttttgctcatgtaataagttaaaatttaaaaattccacaagtaccattaaaaacagaagaaggtactgtttagtgctgaaggtactatttagtcttttctttttcaaagtagaggatagtctttaaattggtcagatcttattttgtaatgaggctccgtagtcattcaaacctggaatcaaaacctgacctggcgcagattagctttgcaagcttagataatttatttaaaccgtctctgcttcactttactatctttaaaacataattaataatatctttatctcagtgtttgagaatcagggataaaagtgcctagagtagtgtctagtttacagtaggcactctgtggaagttattagtttttccttttcactttcttatctcattccacagggatttcaggtcattttggagtgcatttacaatacaaatagtacaattggtttaaagaaataatggaagaaaaacatggtgttgtgtagttcctaaagtgagggaaaaaattgattctaagattctttgcagcaaaagcaaagaataaaatttgatttattacaacatatacagtacgcataagataaaggatgtgtttttttcctgaattaatttgtcagaaaagttaagcaacattttcaaacaactgtgttccttggatgtcagcagttgtaagaaaagagagggtccctggtcaaattagtatgagaatgaatagatcataaacattttttaaatggtggactcaattgtgcttttgtgtataaatatagtactgtgattttgcaaaaggtggtaaaaaatataatatgtagccattttccaaaacatatgatcacaaatcccttctacttagtgtattttaagggactatggtgtggatcatccacatgagtgattcttactgaggagggaaaaatgcacagcattcttaggggttgctaatttgactgacttagcacagaacttcccaacaattgggctgaggtacactggtttgttgtgaatggttatagattgatccgtttattgaaactctcaatctttggggtgttggtgctggttttgagacacctacatccacctcagcaagttatggaatgggtggtacaaaaagaaacctcctctaagacgagccttaccccagcataccttaaaactattaatttctctctgtgccttaatattagaaaggtttgggtatactagccccagggccttttcaatattgcatgtgcaaaagtcctgtttccattctaaaacttcctgagtattgcttcgctttcttctgtcccttaactcccgttattattgtcattagttataggatcatgccttatccgtaactcaggggtgttgggaagactggtggttgagaactaatacatccactcatgttctcatcgtaatactgctctgtctttttacctggcctaatcttcctctcttcttttctgcccagacctcctttttttctacaccttttgatatgctatctggaattctctcatatcctagcaaactcacattcttcatctcttcacctacattctcctaatcataactgaaacctagctctttcccaaatatactacttccccagtaacatttttacaccaaagattcttattttccagtcaccctaatacttcactgtttagagatggggtttttgtcctcatttctcattgtcacttctaaaggaagtgattgtaagtcccattttttgagacttagggcatttggctgtatcaactcttctttactggttcctacctggagcttacaaaaggcttggcccttagcccactttccctctttattataagctttgctgcagtcctgagtggctgcagtgttcatgtacatgagtcatttaaccctctgtttgcttagtcctgtaggacagtggtctccaacctttttggcaccaaggaccagtctcctggaagacaaattttccacaggccatgggtgggaggttgggggatggttttgggattgggatgaaactcttccacctcaaatcatcaggcattagttagattctcataaggggtgttcaacctagatcccttgcatgcgcagctcacgatagggttcgtgctcctatgagaatctaatgctgccgctgatacgacaggaggtggagctcctgtcagataagcaggaatgcttacatgcatgccctctgcttacctcctgctgtgtggcctggctcctaacagaccacagactggtactggtccctggttaggggcttgggcaccccagctgtgggattttctatatacaagatatgttatctgcaaatagtttttaccttttcctttccattttggataaaaatgtctttttatcttttgcataattgctatggctacaacctctgttgagtagaagtggtgaaagccaataggtgtgtcttgtttctgatatggggggaaaataaatattttaaatattttattgttaatgtgatgttagctgtggattttaaaagatactttctatcagtttgaagttcccttccattcatggatagttgagtgtttttatcatgaaagggtgttggattttgtcaattactttttctgtgtctatggagataatcttttttttccgctttcattctactaatgtggagtaatactttggtatgttgcgtgttgtgttggtatgttgtgtgattcagtttgctagtattttgttgaagattttttttgtgtgtgtatgtgtatatatatatatatatatatatatatatacacacttaagaaatactggtctgtagttttgttttgtttttcttcttgagatatccttgtcttgttttgatatcaggaccacacagattgaattgggaagtattcctttcacttctacttttgggaagagtttgtgaaggatttttgtgaattcttctttgaatgttttgtagtattgaccagtggagttatttgggcctgggcttttctttgtggcagttttttggattgctaatttaatttttatagatattctgtagatgtctttttggtcttgttggtttataatgttgcttaaatcttctgcttctcatatatctctaattgttctgtccattattgaaagtgaggtgttcaagtctccaacttcactatatattgtagggaaggtgtgttagcaataaattctctgtttttgtttatctgggaatgtcttaatttctcttttattttgaaggatagttttgccagatgtagacttcttggttggcagtgttccttgtaatatttcaactcccatgctttctgatgagaaatcggctgttaatgttactgagcgtgtcttccacatgatgagtccccccgccctgccaccaccaccccccccagctttttttctgcattaaggattttcactttttctttggctttcaacagttaaattataatgcgcctctcttttagtttatcatatctgtagtttgttgagcctcctagatatacagattaatgtttttcatcaaatttgggacatgtttggtcattagttacgttctttctgcccctccccacttcgctctggccacttaactacgggaatgtatgagcatcattccttgcttgtcacaaaaaatttgaaaaaaaaaaaatacaaataatgtgaaaactacttaaatcagatttctccctggccaggatttgttgttgtgtttttttgtggttgtttactgacttttctagacagattctgtaaaaagtctgtattttaaaaaaatatttgacgtctttgcttggtttgattagtggtcagctaatggttggatggagatttcattgaatgccttgaactagtaagtctcccagcctccaccagggggctctgtgtgtttgcttaggcacacctgcagtccctgtaagtagtttgcagcttaggcacacctgcagtcctgtaagtagtttgcagctctgccttggccttcacttcctgcttgtttagagtttcaaagtcagccaaaggtggaagattaggggattctctggtatttccttggcatgtacatacacagcctatacatgtatatgttcttctctattcccaagactatattggagcatttcaaagcctcttgtggacatttctttcctcaggttttccttttatgatttttggtcagcttcttgtttgtcccaattgatattgccatttcaggcagctgagattttaagcagtgcactagggataagggaattaccgaacaagctttgaatcagctcaaaccaactcctgagaatgggctttttctagggagcggccagggagatcaaatcatagcagttctttgggagtggtgctttttggagagttctaaacccattttgtcccccaatctctagtgactgctggatttcatagctgccatgcttgttgtaatgcttttggttctcaagctaccacaaaggtaaggagatgggtgtggctattggataaattaaaatgccacagagcttgctgtttctttgagattcagcagtttttattgattaaatgctccttagttgttgcaagcatttggctgatttctagagttctgaaaaagttgattttgacaaatttgccagtgttcttagtgctttaatggaggaatggagttttagaaatctctgttattctggcagtgtttctcttcatttgtcatgctttatttttctttctttccttttaactaatagattttattttttagagcagctttgggtttacagaaaaattgagcaaaaatagagttctcatatgctttctcaccttccattagatacagtttctcctatgattaacatcttgcatgattgtattataattgatgagtcaatattgatattttattattaactaaaattcatagtttatattagggttcactctgttttgtatatcctatgggccttgacaaatgtataatgccataccattacagtatcatacagaatagtttcactacccttcaaattctgtgtgttccacttattcatccctcccttcttttcctgaactcctggtaaatactgatctttttgctgtttctacagttttgccttttccagaatgccagagagctataatcagatagtagatagtcttttcagattggcttctttcacttaccaaaatacatgtaaggttcctctatatatttttgtggcatctcatttaaaaaaaaaaattagccaggtgcagtggctcatgcctgcagtctcagcactttgagaggccaaggcaggaggatagcttgagttcaggagttcaggaacagcctgggcacatattgagtcctcgttttgacaaaaaaatcaaaaaaattagctgggcgtggtggcacgtgtctatagtcccatctacttgggaggctgaggtggggggatcacttgagcccaggaggttgaggctgcagtgagccgagatcaccccactctccagcctggacaacagagagagaccctgtctcaaaaaaaattactgaataatattttgttgtatggctgtactacagtttgtttattcatttacttactgaaaaacatcttggttgcttccaagttttaacaattattaataaaactgctgtaaacatttatatacagatttttgcacgggcgtacatttttcacctcattttggtaaatatcaaggagcactattgctgggtcatatgggaagcatatgtttaatttggtaggaaactgccaaactgtcttccaaagttgctttacccttttgcgtttccaccagcaatgaatgagaacttctgttgctgctccatatcctcatcagcatttggtactatgctttggacattaactattaggtatgtagtggtatttcaatgttgttttaatttgcagttccctaatgataaatgatgttgaacattttctcacatgcttatttgccatctgtatatcttctttggtgatgtgtctgttcagatctttgcttatttttattttattttttataatttcaacttttactttagattcagtgggtacatacgcaggtttgtatcacatatacatggatatattatgtgatactgaggtttgggatacagatgatcccatcacccaggtagtgagcatagtacccaacaatttttcagcccttgctcctctttccctcccctgtctagtagtccccagcgtctgtgttaccattgttatgtctgtgagtacaatgtttagctcccacttataagtgagaacatgtggtatttggttttctcttccagcgttaattcgcttagaataatggcctctagctatttgcccattttaaaattgggttgtttattctcttgttgagttttaagagttctttgtatattttagataccaatcctttatcagatatatgttttgcaaataattttttccagtcggtggcttattctcttgatagtactttttgcaggacagattttcaaaaatttttaacattttcaacatccattttttctttcttgggttgcacttttcatgttatatccaaaaaactcattgccaaatccaaggtcacctggattttctcccttttcatattataggaattttatagtttcgcattttgcatttaggcctttgatccattttgacttaatttttgtgaaagatttaaagtcattctttttgtttgtagatgtccatttctagtctcatttgttgaaaagactatcttttatactctgttttgaattgcctttgctcctttgtcgaagatcaattgactgtgtatatgtgggtctatttctgagctctctattgtattcagttgatatgtcggttcttttgccaataccacacatgccattttgatgactgtagctttgtatagtaagtcttgaagttgagtagtgttaggccttcgactttcttcttcttcaatattgtttcggatattttgggtcttttgcctgttctaataaagaatttagaatcaccttgccgatatcctcaaaataacttgctgaaattttgattgggattgtcttaaaatgttaccacaaacataaaaatacgtacatttaacttttagtataaagtttttattaatggtgatgaaacactaatgattttatgaaatcaaaactgtgactcaggttacataagaaatgaagaagaaaaatctccccaccccacacacatacacacacacacacacatacacaagtatacacacacagatatacaaacatctgcacttgccagtctaacctataaatcacaaacttttagattagcatgaaatcacacatcttagtaatcaagaagttctgttgggagtgggaagaataaagttatttgtaagtatatgggtgtagccatagaatttggagaaattcctttaaaactgcattaaataattatgcaacaatgatttgtatgcttgtgggtttaatatcaggttctgctactgtatgtgaattcagtttaagtgggtaaagacggttatctcttcaagattcttttctctagtttgcatctttttttttatcttgttgattttattggcagcacttaaagagcaaggttagataatattggagacagtgggctttcattctcatgcctttgaaaccactgaactcatttttgccttcacccatatctctaatggttcatttcttcatatttacctgcctgcctgggctatgatcggccacataagatctcacttcactaacacatggctactagcattctagtgtgttcatgccacagcagctttgcagtcttcatgttgctttcactaccggagtttctgttagaaattcatgaatgttaaaatttatacagaggtacaaatgtatcaacttaatgtgggggattatggccagtaattcccccttcatctcttattttttattacccttcttacacatttgcccctggatttgtgtctttagtcttagaaagtgattttacctcccattctgagatttattttttaatgtggaaactgcatcatcttctcagaatctgaaatctcaaattctgagattaaaatcttcattatctttctgtcccgtgttcccgctccctcctatcttcatagtctccttttattttctgaaaataatccctgttatatatttgctttctgttccatctttccctctttctgtctcttagatttctctgttatattgatttttttccccagaaaacttcatgtgtttctcccagtgggattttatgtcacttttaatttattgtcagatggtttagcaacaaatacatagatgcaaagcaaatgtgtcaatattttaacagttggtaaatataggtgaagggtatattgttgttcattgtagtattcttttgatacttctatttcaagaaatgtttcaagataaagaggttggaaacttaataatattatagtaagtcatttttatttaatatttactatatattatgtattagtccaagcactttaacatatattacctcatttaagtcttatactaacctaaggagacaagtattgttattttgcccattttatagattaggaaatgaagcatagagggatttggtaacttgccctgtgtgttgtgtggctagtaagtggcagctgaatttggactcagatcatctatgcagataatattaaaattaataagatatggctctgttttcaaagggcttacaatccaattagagttgaaaagtatataggtttctttatgctgtgaaacaaattaaggatcataaaatgatagttttatctagttgaggggatcaggaagggcttctgaagaaagtagcatttcagtactaagagaaaatacagggttaattttgaatctcatggtggaggtatttgaaatgcaacctaaggcatataaactttgttcaatgagcagtagagaacattgagagttaaagaaactatggcccaaagataataaatattttcaacagctagttactgtcagataggatttaaacctaaatctgaggtgagaggtggctattgtggcttttctagatgtcagttctttgtttcagttagtgaacaagacttgttgactcttccttaaaacattttaaatttattagttccatgcatttggatcacatttatgtcaatatatgtccatattccatacctgattctcatggcgtagcctgcagaccagtctccttcagtgtattccctttctaatgctctctcacttgacaaaataagaagtaccttttaatttgattattagctattcagattatagttctaaagcagtgcttttgtcatgtgacagctacagaattttagaatcttggagatataagcttttaaaaaaaattctagtgggtaaaatacatgttccttacccattcagtgcaaaaaaaaaaaaaaaaaacaagaacaacaaaaaaataaataaccaaaaaaaccaaaaactcagatgcaaaggaaaagagtacacagttcattccttcatagagtttgtaatttggcctgaattgcaaacaaagtatactgtaataaatactataatgggacacagtacaggtcgctataaaaacacctgtggaagtgccaagtcctgccttaggggatttaaggaagtgttctctgaagtagtgtcagctgatttaagatgaagaggaattatctagatcaagtgtgcacagtggagggcagaatggagagactgacaaagactactcagaggttgtgggtttggagatgagattgtaggatgctttgggaatctcaggtaattaggtatgaattaagaagtcactctgggcccggcgccgtggccgacgcctgtaatcccaccactttgggagggcgaggcgggcgaatcacgaggtcaggagatcgagaccaccctgtgaatggtgaaacccccgtctctactaaaaatacaaaaaattagccgagtgtggtggcgttacttgtagtcccagctactcgggaggctgaggcaggagaatggcgtgaacccgggaggcggagcttgcagtgagccgagatcacgccactgcactccagcctgggcgacagagcgagactccgtctcaaaaaaaaaaaaaaaaaaaaaaaaaaaatgccgggcgcggtgtctcaagcctgtcatcccagcactttgggaggccgaggcgggcggatcacgaggtcaggaaatcgagaccatcctggctaacacggtaaaaccccgtctgtactaaaaatacaaaaaattagcccggcgtgctggcgggcacctgtagtcccagctacttgggagactgaggcagaggaatggcatgaatccccgaggcggagcttgcagtgagccgagatcgcgccactgcactctagcctgggggacagagcgagactccgtctcaaaaaaaaaaaaaaaaaaggaagtcactagtcactgcgggaggcaggtgtgttgagggaagaagatgaagaataaataggattcaggctgtctgtggcatcataaaatcaacagtttgtaaatttctaaaaatctttttcttgggttaaaagaaagttgggcctgaagtacttaatgagaagtagtttcagagaaaaataatcttgtaaaaatcgacctcatactgaatatttgagaattcagagatgtgggaatatttgttaaaagctagaaaatttggtagaaaccatatttctacgttttcaatatggttgaaatttaatgcgttggaatttttgcacatttaatgcattatgaatttaattttaatcttgattttaaaatagccattatattggagataatattttttcaatgtcttatttcttgaaattttgctagaagttgaagaccagcctgagcaacccgtctctacttactaactagccaaccaaatacacacacacacacacacacagagagagagagagagagagagagacagagagacagagagagacagacagacagcgagggcgatttcacatatattagaagttctcggccgggcatggtggctcacacctgtaatcccagaactttggcaggccaaggcgggtggatcacctgaggtcagaagttcaagaccagcctggccaacatggtgaaaccccctctctacaaaaatacaaaaattaggcatgatggtgggtgcctgtaatcccagctactcgggaggttgaggcaggagaatcgcttgaactccggaggcagaggttacaatgagccaagatcgtaccattgcgctccagcctggatgactgagcgagactctgtctcaaaaaaaaaaagttctcctcacagtttaagaaccaactggaattaaggtagcaatttttaaattgctataactatgacttctggttaaaatattttgctttttactcccatgaaacacattacttttatttttttccttattcagcatgtatgttattgtatgaaactgaagggaaatgtaaaaaattttagagtagttttttttttttttttttttgagacggagtctcactctgttgcccagcttggagtgtagtggtgcgatcttggctcactgcaacctccgcctcccaggttcaggggattctcctgcattagcctcctaagtaactaggattacaggcacgtgccaccatgctggggtaattttttgtatttttagtagggatgaggtttcaccgagagtagatttttttaatgcactgtaagattaggaaatatgcggtatatataaaacttttataaaagcttaagtaacctttattggaaaatatgctttattagtaatataaaaacaaaaaattcatcttaactgcctgttgagactttcaagaaatgggagtccaaggatgtatacaaactgagagttaatgttggtagcatcgttatggggctaaaaaaggtgtgcaatttaagaagttaaacaaagttaaaaactaatgaacaacagtcagtgcagaaaaggaagaataagtttaactttttcacataaagtctttccagagtattgtttctattccggtgcctaaagaaggtttattcttccagtatgtaaaatacacaaaagatgggggatacagaagataattgttttaataaactacagctgattgcgccttttgtggaaacacatcagtgactgaggtgagtggaagtcagagccatggtgataatgataagtgatttgtaataatcactgcaataatttcattatctttatttctttctgaaattgtattgtatatcttttccctccaccttcttccctgcccttccagaggctctccctatagagaatctcctttgggtcattttgaaagctatggagggatgccctttttccaggctcagaagatgtttgttgatgtaccagaaaatacagtgatactggatgagatgacccttcggcacatggttcaggattgcactgctgtaaaaactcagttactcaaactgaaacgtctcctgcatcaggtgagtacataatgaacatttccagctctgatattttgaattgcaaaatggattgactttagttttttttaaaaaaatacttactgggtttctcatgtctttttagatttctgtagaataatgcttgtaaatagtatatagtagaaagttttgtggaaaaaacctgtgggatattgcatgagggtctcattacacagtccctggtatttatgagttgtgtgatatttggtaagccaatctctgcttctgtttcttcattttcataatacctacattataaggttgttgagagaattagaaataatagttgtaaattggctaatccaatgcctgaaacataggcattcagtattcagtgggctgctactatgatttcagctaagtgacaaataagaaacaacaatttttgctttacataatgatagtcatataattcagtttttgtttgggatcttcaagtttaatcttctcctgtttttttttttcttttcttttttttttttgagaaaatctagactcatagcagtgatgtcacttgtccaaagccacaggataacctgatgttggatcctggcatctgattcagtagtatttactttgttttagcacttacagacaaggtcagatgtatagcagaaaatcaaggaataaaatactaattttaagtcatagatacctttcgtttggttttaaatctgtatttgtactttgtagaatagccaactttagcttaaaactacagttaagaaagaacagcctgacttctctctgctgctcagtttgctttctgtcttagaattcctggtggccatcaaaacaaaacatgcagtatatgcacacgaaaggctagttgaagtgaaatttggctcctgtgttagaaatgatggttaatgtaaatattctgttaaagtcaggtaaattgttttctgttactcagggatcttctgtactacttctctccattcttgtggatatttgactactgttttgaaaagaaacttttttgagctaaggaacaaaagagtggagaatcctttttggatatgagattgttaacttctcttgaggcagaaataaattatatgattgaattatccagacattgagcttacagcctagttcaactgtaactagaaaataggcattggtatatagtgtttttctgttggctggtctggggagatgattttttgattaggagttttagtgtcaaagggaagaggtggtagggaatggtgggaaataggtaaaatatgtcaaatatccactgtgagccagtcattgtactagctgtaccacgtaccatcttttgtgtttgggtgttttgccctgaatcatgaagcatgactaaatagcagctaataagaccaggccacttctaataatgaaaaaagtagcataattcaggtagtagtaggtgaattggtaaccaatgattggtaccataaaaataaaaaagtgttttttgaggttctttgtgtaaagttgtaaatctcttaatggttcttttctgtcattatggcctctgaactcttaggtactacacacgggtaaaattgactttattttttgtttatgtgatgacagcaaaattatgagaagaaaattgcaaaatctttgtaggtcatctttaaagtttcccaaatgctaatagaagttaaaagatgactgagttcaaaatttcatgtcattgcctctttaaatttgtttctaatgtgactgaatttaaaaaaaacaatgtgatacgtatatatagttttcaaaaaaattcatacactattcgaaggcttaatgaaaaaaacagtatgtctggccccctccccacctcagtcaacctgttctcatctgaacaggttactgtccaaagcttctctagagctgtcatgcagggacttacttttgccataatctgggactggatccattctttcgatagcatgtcttctttcttcctagtttattctctcactttgctggaatatatctttaatttacttcctaagagaggattaatgaatggcacactgttttagttacttcattactgaaaatctctttatcctggtctcacatttgattgatattaataagtttggttggtatgaaatagtttcgttgtaatagaagagagttttcccttagaaatttgagggcattgcttttctaggatcttatttagccgttgaacagtctactacattctgatccattgtacattgtgttttgcctgtttttatctctggaatatttttaatcttttatttctagcattctgcagtttcacagtaatgtccttggacttgagttttgttgtagttggttggttggtttccacttgatgttttggcatttagtaggctctttggagattaatgtagtgtgaaatgttcttgttatttctgtgattattctctttcctttattttatctgttatctttctggaatctttagtaatcagaaactagaatttctgaattgaatctccttacctttttattttttgttatacgtttttctttttctttgggtttggttatgtttcctggtatattttctcgacttgatattccagctgtctgtttttatttaactgtttatcttggcaatcatattttcaatttccaagaacttttgtgtgtactattccttattcatatcattcaactgttttttcaggaactatggtaagtagagagtttctgtttgttttgtttcattttattgagaattctttggttccctgtattctttctctttttaaatggtcattttgttttttatgcttattttgatttctctttcttctggaatatttattcaaatttataatgattctttgttgtttattcaggactttgtacatggccatgcctgtcaactggctggttttactttatggcattgtgtggatatcagtggaccctcagcatctactgagtgaaggttttttccttcagaggtggttgtaatttatccaaagaagaaacctgattttatgctgggaataaagtagaagactgggaaaatgttttttttttttttttttttttttttttttttttttttttgagacgaagtctcgctgtctctcaggctggagtgcagtggcgcgatctcggctcactgcaaactccacctcctgggttcacgccattctcctgcctcagcctccctagtagctgggactacaggcgcccaccaccacgcccggctaatttcttatatttttagtagagacagggtttcaccatgttagccacaagggtctcgatctcctgaccttgtgatctgcccacctcggcctcccaaagtgctgggattacaggcgtgaaccaccacgcctagccaaatgttagtttcttacacagactttcaattcattcccacatttttaaccttaaggggtcataaatgtatgtttttctctttctggcaaaatgggtgataatgagaacaagacaaattcagaaggttggacattcagtaagaaaagttgagatctctttggcttcttagtgtcctaaaaagatggtgggggaaggtgatggtgctacattaaaaaaaatgtaaaggacaagtagatacagtgtgaaattttgaattgtatattgatttggacagatcagctataaaggacatcttggattagttggggaaatttgaacataggctgtatattagatgagatggaaatttactaaaatggaaaggggagattgttgactgaaaaaagtaggttataaggctgtatgtatattatgatcatttatctatctatatctacatctgtatatttctccagagggatatgctctaaggtgttactagtgatgattcctggatggtaagaatgtaatttcttttttgtgtgttttttaaaaaatctcttttctcatttctaattctccacgaattattgtttctggggggaagaaaaggttttttaaaaggtatgtgccttatccagtgatcagttaattaactggatatgttaaaaatgtagtatgctcacactgcctgactccaaactatattacaaggctacagtaaccaaaacagcatggtgctggtaccaaaacagatatatagaccaatggaacagaacagaaataatgccacacatttacatttacacacatttacaaccatctgacctttgacaaacctgacaaaaacaagcaatggggaaaggattccctatttaataaatggtgttgggaaaactggctagccatatgcagaaaactgaaactggaccccttccttacaccttatacaaaaattaactcgagatggattaaagacttaattataagacctaaaaccttaaaaactctagaagaaaacctaggaaataccattcaggacatagacatgggcaaagacatcacgactaaaacaccaaaagcgatggcagcaaaagccaaaattgacaaatgggatctaattaaactaaagaacttctgcacagcaaaagaaactaccatcagagtgaagaggcaacctagagaatgggagaaaatttttgcaatctgtccatctgacaaaggtctaatatccagaatctacaaggaacttaaacagatttacaagaaaaaaaacaaccccatcaaaaagtgggcaaaggatatgaacagacacttctcgaaagaagacaattatgcagccaacaaacatgaaaaaaagctcatcatcactggtcattaaagaaatgcaaattaaaaccacaatgagataccatctcatgccagttaaaatggcgatcattaaaagtcaggagacaacaggtgctggagaggatgtggagaaataggaacacttttacactgttggtgggagtgtaaattagttcaaccattgtggaagacagtgtagcgattcctcaaggatctagaaccagaaataccatttgatcccgcaatcccattactggttatatacccaaaggattataaatcattttactataaagacacatgcacacgtatgtttattgcagcactgttcacaatagcaaagacttggaaccagcccacatgcccatcaatgatagactggataaagaaaatgtggcatatatacaccatggaatactgtgcagccacaaaaaaggatgagttcatgtcctttgcagggacatagatagagctggaaaccatcattcttagcaagctaatactggaacagaaaaccaaacactgcatgttcttactcataagtgggagtttaacagtgagaacacatggacacagggaggggaacatcacacaccagggcctgtcggggggtagggggctgggggaggatagcattaggagaaatacctaacgtagatgacaggtcaatgggtgtagcaaaccgctatggcacatgtataccagtgtaacaaacctgcacattctgcacatgtatcccagaagttaaagtataataataataaaaaaaaaatgtaggatgctagagaagaggcagaagacatagatagatttagggcaggttgtcaaggaccttgtgtgccataaaggtagctggggcattgttctgttggtagtagtaagccaaacaagcgacttggccaaattgttatttttttaaaaaaattactgtaagggatatgtagaaaatgaatagcagagggagtgacttaagtcataatatttaggaggctgttgcatccattcaaattttaggctaaagtcgttaaatttatttggacattcttctaggttctctgatatacattatctctagtctgaaaagtaggtaatattggcttcaccctcatagctggaaagggtgaggctcagaaaactaattagtgatacaaccaggatttttttttaaccctaatctatatgactccaaggcctgttgcacacagtggtgttctagaagataccttgagggacagcagggagaagagagtgtgaaggaaacatacaacactaattctaccatcattctgtgtccccttagccaaacccaagcaaaggaatctttgttttattaaatagtactgtttaagagttcacttgaaaaaagttctccctgcacacaaaattttaaaaaattgtaaaccattatatttggcctttgatcttttatttgtggttttactcaaattaagattactttatagtttaagcatctcttttgtgtacctcattctactcatcacaacatcattatgggataagaatgacaacagtagtaattccattttaatggtcagaaaactaagactgaaatttaattgtgctttgcaagatcacccagttgcatattaatgtagagtgcattttaaactcagggctttttaattattttagcttaatacctctgtatagtttattgcctgatttagaaattttgaataagaattttgaccctgacatgaagaacgtggggacatgatgaaaaagatagtttttttgtggtatcttgtctctctctttttttttctgagttggagtcttgctctgtcgcccaggctggagtgcagtggtgcagtctcggctcactgcaagctccgcctcctgggctcacaccattcttctgcctcagcctcctgagtagctgggactacaggcgcccgccaccacgcccagctaattttttgtacttttagaagagacggggtttcaccatgttagccaggatgacctcgatctcctgaccttgtgatccacccgccttggcctcccaaagtgctgggattacaggcgtgagccaccgcacctggccggtatctctttaagtctctataccctgtttcaaaaacttcttaacaaagtgtaatatacatacagaaaagggtataattaataagtatttatcttaatgaattttcagaaactgaaaatacctgtgtagccagcatctagcaagaaatgaaacattaccagaacagaatcctctgcttgcccattctcatggtggccaatggatttctgaaaatatagatgaatttgtctgtatttgaactttgaaatgaaatgaaataatataggatatacttgttttatatctggcttcttttgcttaatattatattcatgagtcatccattttctgcatcattctcattgctgtagagtattccattgtgttaatatggcacagtttatttcatttgttctataatagatatttggacaggtttccttttttgttgtttattatgaacagttttgctgctgtattctagtatgtgtcttttggtgaacatatgtatgcatttttattgtatttatacctgtaagtgggattgctgggttaattataagttgggtaaatattcagctttagtagatactacaaaggttttctaaagtagttatacctacccactctttccctttctcatttcttttcattattttttgtttgctcttatcatatcacagtcatcatctgttttgaccttgcaataagaaatgaagaatttaagatggagtaatggaaaggcatgatgatacctcttcctaacattttatttgcattgcaaaatatttgattcctatgatttatattatgtctacttcaggatgcttgttttggggataaaaataaaggagtatataatagtattttatgaactgtcaaatgtgatatacaaatgtttagtttcattattccctcccctccaacgttgagaataaaaccaataatttttccctcacataattctccgattcactgtgtgtgggggcagtgggtgtagtggcagtggtaggtggtggaatgttagtggcatcatcctaagtggggttcaccaagagctaagaggctactgaatgatttccacttggtagcaaagaaccaaagaagagccagagcatgcctgtttccctatccccatatttctctcatcactccaggaaaaaaaggagtttatgaaatattcataataagaatatatacaacataagggttcagtttaacttagaatgtgaaggagcttgtactcttacccacccagattaagaaataagacattaataagctccctgtatgctccttcctgattgcagtacctttcctttccagaacctagagttttcccttgtttttcctctcatttttaccatctgtgtttgtatttccgtgaatataaggtttgcctcttttttaactttatataagtgaaattataatgtgagtattcctctatggcttctttcattcaacttttttttaaggttcattcatgtttggctctacttcattaattttcatttctctattggtgctccaatctatgaacgaaacataatatctttgtctgttttactcttgatgtccattttgtttgtttccagtttttttttttttgactctgacaaataatattcctatgaacattttcccggtacaaccgtgagaaagttcctctgaagtatctaattagaattggaatttctgagtcctgaagcatggaaatagtttaccctagaaaaaccaaactgttttccaaagtagttcagtcttttttactcccctcaagtagtagatgttgtttttcattgtttcacatgtgtgcaaacttgataatacccaacttacgaatttgtgtcatatggatagaatatagtgacatttaattgtggttttaatttacatttccctgattgctaataaagttgaacctttttgtatgtttatggaatgtttgttgcccgatcatatgttttgtgtgtatgagagcgagatttttgtatattctagatgcaagtactttgttagttatatgtgttgcaaatattatcttccattgtgtagagtgttttttcactgtctgatatcctttgatgaaaaaaagttcttggttttaatacagtgaatttatcagacttttttctttgtggtttgcacttttagaaatccttgtttgaaaatcctttcttgctctgaggccataaaaatattctattcttttctaaaaaattaagaattttgaccttcacaattaaatctcaaataacttggaattgattttggtgcatttaaagtatgaggtagaggtccacttttatttgtttttatctgtgggtgatcagtggatggattcagggcttaaagtgtgaagagttcgtttcttttgttttgttttgttttttgcagcagagtgttgctgtgtcacccaggctgggcagtggtgcagtgtcggcttactgcagcctcgacctcctgggctcaaccgatcctcccaagtagctgggactataggtatgccccaccatacccggctatttttgttatcctgctaagattctgaatccttatgcatggctgctcccactcttccgtgtacccttttctcatactactccagctctgactgcttgtcagcccattggactctgatactccacaccaatccccatctccagatggacgccttctcactctgcttggcctgacactgcacatcagttgagtctacgcatggatgccctccttacccattttggatctgaaacctggcattgagccctttactcattgtcatgcctgagctctggcagtctttgccaggccatcctgtgtgtggatattcacctcactcttctttgactctgatagcccatgccaggctgctgattatgcacatacactctattctttccacttaagtttgactctaatatcaagctgtttccccacccctcatggatactgttttcactccttttgggatatggcatatattggtaagctgcctccctatggagacatgctctttcaacctacttaggctctgaaacttcctgctgggcttttggggtggaaacctattttgctctgacttacctaatggcttgttaagaaaggaataggaaggtgaagaggagaatttaaaaaaagtatcaactttattgagacagaatgtacattcaaataaactgcacccattttaagtgtacagtttgttttgatgaatatatgcaattgtgtaattaccaccacattcaagatatagaccatttctgtactgataaagttccttcatttccctttgcagtcagttctttctcaaacccggcccaggcaaccactattctgcttttggttctaaagttttatctttcttagaatttcatcaaaatggaaccatttgttgtgtactctttttgtttctgaatttttttactcgccttaatggttttgatattcatctgtgttttgctagtatcagtagttcatttctttttattgctgagtagactccattctacatatatgtaccacaatttgacttttatcaatttatctgttgatagacattcaggttgtttttagttgtggaataattgggataatgctgaatctctacgtttcaatgatgaaagttaataggaataaatgtaattaagaaaaatcaggccaggcgcggtggcccatgcctgtaatcccagcaatttgggaggccgaggtaggtggatcacctggggtcaggagttcaagaccagcctggccaaaatggcgaaaccccatttctactaaaaatacaaaaattagccaggcatggtggcgtgtgcctgtagtcccagctacttgggaggctgaggcgggaggatcacttgaacacgggaggcagaggttgcagcgagctgagatcataccagtgcactccagcctgggcaacagagtaagagtctgtctcaagaaaaaaatcagaatagacaattccaaggtggagttttgggttcaggcaaattttcctacttgtacgatgttggaaaagttgcttaaactctctgtgctgcagtttcctagaaaagataatagaatgtaatagctcttacttcaggactgttgtgaagaatgcatgaggcaattcccataaaatgctaacgtagggctgggggcggtggctcatgcctgtataatcccagcactttgggaggccaaggtgggcagatcacctgtggttgggagttcgagaccagcctgatcaacatgaagaaaccccgtctctagtaaaaatacaaaattagctgagcgtggtggcgcatgcctgtaatgatcaggaggctgagacaggagaattgcttgaacccaggaggcagaggttgcggtgagctgagatcgcgccattgcactccagcctgggcaacaagagcaaaactccgtctcaaaaacaaaacaaacaaacaaaaaacacattaaattgctaacatagtatcatccatagtatcttaaaatgctaagcatactatgctgatagtattctaaaatgctaagcatagtatgctgatgtttcagcataacctgatacatgtaatgcagttaatgcatgttagcagttaataatagcaacaacatgtttcatagtaacatgaaagtcaagggtttttaattgctcacaattttatgtagctgcccagaaagctaattttatttacttcaatacctgtgtttgtttattattattctgtccataccaaggatcatggtagtaatggagataaaaataaagaggacacagtttttaacctgtacccagtacattgttcgaaaactataggttaaaaccggttagtgggtcttaaaatgaattttcatcatgactagaatttttggtaatgaagtaaaacagtataaaactatcaaaaggacatcacacgtaataaggacaaatactttttcatgaaatttgtttttagtgagagaaatatatgtatatctccctatattacacacatggatatgtgcatacacatgtaaatgcatacctattcatgtatatatgtacttggttgtgttataaaatgtatttttattgtggatcagtgtccccaccccccaaaatagaaaactctgttctagtagataaacaatactatgctcaagactccaaggccaataaatcatagagctgggacttcagtagtaaataaggcagctatcactgcatcaataaaacatgaaattatcaataaatttactgagagacatttgtgatgttttatttttaaaaacctgagaaactttgtagaaaccatttacgttctgtgggaagaccaaatattataaatgctacagatattaaagtagtaatcaagatagctagcttatagtctaggggaatatacatgtattaaattaaataattatgagaatgatgtgttgcaaagggtaacaaattaggtgttataaaaagattgtgtaagatacaatctgagtgtataataaattgtgtgttgtataaagattgtacaaaatacaatttgagtgtatggtgtgtatctacagtttttctcagtacgatttacagatttaatacagtttcagccaaaatcataacagctttgtttttggaatttatcaaaatgactccaaaattggaaacatcaaaggataagatttgtgtacattgaaaaggagaaaggggaaaaaaccctttagagcagggtataatactgacacaaatagacacaacacatagagcaatgaaagagaataggaaacatagaaatatgtgctgatgtatttagtaaaaaataattggctatagaaaggttttttttttggttggttgggttttttttttttgttttttgtttttttttttaaagaacagggtcttgctgtgttgcctgtgctggagtgcagtgactactcacaggtgtgatcataaagtactgcagcctcaaacttctggcttcgaatgatcctcctgctttggcctcccaagtagctgggactacaggcacgtgccgttgcgtccacctgcatatagaaagagtttatgcaaaagttactgaggaaaatttattagtttaggaaaacttagtttcttatactgtagcagaacacagatggcttgaggagttggatattttttaaaaaccaaaatctagaaaaattagtagaaattaggaatatctttaagtgccaaaacaaacctacaggaagggatatctgggttcagatatgtacagacgtaacagatatgtaaatgtgtaggttcaataaaaaatttaaacagaaaaaatttgtaaatactatttgcttagaatattataaaggttctatttatatataacaacattccagttaacttggatgccagatagatatgttttttatttcaaagtgtctttgccctgaccatctgtgaggatcacttcacctctaaagcgcttattaaaatcagattttataagtcagtgtttttaaaatcctctcaaatgtagcttgaattagtagattttaaatcccactgttgaattttacagtattactcaaaaattatttgtagtgcacattctggactgtgtgatgtgatgtgattgttcatctatatacctttgtatttaaaaaagaaaaaaaacttacaaaaagaaaagaaagaaaatgtctctgtcctcttcctctgctccctttcctaggatgcctcttgtcattgtgttgtagcatatctgaaacacaaggcagctttgttgacatcactgatgatgcttgttagtagggatttgtcagtgctgctaaacgtttttgttagtcatttcaagtatccatgtccattgcagctgctctggaactcacaggaagatctcagtttttgcaaactcatggaagaatcacctgggtaagatggagtttgttacagggttttcagcaagttaacatgtggaagaattatagtattagaacaaaagtttgccattgtgatgtgtcaaaaaagaagagtggaagatggtttgctgacaatagtcctctaatgctttgagaatagaggaaggtttatccatctttaataaaatgctgataatgtattagcatcctaattgcattcagagttcagaaattctaactagaaactgtagagactgctaaaacatttcacctagtaaagcagtccagaattcctagacagttggttaactgtgaattacttattttttgttcagttgctatggattttttgtactatttttgctcctgtgcatttattaaatatgtttatgcaaaacacttggaacagtacccagcactggtcaataaatgttagctctttagtatgtataatgtgaaacatgaaaattgaatgcatgaagttatttcttcagtattttttagaaagagtatgttttctattttatgatccccgccgcccccctccccccaccaaatgtttcctaattttggcctgggcactttccttttagtcaaggattaatagagagtactaaccattggttagtgtcagagttattaggagggtggttattatttgattcagttgttgttatattcctaatctttaaggctcttgtgctttaatggaaataatagcttttttatctttttgatctcctaaaatctggactgctagactgtttaataaaaaggagcagaattttttgaagcatattaataacttaaacactagtaactcctagttgtcttgggctgtcccatgcatttattttatttcattttttttttcagttttcaaaaataatgacttggtatatggggctttcacttaatttatttctaatttctaatttttaaattgatcagaacaatatatttctatgatataagttctttggaaggtgttaatgttttctttgtgggctagaacagagtttggaaaacttttctttagaagatcacgtagtaaatattttagccattttgggcaagacacaaaattgaggctattatgtagataaaacatttcaaatgcgaccatttaaaaatgtgaaagctttcttaactgtagtaaaaagaggcagctggccagatttgtcctgtgaaccgtagtttgttaatctctcgccaacagcgtggtcagtttttatgatggctctgttcgtttgaatggaatatatattttctgtatcttaggtagcagtatgtctattatatcaggcttgttaattgtactatttatatcttgcttatccttactaaatttttgcctttgatgtgtgaatttctgagagtagtgttaatctcctgctataattacagatgtctcagtttctccttttaatgctgtccatttttgttgtagtattttcaggctattgtatcaggtatatacatgtttatgattggtacatcttcttggcagattggtcctctgattactaattagaattctttgtttatctttattaatactttccttctttaatggtaccctgcttctcgtgttacaataatattgctatttcagctttttgtgggtgtgattgttgagatttatctggtgtttctctctcctttttacttgcttttagctgttttttgatcaaatcttatcttagttttttagagctgccataacagattaccacaccttggaggcttacatcaatagaagtttattctgtcatagttctggaggctagaaatccaaaaccaaggcgttgtcatcagggcttttctctgtctgaaggctctgtaagagaaacttgcgtttcttctaccttctaatggttaccagcaatccttgggattccttgatttgtagatgcatctctccagtctctacttccatcttcacatgaccttctcccttgtgtgtctgtgggtccaaatttctcccttcttataaggatatccgctatattggatttatgacccaccctaatcccgtgtgaactcaacttgattacatcgtaaaggcctattttcaagtaatgtcatattcacaggttctggatggacatgaatttctagggggtacatcattcaagctagtgcagttctattgagatgcaatatacacagtaaaattcagccttttggtgtgcagttttttttaagtgtttaataagcatattttatttaaataaatcctctcataggaaatgaagaattcattgcttttacttagaagaaggctgttaaatagatgtcaaatttatatatgcagctcaccagtatttccttattggcaacatctgtatttccacaatacacttcccaaaaggacttctaagtctcaaaattctgtctcctttgatgtgcttctctcttgattacacccaggctctattaatggtttggttcatatcattatctccttcttcatatattttctttagaatattcatcaatccctcactagcatctgtttcagtatcataggagggtttctctttttctttgcacttgatttggtttggctatgtcccaacccaaatctcttcttgaattgtagctcccataatccctacgtgttgtgggatggacctggtgagaggtaattgaatcatgggggaaagggtttttcccatgctgttctcatgatagtgaataagtctcatgagatctgatggttttatgaggggcagttcccctgcacatgctctcttgactgccaccatgtaagacatgcctatgcttctccttcggccatgattatgaggcttcccagccacatgcagatgtgagtccattaaacctctttttctttataaattacccagtctcaggtgtctttattagcagtgtaagaacagcagtctttttcaacctgagccaggtaatccctcccaccttgtgttttccactttctttctttttttctttttctttttctttttcttttttttttttttgagaaagagtctttgtcgcccagattggggtgcagtggcgcaatctcggctcactgcaacttccacctccagggttcaagtgattctcctgcctcagcctccctagtagctgggattataggtgcctgccaccatatgtggctaatttttgtacttttagtagagacgagcttttgccatgttggccaggctggtctcaaactcctgacctcaggtgatctgcctgcctcagcctcccaaagtgctgggattacaggcgtgagctactgcgcccagccttttccactttctttctgcataaaataagaactgtatcagtcttgaccttttttgaactgccttccacagaaatgagtttcaggagattgttcacagtcatggagtaactcctcccacttagattctttaccaaaagatcaaatgacctctctgtaaaatgcacctgcacattctcagagggaacttgatgaactccagttaaggtaatgtagattttcacagacttatctgactgatcccatccataattactggttttcactgtatatcccattgtaacgggagcaaccacagcatctggcttttcattatcaagaagttctgctttcttctatgatttctgttgcatcttgttctggatttctgtctcaattttggattttttcacctgtaagggcatcacgtactcctttcctagtagccttctccagcaacacctttgcttcttctagatgtttctgtagctcttccaaagcctagatcgggctgggtcaggccaaagacccgagctgcagccacacaggggagagaacaggaaacgccatgcagagccctcaaatcaaacacagacccccacctgcatgaattcagtgtacagttttatgagctttaattgacaattgtgcagctattacaatcccctcccagaattccttttcttttaaagtcaatttctacacccactgctagctcctggcaaccactgatatgaaaagattatcatataaatggatatgatatagccttttgagtataatatatagcctttgagtctggctttttttacttaacataatgcaacttgaaatattcatttatgctgtaccgtgtattaggaattcgtttctgtatattgcagagttagtgttctattttaatgctaccagtttgcttattcatttaccagctgaagggtatttatgttgctttctactttttttgcagttacaaataaaactgctgtgaacatttgtttacagattttcatgtgagcatgtgtttttatttctctcgggtaaatacttgggagtaggattgctgggttgtatggtaagtgtaaacttaactttttaagaaactaccaaactgttttccttggtgactatatcattttgtattgccactagcaatgtaagaatgtaactattgttctgcattcttgctggcacttggtattatcagtgtattataaaagccactgaataggtgtttagtggtatctcattgttgatttaatttgcatttgtgtaaagattaatgatattgagcatattttcatatgactgtttgccatttatatgtcttttttggtgaagtgtcttttttgcctattaacacaaatgtcttttcttactgatttttgagagttctttatatattttagatatagctcctttattaggtatgtaagtgatgaaacaaatggatatttttaaaaatgggactagctttttgggcaactatgtacaattgtgaggtaataaccctgcaccttcacattctcattattttcttactattgttttaaaattagctgacactttaaaaaggctttctatgagttacgcattatgctcggtatttacttgaatgattgcagatattttcttccagtccatgtcttcttttatatatatattacatattatatataaatatattatatattatatattatataaaatatattatatataatatattatatattatatattatatataatatgttatatataatatattatatataatatattatatattatatataatatatatatttattttaaatatatattttaaatatatatttatttaaatatatattttaaaaaatatatttaaaattatatttatatataaatacatattataaaatatataatatatatataaaagacatggactggaagaaagtatctgcaatcatatatatttatatataatatatgtataattatatataatgtatattattatatataaatttatatttatatattatatataattatatatttatatattatatataattatatatttatatattatatataattatatataattatattatttttaattttagttattatataaattatatatatttatatataattatattatatataaatatataaaattttgtttgtttgtttttgtttttgtttttggagacagagtcttgctctgttgcccaggctagagtgcagtggtgtgatctaggctcactgcaacttccacttccctggttcaagtgattctcctgtctcagcctctggagtagctgggattacaggcgaatgccaccacgcccagctaattttttgtatttttttccgtagagatggggttttaccatgttggccaggctggtctcagaactcctgacctcaggtgatccgcctgcttcggcctcccaaaaggctgggattacaggtgtgagagcaaaagttctgctcttgaagtaaaatttatcatttttttgccaccattttttccatagatcatgttttggtctaagaaatctttgctcaacccaagattgcaaagattttctatgtttaagtggataagttttatagttttaagtttgaaacttaggtgtataatctgtttgaagagtttttgtatgtggtatgagttatgggccaagattatttttatcacgtgtatgttcagttgttctagcaccattggttggaaagaatattgtttctgtagtgttttgcctttgtaattttgtcagaaatgcctttgaccataaatgtgtgggtctgtttctggactcttttctttccattgatgtatgtttatctttttgctattatcactttctcttgattactggagctttatagtaagtctttaagtagtgtgactcttccaactttctcttttcagaattgtttgactattttagttcttttgccttttcatgtaaattttagaagcagcgtttctatttctacaaaaaataaattctgctgggattttgatagggagaatactgaatctccagttgagtttggaagagaattgatatctcaacaatatttaatctttccattcatgaacagaggatatctccatttatttagttctctctgatttctttcacatatacacacacatatattccttcacatatacacatatatacatacacatatatgtatatacatatatgtgaaagaaatcaacctatatatttaatatacagagtctgtgttttgttggatttgtacctaagtatttctcttttgttattttggatttttttcccttgtcttttggattttgctttatcataaatggtagttttttttaaattcaattttcagttgtttgccatacacagttgatttttgtatattgaccttgtatcctgtgattttgctaaattcatgtactagttctagtagtttttgtttttgtctttgagacgttctcgctgtgttgcccagactggaatgcagtggcacgatctcagctcactgcaacccctgcttcctggattcaagcgattctcctgcgtcagcctcctgagtagctggaattacaggcatgtgccaccacgcttggttaatttttgtatttttagtagagatggagttttgccatgatggccagggtgttcttgaattcctgacctcatgtggtctgcctgcctcagcctcccaaatttctagtacttttattatagatacttaagggactttctacaccatacattctgtgtctaaatgaggttattttatttttttctttcctattcgttcgccttttatttctttttcttgccttattgcactggatagaaactccactatgatattgaataggagtgccttgttcctggtcttggggtagaatattccatgtttcaccattaaatatgatgttactggtaggatgttttgttttgttttggtttggttttgggggggaatcagagacaggatctccttctgttacccaggctggagtgcagtggcacagtcatgactgaccacagccttgacttcccaggctcaggtgattctcccacctcattctcccaattagctgggactacaggtgcatcccaccacacctggctaattttttatagttttggtagagacagagttttagcatgctgcccagaatggtcttgaactcttgggctcaagcgacctgcccctcttggccacccaaagtactggggttacaggcatgagccaccatgcctggtgggttttttggatgaactttatcaggttgagcaagttcttttattcctagctttctgagttttttttaaatcctgattggatattgaattttgccaggaaatttatctgtgtagtctattgagataattgtgcagaccttttatttctcaatttggtgaattacattgctttctgactattgaaccagctttgcattggtgggatcaacctcagttgctcatggtgtatttccctttttacatattgttggttttgattcttcgattttttttttttttttttttgagacagagtctcactctgttgcccaggctggagtgcgggggtgcagtcttggttcactgcaacctctgcctcccaggttcaagcaattctcctgccttggcctcctgagtagctgggactatgggcatgcgccaccatgcccggctgattttttttttttttttttcatatttttagtagaaatggggtttcgccatgttggccaggctcatctcaaactcctgacctcaggtgatcccccccgtcttggcctcccaaagtgctgggattacatgtgtgagattttttaaaagacttctgcatccttatacatgaagaatattgatctgtagtcttcttatactgtctttgttttagtatcagggaagtgcaattaatggcctcattaattgattttattaatttaatttgatttttctctaagtggttgtatagaattgatgttattctcttaaattttggaacaatttgccagtaaaacatctggcctcagatttttttttttttagtgagaggctttaaaccatgaattcatttttattagtagtcatatgtttacacagcttatctatttcatcttaggtgagtttcaagagtttgttgcttttgaggaattttgccacttcacataagttgtcaaatttgtgtgtgtagagtcattcatattattattgctttatttactcttagcatttgagatgtctgtaatgatatttctgctttcattcctgataatgttttgatttgtgctttcttttttgcattttggcagttttgctagatgtctagcaattttcaaagaaagtgtttttagtttcattgatttgtttgtgttttttaattttcagtttcattaatttctgctcttgattattttcttctttctgcttgttgtacatttattttgctccagttattgatttgacacctttgttttaataaaagtatttcattctataattttcccttatcactctgctttagttgcattccacaaattttggtatgtggtgtctgttattttccttcaattcacaatattttcttgtttttcttgagacttcttctttgacccaaggatgatttagaaggttgtctacttttcaagtgtatggagattatctttctgttattagtttctagttaaattctcttatattcagagagcatatgtttggtgtatttttagttcttttaaatttggtttctcaaatctgtaggtttgtgtctttcaccaaattcggggtgtgtttatccattatttcttgaaatattttttctgcccacccctatccttctgtgacttcaatgacaggagtgttagctcttttattactgtccgcatatgttcctgagcaggctctgtcaattttttttgaccaatcttgttgctcttcatcattcagattggataatttttgttgatcactctttaagtttattgtataatctgaaatgctagtatttagcccatcaatagtgcattttaaaattttggtttttgactcttttcaggtctaaaatctccatttgtttctactttttatattctgttttttttttttccccctgagattttctctttgtagtcccttcaagagtttattcttttggagaattttaataacagctctgttaaaatctcttccagttctaccttctgtgtcattttggtgttggtgttttttgattgtcttttcctttgtgagttgacattttctcctctgtttagatgttgagtaattttggattatatattagatatttgaacgttgtataatgagattcctgatcttctttaaatctttattttattttgtttttaaacaggcaaacaatgtggttgagtttaggctacaaggtacagctagctgtcttgattgtggttttaatgccagctctgttttcaaagcttttgccatgctttccagatctgttctgagtatacatcttccagaggctagtctgggacctgggaagtgatcttaggttatttttcaaagtctttgctatgctgtttaggatcagatccaagcaagtgctgctcagggatgaaccgatgaatttacaacagctttatggagctactttactcagttcctggtattttgtgacctctggtattttctgttttgctggacttctcttttttcctctatccttaatgctgttgttttattttttctattctgctgtacacttcccacaagtgcacctgcatttaatgcaaagcagtatgtgcttgtgttgtctcatattccttggggttcctgcattgcagttgggaagaagacatttagatatttggaaataattcaaattttacagtctgtctctcttctcaaatatacttgtaggtaggactggcgatgcttttatatgtctaggcagtaataacggagatgaactttttactgagatgagtcctgtaaaactcactttactttctttatttcttaatttttaaaaatgtgttccgagaatattgctattcattagaatgttgcctatgttcttagatcaaagtcttaatgtccatttgacaccaccatagaaaagtaatttatctatgctggaaatttggcaaacacttactctcttgactgtcaatcagcattaccttttgaactgccctaaatacacatttagaaattctgggccccatccctagagattctgtgtcagtgggtatacagtacaataaattaagaagaaaataacctgcatgctcacctcccctattgtagacattatccatggtatgggagaaccagaaaagatatatctgaggaagattgcaatgttatgttccttgaaggttgctggttcagtcactgggtttactgaggcagccaggaatcatgaacaaataaggtgttgaacctcagttgtgctgccttagtcaggggctcagtcctgatcaaggtagcacgtcatccagttatattcttcactggttcatttttcttgaggctgtctttctgaaccattgagcatgtggtttcttagtactaaaccagttcagcaaagggtggaacttagtattgtcatcctattttatttataatgttttggaacaaaaatctttatttcagccttttttgaggcatgagatacatccagtaaagtggttaaggtgtaccaatcttaagtgtacagctcaagcttttcatatgtatgtttaactaccgtacactcaggacatagaacatttccagcttcctactaggttccctaatgttccttcttagtcagtaacccccttccctttagtctaccatcattcttctgatttctaacaccatagattagttttgccttttctcagacttcatataaatggagttatgtgatatatatcctcatgtagctagtatttttaattcagttatttttgctgctaagccttactgggttacttaatattattgtttatggctccttggtactcaaaacatgtctaaaccaaagcagattcagttgacctttgttttacacttttcctaggtgaaacagtcttaaaattctttaggaaatttctcataatgcttaatggttctgtatttcagccgcttatatagtatccgttatttacttccacagattattcttgccgtagctcccttttttcttcttccacatttccttctaacagtatatataggggaaatgaagatttctaaaattttgtctcccatttgttcttcaccatgctagcatttggtcttcaccatgctagcatttggtctgggtaaattcaggttgaactgaatgtccacaattactatattaatctagtgtttttcttcccttctttctgacagcatgatggaagtggttcattgcatgatattcaactgtcattgccatccagtccagaaccagaagatggtgataaagtatataaggtatgactatgtagtcatgctggatttttcaaaattctttttaaatactaaaataatgatacaatgacaatgaaaacaataataaatgtattaatacctaaagcatcaggtttgttcttaacttttgctactttgttaagttgaaatgatatctctgtggtgctttaatttgaatttatcagttggataatgatctgtccttgtattactactgttgcaggatttaaaaagaaaatatattgctcataatgataaatgataagagtttttaaaatatgagtaggaatgaaagttaaaatggttataggtgcttctcatatataaatcccaaaattgaagaagtatactgaaaatgagattaatttcttttttcatgtttaaaaatacagaatacagatgtatttttgtgagtgaaagtgtttttttataattcttatttatgtctatttttagttgaagaaaactcttttattttgcaactatttaagcacatatttatttcttaagcacacacagagattcttggttaatttaatgtttccaagtcaagttatagttagcttttacatcccattttcagggtacacttattagtgtttgctagtcatctacagtaacaacctgaaagcaatggtggcttataataatgaaatttatatttcacttacatattggctgtagatcagctgggactctgcttcatgtgtcttcctcattctgggatccatactgagacggatcagcccctattgtgggacatgttattgtgccagtgggaagagaactttgataggatcacatgtgaattctgcttggatgtggcacatatcactttcaaaacaattcaaggggccaggcctggaattaatagggcagaaaagcattatttgctcgtaggttgcagagtgatttattgggaagaagattgtatataaagcaatcaaaatcataagagtatagtacagtagtcaatctcattctctcatcttggcttttcaacttgttgactacctgtccttgcccagattgcttcccaaccctgagctttcatcctactctcagtataatacattaagtcagcaggttcacagcaggccatctcttaacactcagttgagaaccattgacttaggtaatctctgatgacctcccagtttagaaaaaaaaaaattgtgaatttgtgactgacattttaaaagcaaagttgacctctttcctgaatttgtgtgtgtgtgtgtgtgtgtgtgtgtgtgtgtgtgtgtgtgtgtgtgtgtgaaaaagttttttacatgtaaagatttttttttttttttttttttttttttttagacggagccttgctctgtcacccaggctggaatgtagtggcgcaatctcggctcactgcagcctcggcctcctgggttcaagcgattctgctgccttgatttcccaagtagctggaattacaggcatctgccaccatgctcggctaattttttatatttttagtagagatggggtttcaccatgttgtccaggctggtctcgaactcctgacctcaggtaatccacccacctcggcctcccaaagtgttgggattgcaggcatgagccatcgcacccggacaagaaattatgttttaaagaaaaaaaattaattccaacatttttacacaattggtatctttactcttttccagtgttcctttctagttcatctaaatatttaatgctatatgatagacattttttgctttttttttcttttttgagatggagtcttgctctgttgcctaggctggagtgcagtggcatgatcttggctcactgcaagctcagcctcctgggttcacgccattcttctgcctcagcctcccgagtagctgggactacaggtgcccaccaccgcgcccagctaattttttgtatttttagtagagacggggtttcaccgtggtctcaatctcctgaccttgtgatccgcccgcttcggcgtcccaaagtgctaggattacaggcgtgagccactgtgcccggccatatgatagacattttgttacacagtatttatttcttgtccctgctccatttccttccaggcagattattcctagtctttcttatttaagctgagttgcaataggtcatacttgtcttttcttcagtattctggtctcttttgcattttaatcagcaaatccccaactgtgtcacctttcatccaaaatggtttagcagtgcagtttcaaatgacacaaatactgcatctcgtgccattaaaattgtaggatctaaagtctccattggacctaccatgcctctaatctatccttttatttaatctcaggacagatccctctcccattcccttaatgatctcttccaaatagctctctccaagttccatgcttagctatacttctcaacctctgcaggtagccttatgtttgttcatccagtaaatatcttatgcttcctgccttcttgctttcttttttttgtttttttggttttttttttttttgagacaaagtctcgctctgttgcccaggctggagtgcagtggcacaatctcggctcgctgcaagctccacttcctgggttcatgccattctcctgcctcagcctcccgagtggctgggactacaggcgcccgccgccacgcctggctaatttttttttttttttgtatttttagtagggacggggtttcaccgtgttagccaggattttcttgatctcctgacctcgtgatccgtccgcctcggcctcccaaagtgctgggattacaggcgtaagccaccgcgcccggcctccttcttgccttctaatttatctatatttgtctcattcttactcctttgttccagttacaggggaaaagtgtccactgtgctatggaagatcagctcttctgtgttcttaactcttgtcttctgctgttgcttaaggacctaactgcatctcttcctcctctctcatctgtcttgagtgcgcctcctctactttcttgtcattatttgtttgtaaatgtgtatatctcatttaatttcagtaaatcaaatacactttttcttgactccttttaaactcctttccagttagtgtgaaaacttggaacaatgaaaatagctaccatttcaatgctgtagacgtttgacatgacctttgttttaaaagctttctcctttggcttttgtgtcacttctctctggaatccctcatacctttcaacattttttcctgtaggtttctcctcttctttaaatgttagatttatatctttagtccagtcctctttgaacatcttactctcataatttcaaatatgacatatatggctaacatgtaaaactcctttctttcatgcttggtaatccagttgcccactggacacacttctattgtatgtcccacccataagtacttctaacacagactctctctctctcaccccccacatatgtgtgtgtatgtgtgtgtgtgtgtgtatttgtatgtgagatgtcttaaacattttatttatttaatgaaaaaactgataactgttgagctcagaaaccaataccccaacatacagtactttgacatactgaactgaagaaacctcaagatctcttctggctccatcatgtccccacctcccccctactgcccacccacctgtgtaacaatatatttaaaattcacacatattcctctttggacatacttgttgttcttctgtattcaccatttcttttgttggcgcagctattcaccatgtcactcaagctagaaatacagtgtcacccttgaatgctcctctgttcttttctcacatgcagtgaattgccaaaaatctcaaaattttgatttcttctctcccttttcatctatattatcactctcttgggtcaggctcctactcttatctagattattataatattttcataagtgcctagctcagttttcttgctgttgttaaaatttgtcctctaaacacctgtcaaagccatctcaaatgcaaatctgtcactccctagctaaggccatgcgtgatagtcatggctctctgtgatctggcccttgcatagtttactagccaattgcttctcaacattaatcagaacctatgtgcaacagcgacactgcttatacttctccagacgtgctatgctttccctcacctttgtattatattgtatggcacttagaatcctttaactaaaattccaagcctaccacactcctctatcttctgaatcttgtgcttatcctttggaactccactgtagtccctcatttctgatgtgtgatgtcacttctttgcctatctttatatataaaatcagtgttcccaatgcaaagagatgataaatgtttgagatgatggaaatgctaattgccctgatctaatcactataaattatatgtgtcaaaacattactgtgtaaaccatgaatatgtacaatgttatctgtcaattaaaagtaaaattaaaacaatgaaatggttttggtgggggaaaaaaatccttagagcagtgcctgccatacagcaagtgctatatacatgctggctattaatgttcttagcacattatttgttgatttcatttttgggtccatttcctgtgtaacacagtccgaacctactggtgactgcatgaatgatggctatatagtgttccatgaagttgctacattttattcccgttgtcctcttacaggacaattgtaaacttgttaactttcagataacaccttgttataggttttctctttctaaggatcatttctttcatatagattcctaggagtaggataactgaatcagagtgcaggtattttgatggctcttaaacatacagatgtatatttgtccaaaaaggttaactgctatgtctgatggtgtgccattttttcctgcagtctggttaattacattgggtatttcaccactaacttaatatttataaaacaatactttattcaacaagttaaatacaacattttaccagttatatgtatatttgtgagaactggctacttgtctgttgaggccttaaaaatgatcttaaatgtttagacaggctgttaatatacttgagatataaatcctctgtcatatttgcatggattatcaatagcttttaactaatgttaattgttaaggtgccttaaaatgttatataattaaatataaatcatttcttttgaatagctatatttgctacataacttagaaatgtgtccttctaaatgtattcttagaaatgtatctttcatgatctgcaatccatcttttttgtctttatgaatttttataattcctaaacttaaaaacaagtggagattatcttttgtatgtaataaagtctttttcaattatagtgtacataatagcattttaaaaatcttccacattgtttgggatgcttatgtgatatgttcaaggctttgtaaaatgtctatttctgatctctttgttaaagagaatatatgtttttgttcccgatgtagctaaaggggatgacattctttgcttagttacaacacatcctaattatttgcttacttgtttttctctctggaaagatgttattcacatctatatttgaatttccttgcttatattaccttctcttttggataactgaataatgaaacacaaacaacatgggctaactatagggtaatgattaacactttggaaatgtaactggattcctgcttaacttgacagtaggtttccatttaatagtactaggcatttcttatagatccaattgagaaggtgttctctctttgattcaggaggtactcctcaaaaagtggctcatggtcaaagaatcttccttgttacccttcaggcacatttatcttttttgctgatttgtaaaccagccatgaaatgcctctgtgcctttaattattctattgcctctgcttctcatgccctttgttttctttcacaggctactcttatgtatcccttgaagtctagctgaagttgcttttttgtatgtgattttttttttttttttttttttttactctgtggcctatgtcccagttttcttatatgtaaaaaaggattacagtacctacctcaggagtgtgggtagaatcaaatgcttaaataagtgcaagtgcttagtttttaacatctaataagttctcaatgaatgctaactgttgctgctactattgctcattgtcaacatgtcacacttcattaccggatgaaatcttagatttttttttaatagaggatttcccccctaaatgaccagatagtttgttcattactgtgtcttcatcattgatttcatgcctctcattatggtattttaaatacctcatctaaagattttttaatatttcagaatgaagatttattaaatgaaataaaacaacttaaagacgaaataaagaaaaaagatgaaaagatccaactattagaacttcagcttgtaagtattgtagtataatgtatagagacttttcaaactgggtgaaatgtgtttttcataaaactctgagccagaagtagagtttagctttatttttggctctcaaagttgcacttttatattatttttagattatatgcactgtaataaaagtatgtgatttaacttttaatctaaatattaagtatttggtttggaaaattcttcattgattcagcgacctcagttttgggtatttaaaatttaccaatttacattcattttgttgatacaagggtaaatggcttttcttcagatatatttaaagaaacaagtacttgtgagttgagaacagggtattttctctctctgtgagcagaattagcctgggtattcagatttaggtagctgcatcactatcagattgaagggtactccaagaaaatgtttatttcctatggatgctattgaatgatccatcagagtcatgtttgaatcttcataatctaataattgtgcaatttcacatattagtctcatatgaaaacaatatgtatggtgtcttgaatttaattattacttagtttgtatataaaagaccatgataaaaagaaaataatggcctaaaaatcacaacactcaaaaggaaatctttgttgtgagtcaagagcacattttggtctaacaaagcaatttggtgaaatattaatctcactgaaaatataaaggatatcatatactgagctctgagccactggggtcagctcacggagatccatttcatgaataaatagagcagataaatcaaatattatgattaaaggaacaaagaaaatttatgaaactgaataaaaagtagcataatattacaaattgaggtcctgtcacatacaaaattaaaaaggaaaataataaggcctagtgtttgtgttcaaagccaaagacaagaacccaatcaactttcagggagaagaaaaaagacaacaaagaaaattatgtaagcttcgatttttacaaaaatatattacagagcacaagatattgtgtcttgtgcaattcagaaaagaggttatgaacctcctattttatatccaagcaagtttttatttatatacaaaggtaaattctgacctttaatgtcttgacagacccagttaatacatttcagatatttgagaggtaaattgaaaaataactcaagaataaggagataaagattaaaatgaatgagcggtgaaatggaaactaagtggtgtaaacttctgagccactagttggagaaaacttactgcccattttacctaatgtaaattacatatcattctaatgttgggatttgtttggatttataaatccttaatttttctgaaattaaaaattatttttaattttaaaattttaagttgctattaattttggaaaatattcagattaaataagtttgaggaagaacataaggaatatgctgaaggaagttagaagtactgaattttttatcttctacaaatgaatattcaacattcttaattttaaaaaatatacttagataaattataatgtttatgaaatgctttaaagtaattagtaggttggaataaagtatcttgcaaaagttaaaagttaaaaaaaagacgaagtagaaaaataaggaaaacttaaaaacagcataaaactaaagtaatagaaattagaccaaatataacaaatataatagtagttgcaaatagtcttatgtcttggagagactttccttgaggatctaaagcaaaatccagtaacttgctttgtataaaaaaaatttagctaaaggaaaatggcacgataaggctgaacataaaagattgggggaggctgggcatggtagctcactcctgtaatccgagcactttgggaggcctaggtgggtggattgcttgaggtcaggagttcgagaccagcctggccaacatggtgaaaccctgtctctactaaaaatacaaaaaatttagctggttgtggtggttcacgcctgtagtccccagctacttgggatgctgaggcagaacaatcacttgaacccaggaggcagaggttgcagtgagccaagatcatgccactgcacttcagcctgggtgacagagtgagactctgtcttaaaaaataaaatagaagactgggggagacagaataaaattattctcatcaaaaatattaggattgcaatagtaaaattagaaaagtaaatttaagacaaagatttatgtaaaaggtcactttatatggacatatgataaataatgaaagatgaatctttttatgccgtgaagttttgataaagtattcttttaacctcagaatgtatctttaaaaaaataagaacaggtctcttcatagctcaaattatattattatctctaagcaattaatagtaattccttaacatcttctaatatctagtccatactaagattttctcagttgttccaaaaacatcctgtactttgatgtccctaaactaaaagtcagtctaggactatgcacaactggttatatcccttatatctcttttaatttagaactgttcttttttttctttttgtattgatttgttgaagagactgcaccagttgtcctgaataatatctcatcttgaaaataatttttagaaagatttaagaaatattgaagagcatcctaaagaaagaaaagtgaaagcattaatctttatcagtaggtaccttgaaattctctgtactcgatatattaaacctagtaatcatatttgtcataaaagagcctgccacctgtttttctaggtggtgtgcctagttttcctgtggattgcttgggaagctgtggtgtattcagctagaaattccctctgtaaacacattagaatctcattagcatgtttacaaattgcagaggagctgtggccccgtaccaggagaacttcgtgatattttctttacagttcatgtaaaggctaatgttagtgtggttttctcaacataaatttagaggattagaaaagattcactgcttctcattgcaagcagtgatctctgtaaagtgaatgccttagttttaggtggccaagtatcctttttatagtagaaaattagaaatcactcaaagattttaacagtataaggtttagttatagaactcgagaaagtcacttgttcaaaccaagagagttttaacagatacaaaccatttgaaaacaaagataagtaacagtatttttcacattatcaaattaaaatcacctattaaaaaattttttttaacatctctattcttaatataggaaaaaaatcagaagaatcatagactaggaattaaaggacttgtttctaatttaattagctaaatggcactgacagtttccatcacctctctctagtgctttctttatccaaaatgtgaaggtttttctaggtgatttccaatttccctttcagttatagccttctatgcttttttatctttttaaaaaatatacattcaactccaacctatgtttgcatgcaaaccttcataaaaatacgttgacagtataaagtgttgaattcaaaatattctgatttaaaatcagattgcagcgctctgagaattaactgaaaggcatagaagtttaactattcaaaccttactaaaaaatgctaagaatgcctgtttatctttactacaataccatagttaaataatagttcagatacatttctcattgactcttcagaataatcttgggaaattgctagtgtagaatttcctttatgggagacacattagacagtggaactcaggttaagtgggctagcagtatagtatatttgaaaaaccaagacagacctgagttcagatcctgactttgaaatttatagccatgttctctgaagggagttctataatctctcctaagccccttctgttagaggataataaaagtagtactgggctgggcacggtggctcatacctataatcccagcactttaggaggccgaggcaggcagatcacctgaggtcaggagttcgagaccagcctggccaacatggtgaaaccctgtctctactaaaaatacaaaaattagctgggcatggtggcacatgcctgtagtctcagctactcaggaggctgagacaggagaatcacttgaacccgtgaggccgaggttgcagtgagccaagatcgcgtgccactgcactccagcctgggcaacagagcaagactccatctcaaaaaaaaaaaaaaaaaaaaaaaaagtagtactgaccatatagggttatgatagttatgttgtgatagaactacatagtaaactacttaatgcctggtccatggatacatgatgaatagcaactcttatataagccctaaatcacccagtgtaaatcagtgcatatcttatgatgttttaagttccgagtaaaagtccctaactaaaagtgattttaaaaataaaaacagttgtaaactcaacaagaaattatgtaggtcccatccatttcagtggtttcttattggtcatttggctgattgattaggttccagatcagcttttttggaatcctgttggctgtccattcatggtcacaagatgtctgttgctctgtgtgtcacattctcacacagtaatacccaaggataggttaagggcctatgatctccagtgtctgtttttaaaatcaacaaaccctttctcagataccctagactttcctgtttgattggctagatttgagttacttgtcccttcctaagcatagaggaatgggattaatcacattggttcagactaattaagttctagctccttggggtaagagattaggacacatttccccaaatgtgggaccaaatagaaggtgagcatctgtacagtctgtcagcaataaagaaggcagatggtgagaaaatgatttggttagtcattttatatatgttgacatgtcactagaaactagacttttccaaattttggaaaactcatatatttgccaaatattatttttcatgtgtgagcatatagaccacagaaaataaatcatagacagtctgctacttaggattttttgattatatgatggtacaaaagtgatactcattcagtaagctcctcaacttatgacggaattatgtcctgataaacccattataggttgaaaataatcccaaatcaaaagtgtgtttttagtaatattatgagtttatccaggtgtgaccccattataaatcaaagagcacctgaatttctggaattgcaataggatggaataagtaaagtgttttcgttacgatagtgtttttaaattatcttttctgttcctcatatacccctcatatatgttaaaagttgatcctattacagtgaattccaagagactgtaaatacttgattatatattgaatttggggggttattttggagttagagtctcactctgtcacccaggatggagtgcggtggtgcaatctcagcacactgtggcctcaacctcccaagctcaggtgatcctctcactcaacctcccgggtagctgggactacaggcacatgctaccatgcctggctgtttttgttgtgtgttttttgtagatacagggttttgccttgttgcccaggctggtctggaacccctgggcccaagcaatccgccagccacagcctcccaaagtactgggagtacaggtgtgagctactgcacccagcctatattgaattttgtttcagtgactgtctcatttgttaggaatgggaaatatgtctctatgatagacatttttgtttttagattttattttgtataaggaaattgtaatgatctgattgcagttaagaaaaattttgaatatgggtaaatattattaaagtagaaatgtatcattttaacctgatggaataatcaagaattttttagtttcctatgagaaagtatatctacctccagtgaggttgtttaacaaataatgtggttattttctagcttgtcactaagggtgaattctctctctttttttttttttttttttttttttttgaaatggtgtctccctctgtcacccaggctggagtgcagtggtgcaatctgtgctcactgcaagctctgcttccgggttcatgccattctcctgcctcagcctccggagtagctgggactacaggtgcccgccaccacatccggcaaattttttgtatttttagtagagatgaggtttcactgtgttagccaggatggtctgcttctcctgacctcgtgatccgcccgcctcggcctcccaaagtgctgggattacaggcgtgagccaccgtgcctggccgggagaattctttttatcagtattttcatgatcttttttgaaagtgatgattatttgggaaagttactttgtgttatataaatgagtgtgctttgagtggaatcgtgtggagaaatcatttgtgaacagaaatggtcagatggatcttgtcaaagggctgacactcttcaaaatatttcagtccagtaaagtcaatacatcatgaaagaggcttcatcacactgcacatgagaacagacatcctgacaagtggactggtggtattcaatgtccagcagagtcccattaaaatatggatttaagaaactgagctttagtgactgtagtaccatgacagtttagggaaatactgtaaattctgcagttgtattctttatatactgaatatccctatatattctacatccatatacttaactctttatattgatatacataaaatcatatattgtatgttttatggacaatataagagattgccaagggtaatttagattattcaaaattctaaccttacaggctgactctcaaacccactccctgaataagatgagagaccactgaatagaccttattgttggctgtgataacattttttcttcaaaaaagtagccagaactattttgccatgtgtgacttttttgttgatttggttacataccccctaaaagagccctgattacctcctgtcatggctgttaattttttttataggtaatttagttttgcttgtctcttaggtgttttatgtgttttcctaaagtttctcttgtgtgtcttggtgtgtatatgcagaattaaaccaatgtaaaaattttgtgtttttgtttaggcaactcagcatatctgccaccaaaaatgtaaagaggaaaaatgcacttatgctgataaatatacccaaacaccctggagacgaattcctgtaagtaacatttgctcttagcctcctctccagtcatttgctattttgatgttttatttcactctttttacagcaatctctaatgattttgaatctgtcatggctgttaatttttttgtaggtaatttatttttgcttgtctcttaggtgtttatgtgttttcctaaagcttctcttgtgtgtcttatgtaagtgaatgtgcattttaatagctttttcattctacatactatagttcattttatttgcgtgtctactctcctcttattgcatgatttatgagagtagttccacatgccttaaaggaaatagcagtcctgtatgcagtcatcccactttagcagcatatgacactttgaaaatatatgatttagcatattccttttttgttaaaacttttcaaatatgtttattataattactcaaatgttgagggtgttaggaaatataaatgcacgaagatacagacaataaaagttatgttttaggcagaactagggaatggtttattttaaataggaagtaactatgtattccatgcttatttgtttttcaaaaatgttatatctcaaaacatgtttagtgctaaaaatactctatcatttaatctgagttctcagaacttagtgcaggatgtgtgtgagccagagaattatcatatggacattagtcattctgctgttgtttggggccaggtagtagacatttcttgttaagagattgcctaataagtcagccttgactcttttgccttatatttaggagtggaatcctagtaacacaaaggaacagagaaatataatggctaatataatcagcaattcagtttataaagcttagccataagcctttaaagtttataaaagagttttgtttcttttcatctaacaagtattttttttgtgctctgtataagatacaatggtaggaattaatttattcaacaaaagtttgatgatcccctttcatcccagatatttggctttcaaactagaagtggggaattagggaaggaaatacagacaaataaggattcctctgtttataagtacttcttaagaaattgggaatgcattgatgtagttaaagtgctgtgtaagtctataaggttcaaaggatgtgggaaagtctagttgaaagaatcaaggagcttggtgaagaaaatgaaggttgtgtttgaatcatagaaagcaaaagataccaacagaaaaagatgatgtgatattatttaatgtcaaaggcggtggaagctcatctgtttgcagacagttgtttaatagaagaccatgccccttgcttctagatggaagtttgggctttccaggtgtctccatttaccccatagggatgttatgccttataattgtactactaagaagactggtgattccattaagcatgataagttccattttgccatcctcatggaagtctttataccacctctggctccttcagcctcactgttctggaaactggatgttagtcttcctcctcatcagacaaaagtaactataaaaaaagtaactataaaagttactataggaatcatctggccaaatacctttgttttgtagataaggtagcaaaagctggggagattaactggcatagcaaagttcccataattaataagtggctgagctagtactataacttaggactcttgactgctagttctaggttcttttccccaaaagcacattgaagagcctttgaaggagagtggtttgctgccaacagcagcagagcaaaaatttgaatgtattgagatttgtccaaggggattttgtgtcacttaatggctgcaaataagatctctgaagtagagaatcaacaggaaataagaggaagaaatatagtagtagaaaaggggaaaggaggaaaagcagatattcacttgcttattcagcagatatttatgtgcctacttcatgccaggcactgtattaatttggatgtgtaaatataaagaagaatataaaaatacatgtgtaaatataaagttccatccctcaagatgcttgtagaaacctccagtgtgcttaaatgatagtaagctcactctttttctgcatgtgaagaagctaagactaagaagtgacttatgcaagtgtttacacaacttgtatacagcagtcttattttagttgcttttcttttgaatggttgcaggagggtgagggggctagaaggaatagagaagagaaaaggatcatagctctgggaagggaggacagaggcttaatcttagtgagagatcacaataaggacttaacttccctgagaggaaaaaaaacaggtgcccaggtttgcactgcatggtagaagacttagcagtatactgtgataatccatagaaacatacttgtattttaaaagttatttaatttattttgagacagggtcttggtctgtcacccaggctagagtgcaatggtgcaattatggtccactatagccttgacctcctgggctcaagtgatcctcctgcctcagcctcccaagtatctgggaccacaggtgtgcaccaccatgcctggctaatttttttattttttgtagagacaggggtctcacactcctgggctcaggtgatctttttgcctcagcctccccaaatgctgggattacagacatgagccaccatgcctgaccacatacttgtattttaaattactgagaaaaaagtatttttggttgaaaaggcatagtttcagtaagagtgtaataagaaaactcctctacaaccaagttagtttcaatctaatgtgagtacaaagaaatcttttgacatattaaattatgtaagtcattttctcaatagaaataataaaattcaatacctctcattaaaagcatgaaaaaatagaatactaagaatactttatgagtaacctgaggccaaaatatgtacgtttaaaagagaagtactgtaaagtggatttttcctttcctatttttattgagagataacgatatatttattctatagcaaatatagaaaatagagaagcaaaacaacttaagaaaaatttaaagtacttaaatcatacaagccaatgacagtcattgttaacattttatatatggtcttccagccttgtttggtgttgtgtgtatatgtgtatgtgccatctgtcatctctatttagatgggattatgttgtatatgtggcattttaacctacgtaggtagtggtgatggtggttgctattaatatttggtttgatttttttactaaaccaaaatgaagaaatgcattacctttaatcaagttaaggaattaattcctttactggatggtctttgtaaggttcttgaaataaattactacagttttttttctgaaaggtttatacaggcttatactaccaccaactaagtatgaccagaaagtggcttggtggccgtgatgttaggttgtgtgattcaagtgtttgatgtcattagtttatttaaaaaaagcccctgatatttccctccacaaacgaggaaatacaagggcaggagggttaccccttgtgccccacactatcatttcaggtggtactgggaagccactcccaactatttatgttatgaccattcctgttatgtaatgttttcttaccttacaaattctttcttcctcctggcctgaaaaccattttatcatgctattttctgcatatattcaacctcagcttttgtgtatatcaatacacaaaattttttatatattttatatatattgattttatatatattgatcctcagaattttaggagtttttttctgcctgtagtaaaatttggctttcatgctacaggtgcttttggtgttagaactgtactgataaagatcaaaactgtttgggtttggtttggttattatttgtgagactgaacccagcaagggaatagtggctagtcacctggtgggtgctcttcatttagggcaagacaaaggtttctactaccgtagggagttgcctaagccatgctgtaggcatagtacaggatgtttttaagtataagtttttaagaacagtgttttcagcattgaggaccagagtgtgaagcacgtcttagtggagtaaggggtctatcttctgcttgggaaagcaataatgtagtgttataaactcccctgagccttgcattataaaaagagggcagccataggaccgtattccagaattgagaatgccctactctagagcggcacagtcctatacaactttctgtgctgtccattgtagtagcctgtagctacatgtgactgttgagcacttgaaaatgaaggaagagaattttaaattttgtttagttgtaattaatttaaatgtaaatagtcacatgtagctaattgacatcattttggacaaagcagccctggacctaatgatatctacttacatggatatggaaagctacctagaacaataagtaaagggcaagtcagtaaaagcagttttcagaagaaatgaaggaaaataaaaaacatggagttcagatttaggtggaggaaaaaagagggaaaagagataagaatgagccgtaagagcagaaaatgatacttccagaggaaagtggggcaattatttttcttatctgaggggcaaaatacccggatacaatggtgaaatgagtaacgcgaaaagaagaataacaatatggaagatgcctaatcattcacatgaaaatagttgatattactgtgaatactgctggaggttgttggttatgcgagaaatcaagattcattttaaacataaaaacttacgaaactatttttaagcatagtgtacagatccatgtacaagcatattcttaaaaattagcattatcttggactgaatttatttttatgtatttccaatactgttttaaaagcatttaacatcagtatttaaaaatatgaatattctgcacgttaagtaaattgtaaaatcttatgatatgtaccttttgtagtccatttgtttgaacacctcaagttaaccagagaagccaaaatattagaaaaaagaaacatttctggactcataccttcaaatgccttattacttatccccttgaatctctacgcagggagaacaggttagacccaaaggatctacctgacctgtcatgtaattacctgacctggattactctgaaaattgagtacatgaatacacagactgttgtatcggtatcagtgtgaaaaggtgcctacaagttaaaattctgaatgggcacaattcgatctaatgctaattttctctcatatttttaagaactaactctgttatatatagcaaagaggcaagaaaaggtgattttatatacattaaaaatgatctgttggaattatagtactgaatcaaagattaatccatgttacggtatatataaaagatatgcatatgtaatttatataagttcagcaattggaatatggtcagcattgtcaaccaccctttttgtgcttagaattaggtttttggtcacagcactttgggaggctgaggcgggtggatcaccggaggctgggagtttgagaccagcctgaccaacatggagaaaccccgtctctactaaaaatacaaaaattagtcaggcgtggtggtgcatgccaataatccgagctactcgggaggctgaggcaggagaatcacttgaacctgggaggtggaggttgtggtgagctgagattgcacaattgcactccagcctgggcagcaagaatgaaactctgtctcaaaaaaaaaaaaaaaagacttaggtttttgggcctcagatatactgggtcaagtattttcccatcataaatatttataaaatagaaaaggaaaaagcagaaaactatcacagttacatcacaaaaatcacatcaaatgtttataatttccaaaggagacagattttacctagtttctagcaaccgtggaaatttatcagcaaagaactccactctattttttcttgcctgagaaatgggatggaacgctaaccaaaagacagtgcaggcaaacgatttatcttatgaataatctcccccaaatccattttcttagaccatattctttcctgatttggaaatgggcaaaattattggttaatttttatgttggaaaaatgtcaattttttttcttttcttttttttttttttgagatggaatctctctctcttgcccaggctcaagtcagtggcatgatctcagctcactgcaacatctgcctccctgttcaagagattctcccacctcagcctcccaagtagctgataccacaggtgcatcccaccacacccggctaatttatatatatatatatatatatatatatatatatatatatatataatttttttttttttttgagacggagtctcgctctgtcgtgatcctggctcactgcaagctccacctcccgggttcacaccattcccctgcctcagcctcccaagtagctgggactacaggtgcccgccactatgcttggctaattttttgtattttttttagtagagacggggtttcaccgcgttagccaggatggtctctatctcctgatctcgtgatccacctgcctctgcctcccaaagtgctgggattacaggtgtgagccaccgcacccagccctaatttctatatttttagtagagatggggtttcaccatattggccaggctggtcttgaactcctgacctcaggtgatctgtccgcctcggcctcccaaagtgctgggaccacaggcatgagccatccaccatgcccagccaaatgtcctgattttaaattttaatgagcccatttatttctctggagagacgttgcatgcatgtgtgcatgcacgtgtgtgtgtgtgtgtgtgtgtgtgtttcaaagggaattacttctttgctaaggccttttatttgtattcactattacttatatttttaaatgccactaaaagtatttttagagaaaatcacatatacattggtgtttaaataagtgatatttatgatctggtcatacagttatttttaaattattcaatgttttactcaatattagacattggccatggaatacagcctgtgttttgatgatctgaatgttgacaggagccatctgtgttgctgagacattgtgtggcatgcagaatttatgacaacacaagaattcttttatgtttgtcatttcttctatttttttttaaacattagtgctgtgactttctttcatgtatacaggttaaaccaataaccgaaaaaacataattgtttcttaaggatacgaacaaattaaatatggatattatagcagttgagtggtttattggttgtaagtttacagttacctaaatctgtatttttcaataccagatactagaactatagaaggcatttttgaaactttgtttaaagtatccattggaagaagcaaagtttgcctgtagtgtaattacaaaagagtgataagaagttgcaaaaaatgtggagatcttttttatttttcaaccaattttccacattagttacattttacataattgtagtacaatatcaaaaccaggaaattgacattagtgatggtgtgtgtgcacgcttctgtgccattttataacttgtgtagtaactgtgccattttataacttgtgtagtaatgatcatcatatttaaggtatagaactattgtaccaccacagcattttcccatgtgtggtacctctttgcattctaaccattctcactttctctcaccattcctaacctctggtaaccactaaaactgttttacatctttataattttgttattttcagattttttataaatagtatcttacagtgttgaactttggagcttggctttttaaaactagcataacaccctggagatccattcaagtagttgtgtgcatcagtagttagtttctttttattgctgagtactgttccatgatatgggtgtaccacagtttaaataaactgttcaaataaataataaagatgttgattctcccaatttatgaatatggtatgtctctccattaatttaagcatttttgatttctttaatcagcatttttcagttttcagaacacagttcactacatgcttttttaattattattattatttaagttctaggatacatgtgcacaacgtgcaggtttgttacatatgtctacatgtgccatgttggtgtgctgcacctattaactcgtcatttacattaggtatatctcctaatgctctccctaccacctcccccaaccccacaacaagccccggtgtgtgatgttccccttcctgtgtccaagtgttctcattgttcaattcccatctatgagtgagaacatgcggtgtttgtttttttgttcttgcgatagtttgctgagaatgatggtttccagcttcatccatgtccctacaaaggacatgaactcatccttttttatggctgcatagtattccatggtgtatatgtgccacattttcttaatccagtctatcattgatggacatttgggttggttccaagtctttgctattgtgaatagtgctgcagtaaacatacgtgtgcatgtgcctttatagcagcatgatttataatcctttgggtatatatccagtaatgggatggctgggtcaaatggtatttctagttctagatccttgaggaatcactacactatcttccacaatggttgaactagtttacactcccaccaacagtgtaaaagtgttcctatttctccacatcctctccagcacctgttgtttcctgactttttaatgattgccattctaactggtgtgagatggtatctcattgtggttttgatttgcatttctgtgatggccagtgatgatgagcttttttcatgtgtctgttggctgcataaatgtcttcttttgagaagtgtctgttcatatcctttgcccacttgttgatggggttgtttgtttttttcttgtaaatttgtttgagttctttgcagattctggatattagccctttgtcagatgagtagattgcaaaaattttctccccttctgtaggttgcctgttcactctgatggtagtttcttttgctgtgcagaagctctttagtttaattagatcccatttgtctattttagcttttattgccattgcttttggtgttttagacatgaagtccttgcccatgcctatgtcctgaatggtactgcctaggctttcttctagagtttttatggttttaggtctaacatttaagtctttaatccatcttgaattaatttttgtataaggtataaggaagggatccagtttcagctttctacatatggctagccagttttcccagcaccatttattaaatagggaatcctttccccatttcttgtttttctcaggtttgtcaaagattagatggttgtagatgtgtggtattatttctgagggctctgttctgttccattggtctatatctctgttttgataccagtaccatgctgttttggttactgtagccttgtagtatagtttgaagtcaggtggcatgatgcctccagctttgttcttttggcttaggatagtcttgaaaatgcgggctcttttttggttccatgtgaactttaaagtagttttttccaattctgtgaagaaagtaattggtagcttgatggggatggcattgaatctataaattaccttaggcagtaaggccattttcatgatattgattcttcctacccatgagcgtggaacgttcttccatttgttagtgtcctcttttatttcgttgggcagtggtttgtagttctccttgaagaggtccttcatgtcccttgtaagttggattcctatgtattttattctctttgaagcaattgtgaatgggagttctgtcatgatttggctctctgtctgttattggtgtataagaatgcttgtgatttttgcacaatgattttgtatcctgagactttgctgaagttgcttatcagcttaaggagattttgggctgagacgatggcgttttctagatatacaattatgtcatctgcaaacagggacaatttgacttcctcttttcctaattgaataccctttatttctttctcctgcctgattgccctggccagaacttccaacactatgttgaataggaatggtgagaaagggcatccctgtcttgtgccagtttcaaagggaatgcttccagtttttgcccattgagtatgatattggctgtgggtttttcataaatagttctgattattttgaaatacgtcccatcaatacctaatttattgagagtttttagcatgaagcgctgttgaattttgtcaatggccttttctgcatctattgagataatcatatggtttttgtctttggttctgtttatatgctggattatgtttattgatttgcgtatgttgaaccagccttgcatcccagggatgaagcccacttgatcatggtggataagctttttgatgtgctgctgtatttggtttgccagtgttttattgaggatttttgcatcgatgttcatcagggatattggtctaaaattctctttttttgttgtgtctctgccagtctttggtatcaggatgatgctggcctcataaaatgagttagggagggttccctctttttctattgattggaatagtttcagaaggaatgataccagctcctccttgtacctctggtagaattcggctgtgaatccatctggtcctggactttttttgtttggtaggctcttaattattgcctcaatttcagagcctgttgttggtctattcagggattcaagttcttcctggtttagtcttgggagggtatatgtgtcgaggaatttatccatttcttttagattttctagtttatttgcatagaggtgtttatggtattctctgatggtagtttgtatttctgtgggatcagtggtgatatcccctgtatcattttaattgcgtctatttgattcttctctcttttcttctttattagtcttgctagcagtatatcaattttgttgacattttcaaaaaaccagctcctggattcattgattcttttgaaggattttttgtgtctatttccttcagttctgctctgatcttagttatttcttgccttctgctggcttttgaatgtgtttgctcttgcttctctagttcttttaattgcgatgttagggtgtcaattttagatctttcctgctttctcttgtgggcatttagtgctataaatttccctctacacactgcttcaaatgtgtcccagagattctggtatgtcgtgtctttgttctcattggtttcaaagaacatctttatttctgccttcatttcgttatgtacccagtagtcattcaggagcaggttgttcagtttccatgtagttgcacagttttgagtgactttattaatcctgagttctagtttgattgcactgtggtctgagagactgtttgttatagtttctgttcttttacatttgctgaggagtgcttcacttcaactctgtggtcaattttggaataagtgtgatgtggtgctgagaagaatgtatagtctgttgatttggggtggagagttctgtagatgtctgttaggtccgcttggtgcagagctgagttcaattcctggatctcgttgttaactttctgtctcattgatctgtctaaggttgacagtggggtgttaaagtctttcattattattgtgtgggagtcagagtctctttctaggtctctaaggacttgctttatgaatctgggtgctcctgtattgggtgcatatatatttaaaatagttagctcttcttgttgaattgatccctttaccattatgtaatggcctcctttgtctcttttgatctttgttggtttaaagtctgttttatcagagactaggattgcaacccctaacttttttttgttttccatttgcttggtagatcttcctccatccctttattttgagcccatgtgtgtctctgcacatgagatcggtctcctgaatatagcacactgatgggtcttgactctttatccaatttgccagtctgtgtcttttaattggagcatttagcccatttacatttaaggttaatattgttatgtgtgaatttgatcctggcattatgatgttagctggttatgttgctcgttagttgatgcagtttcttcctagcatcgttggtgtttacaatttggcatgtttttgcagtggctggtaccagttgttcctttccatgtttagtgcttccttcaggagctcttttagggcaggcctggtggtgacaaagtctctcagcatttgtttatctgtaaagtattttatttctccttcacttatgaagcttagtttgactggatatgaaattctgggttgaaaattcttttctttaagaatgttgaatattggcccccactctcttctggcttgtagagtttcttctgagagatccgctgttagtctgacgggtttccctttgtgggtaacccagcctttctctctggctgcccttaacattttttccttcatttcagctttggtgaatctgacaattatgtgtcttggagttgctcttctcgaggattatctttgcggcgttctctgtatttcctgaatttgaacattggcctgccttgctaggttggggaagttctcctggataatatcttgcagggtgttttccaacttggttccattctccccgtcactttcaggtacaccaatcagatgtagatttggtcttttcacatagtcccatatttcttggaggctttgttcatttctttttactcttttttctctaaatttctgttctcgcttcatttcattcatttgatcttcaatcactgataccctttcttccagttgatcaaatcggctactgaagcttgtgcattcgtcacgtagttctcgtgccatggttttcagctccatcaggtcatttaaggacttctctacactggttcttctagttagccattcatctaatcttttctcaaggttgttaccttctttgcatggggttcgaacttcctcctttagtttgaagaagtttgatcttctgaagccttcttctctcaacttgtcgaagtcattctccgtccagctttgttccattgctggcgaggagctgcgttcctttggagggggagaggtgctctgatttttagaattttcagcttttctgctctgttttttccccatctttgtggttttatctacctttggtctttgatgatggtgaccgacagatgggattttggtgtggatgtcctttctgtttgttagttttccttctaatagtcaggaccctcagctgcaggtctgttggaatttgctggaggtccactccagaccctgtttgcctgggtatcagcagcggaggctgcagaacagcgaatattgctgaacagcaaatgtttctgcctgatcattcctctggaagcttcgtctcagatgggtacccagccgtgtgagttttcagtctgcccctactggggggtgcctcccagttaggctacttggaagtcagggacccacttgaggaggcagtctgtccattctcagatctcaaaccccatgctgggagaaccactactctcttcaaagctatcagacagggacatttaagtctgcagaggtttctgctgccttttgtttggctgtgccctgcccccagaggtggagtctacagaggcaggcaggcctccttgagctgaggtgggctccacccagttcgagcttcccggccactttctttacctactcaagcctcagcaatggcagacacccctcccccagccttgctgccaccttgcagttcaatctcagactgctgtgctagcaatgagggaggatccatgggcgtgggaccctccgagccaggcacaggatataatttcctggtgtgccgtttgctaagactgttggaaaagtgcagtattagagtgggagtgacctgattttccaggatccgtctgtcaccccttcccttggctaagaaagggaattccttgaccccttgtgcttcccgggtgaggggatgcctcgccctgcttccactcacactctgtgggctgcatacactgtcctgtccccactgtccaacaagccccagtgagatgaaactggtacctcagttggaaatgcagaaatcacccctcttctgggttgctcacgctgggagctgtagactggagctgttcctattcggccatcttctttggtgtaatctacatgctttcttagatttctttctggggtggttataagtgatactgttcgttaaatttcactttccctgtgctgattgctgatacttagaaaaaaaattgatttctgggccatgtgcggtggctcatgcctgtaatcccagcactttgagaggctgaagtgggcggatcacgaggtcaggagatggagaccatcctggctaacacaatgaaactctgtctctactaaaaatacaaaatattatccaggcatggtggcgggcacctgtagtcccagctattcaggaggctgaggcaggagaatggcattatcccgggaggtggataattgcagtgagcagagatagcgccactgcactccagcctgggtggcagaacgagactctgtctccaaaaaaaaaaaaaaagaaataaaattgatttctgtatattgaccttgtattttgtgaacttagtaaactcacttataagtttggagagtttttctgtagtttggggttttctatgttgaccattatgtcatctgtaaatagtaacagtgttctcactttttgatctgatgtcttttatttcccttctttgcattatgtcaccagcttggattttcattactatgttgaataagaattatgagaatgggcattcttgcctttttcctaatctaaggggaaaaagcattcagtctttcacctttgggtagatgttagctatcgatatttgggagatggtttttatcaagttgaagtagtttccctctattcctagattgctaagagtttttatcatgaatatgagttggattttgttacttttgttttggtaattgctatgaacctatgagttttcttctttagcctgttgattgcactgattgattttctaatagtaaactaatctcataggcctgaaataaaccccctttagtcatggtatgtagttctttttatatattcctgaattctagttagtagtattttgttaaagatttttacatctgtattctgggggttaatgctttttattctttatttttcttttgttgtactgtctttgtctgcttttgtattaagttaaacctggcctcataaatactttggaaggtgttttcttctcgtctgctttatggaagagatagtgtagaattaatgtttaattcttctttaaacatttagtagaatttagcagtaaaattatctgggcctggagatttcttttttgggagttttaaagttataaattcaacttctttaatagttattgacctattcaaatgacttctttcatcttggatgaattttgatagtttgtggttttgaggaattggccctttttctcagttgtcaaatatatgactgtaaagttgttcataatattcctttattaccttaatggctggagggtctgtagtgatattccttatttcattctgattttggtaatttaccttctctctttttctttgtcagtcttgctagtggtttgtcaattttacagatcttttcaaagaaccaacattttgttttcttgattttctctgtttttctatgttcaatttcaaggatcctgctcttttatagtgaaagtgagtttattagagaagtaaagaaacaaaagaattgttactccatagacagagccctgagggctgctagttggctatttttaatggttatttctcaatcatatgctaagcaaggggtggattattcatgagttttccgagaaaggaacgagaatttcccaaaactttaggtttctcttccttttaaactatatagggcagcagtccccaacctttttgacatcagggactggtttcatggaagacaacttttccacagatggggagagggttgtgggagcagtgtggatggtttcaggatgattcaagtgcattacatttattgtgcactttatttctattatgattacattgtaatatataatgaaataattatacaactcaccataatgtggaatcagtgggagccctgagcttatttttatgcagctagatggtcctgtctgggggtgatgggagacagtgacagattatctggcattagattatcataaggagcaagcaacctagatttctcgcatgtgcagttcacaataaagttcctgcttctgtgagaatctaatgctgctgctgatcttactggaggcagagttcaggtgataatgcaagcagtgggcagtagctgtaaatacagatgaagcttcaactcaactggcctgctgctcacctcctgctgtgttgtcaggttgctaatagcccatggattggtactggtccgtggcccaggggttggagacccatgatgtagggtaacttccagacattccgatggcatttgtgaactgtcaggtgctggtgggagtgtcttttggcatgttaatttattataattagcatataatgagcagtaaggatgaccagaggtcactttcattgccatcttggttgtggtgggttttggccagcttctttactgcaacatgttttatcggcagggtctttgtgaactgttatcttaatgccaaccttctcatccagtgactcatccggtgactgagaatgcctaacctcctgggaatgtagtccagctggtcttatcctcattttacccagcccctgttcaagatggaattgctctgattcaaatgcttctatttccccctcccctttacaaggggacccttaatcctaaaggttgtagagggaccaagatccatcttctgtagtatcctttggcttaataggggtgatgatattccttcctaacttgtagggtctcttgtattcaaggtagagtgaagcgcagtcataaagcagctatgtggtgaaagccattcataactctgagtcctgacaaaaggcgatatttgggagaccaaagtattatctgttcatggttcgttatggaatatattaccggaaaggggtctgatccagaccccaagagagggttcttggatctcacacaggaaattttgggtgagtccacagagtaaagtgaaaatgagtttattagagaagtaaagaaacaaaagaatggttacaccacaaaactgctgatgtctgcttttttttttttttctttcttcttactttgggtttattttggtcttattttctctagtttcttaagacatcagtttagcttattgatggaatttttttctcttttctgtctctacttcagctgtttcctacatattatatattttttcagctgtttcctatacattatgtattttcttttgcattcagtttgatatggttttttttttttttctcttgagacttcctctctgactgacccatggataacttaggggtatgaatgttagtatccaagtgtttggacatattcttgtcatctttctgttattgatttctaatttgatcccattgtggtcagagaacacattctgtataatttcaatattttaactttgttgtggtttgtcttgtggcccaaactatggtctgtcttggtaaatgttctgtggattcttgaaaagattgctttttgctattgttggatagaatattctgtaagcattgactaggtgctgttgttagtggtgtccttgagttttatgtcattgctgattttcttgtctagttatttttatcagttgttgggatggggtgttgagctctccaactgtaattgtagatttggcgattctctcagttttatgagattatgcttcagctactatacgtttctgcagtttggtgtgctgttaggatcactgtgtcttcttggtagattaacctttttatcattttgtgaggtctctttctatatgtgggtattctttttgctctgaagtctatttgataataatataagcacatcaaatttcttttgttttttttttttggcgtggtatatcgttttcatcttttattttaaaatatatatatttttatacctaacatgaatttcctgtaatctgcatatagttaggccatgaatctaccaatctgtcttttaatgggtatatttcagccctttatatttaatgtaatttttgctatgtaagtctgccattttatttttttcttttttctttatttctgttttttcttttctgtatattagttttttaataattctatttttatttatatatagtgttttgagtttatgtctttataataatgttttagttgttgctgtaggcattatatttcacacacacatacatatatatttaactatatatagtctactacatgtagaaactttatgtccttttaagtcccttttcctctcccatttataagtttcttaaatattttttatgcgtattttaagaagtacataagaaaatgtcacagccatacaagggtggaggcctacactccccagtcctccctttcttttttcttttttgagacggagtctcgctctgtcgcccaggctggagtgcagtggggtgatctcggctcacagcaagctccgcctcctgggttcatgctgttctcctgcctcagcctcccaagtagctgggactacaggcgcccgccaccacgcccggctaattttttgtatttttagtagagatggggtttcaccatgttagccaggatggtctggatctcctgacctcgtgatctgcccgcctcggcctcccaaagtgctgggattacaggcatgagccaccgcgcccggccttcccagtcctccctttctgatgggaatgggggctggggccacaggtttttctgtggtgttaggtagattactggatacaagtttcctgcattgctagtcttcctctttcctgatcctttggctagagtgtgcaggctttcttaaattttttttttgtgtgtgttccttgtcatttccaggggctggcttctctatcactcattttaggatacattaggcaaaaagaaaatcaccatatttttccttgggtcccaagctggtctcactttttctctctacctttcagaatattgtgttttatatatagtgcccagggtttttagctgtatttgacagcaggaaaagggagaagtatgtctactccatcttttcctgaaactggaattccctgttctattaaatgctgatcagagtatgttatttctactctctataagtaaattgacaagaagctaagtagttgacaccaaggaaagtaagagagctattattttcagggtggttatatttaatagaagaatttttaagatactcaaatcaaagtaatgaaaagaggaagaaagattccaccaattgctgtgggtgtttataaacaagaatgatcataattaatttaggcaggatcaggaaaagcttttaggaaatgggtttgaaagaacctaagggggctggataagattttgacagatgggtagagaagtggaagacgcattgtaggtggcagaaataaaatgagtaacattctttgtctttctgggcataagctctgatggcatacaactgtttgataggctaatagatgggtgccccttggcggtggcaggcagcgctgtttatgtatttatttcacaaggttgtctttcccttcttatactcagacctatgccagagattatgatttgttggtcttggggaaataaagacagatatcattgtttttggttttaaaatttcttaggtggttatagtgtgtggccgggattgacagatgctacagctgcatctctagataaacacagtaaattaatttaattttgtttaaatcagtaaatagttaacttagtgtctgctacatgctgggggagttttaggctatagaaggtgggacatctaatatcttttaaaactcctgcgaacttataggtactgtgacagatactttcacctaaattatttcaggaattaatgatctagcaggagagacaatttaatacaaagttgattgttttaaatgccatataaatagagttacaaaattaaaaatagagttataaaattactggagtggagatggggacagatatgagtaactaaattataggaactaaaagtaagagggttcttcgagatgaaccagtccagcctctgcatctgacaaataaggaaactgaggctcaaaaatcagtaattttctcaaggttacaaggcttgggaaagatccaaggaaaaaaagtttccctgattccaaggtcagtgctatttccacagacctgcaaaggtaaacatacctctttggtgaaggaaacaatgactgttttcttaaacatgtctatgaagttaccatctgaaagtttctttacttagtagtacagtgggtagaagcttggttctgcaaaacgcatagggaggatttggttgagaatttgtttagtataaatatagcctttgaaccaaaacatttcacaaacagcataacagcaggtagtatctatggagagcatctggggtcatcaccttattcaatgttttctaagctgtttttgccaaattagcaaaagaaaaaagtataataatttcaaaagataagatttttatttactagaatatcctaaagattgttaatttagtttttgtggcttttttttttcccttcatcaacatagaaaatggatcttttatgtttctgttttatattgaacaatgtgggatcacccttaaatttaaagaagtatttgattatacctgagtcaaagaatgttgatacggaaagtgagaaaaatttttttcatttcagacccttcataagatctgtaaacactgttaaactattatcgtaatttttaatacaatattatttttaagtcagattaattggtctgaaaaaatatacataatttcttttgcagatttaactgggtatgatcatgatttataggctgattttccttaatgatattttaagagtgtttcagtagatttttttgtgcatatgtttcagtcagtaaggaggctaaggacataagacccaatatggttccctttgtataacattgaacagttactttcttgaaaaaagttttttctgtaaagtgaggacattgaagtaaatgacatttcaggagtatcgtagttctgataatctgtgattaaaataagtaaagctaaaaagccacaagttattgaaattaaaaagcatgtccacgtaaccagtggcctacatgtcacattacaacatcctgaatcttttttaatgctgtgttggttttgctaactttagctaatgttctttatttttacctgctaatcctctgaaaacctgtgatttaagaagaaattttatttttttttgagacggagtcttgctctgttgcccaggctggaatgcagtggcgtcatctcggctcactgcaacctccacctcccaggttcaagcaattctcctgccttagcctcccgagtaactggttttacaggtggctgccaccacacctggctaatttttgtagttttagtaaagacagggtttcaccattttggccaggctggtcttcaactcctgacctcgtgatccacccgcctcatcctcccaaagtgctgggattacatgcgtgagcccactgcacccggccgaaataaaaatttttagatgataatttttttgtattgcctgattcacaaattggtgcattttctgtgtgtttaacacctaaagtctatctccccctttaaattccttctttttctgcaaaagactggaatctgctactttaacaagagatatatgatgataaatgtaatgtataccggaaagaatatattatttcttgtacattgtactacaaatattagaggaaaataattttttaaaaaaatattaaaaataactaggtttggattatgatgtatttttagtaatttgagctgcctgtattttaaaaaaatgaaatctgtcttctcgttaacactattgctctgtgttatttaaaagtaaaacaaagtatgacttggtttctctattttttggttcccttttttattatacctccctaccccatctctctctgcacagggtgggtattctgctccctccttctctccttggcagggctccttccaggggatcccacggactgttccaccgcaccgcagacagagtgagtctgtgtctctcactcctatcctgctctggcttccccttcatggtatttcccttctgcatgacctgttcctccccagcacctccttttctatcctgagtgctctgcaggcatctgctaaagcagcactctctgtggtctcctctcttaacacttccttttactgcatgtaaacagacctctacttagagccttatggaagctgtctgaggttaatttcattctaatactgtttaaacctattgccagtgaccctagacctactgacatgcatctgtctttaatgcattttcaaaaccttgaaatatgtgaataaaaattgttgtgttatctaattgttttaaaaagtgtacatgtgatctacaatggtatgatggacagatgcataatgtgtggggagcaggcttactagaccattgcacatttctttaaataatatttcctaattaagggcttggattgcatttcactgtcatctaaaataaagatatttctaattgttttttctaaaagtggtttaaaacaactaagatgtttttgtaatttatcagctttacagcacagaagaaatggcttttgaatatgcatggtttactaacatttctaatgatttagttactgtttgaccttaaaatttttgtttatgttaaatctcttttccaaaacagtgtgggttattttgttttatgtacttaagtatgcctggtaagttggttatattttatcttttttgaaaagtcacccataaaaagctattattaatgaaaatgaagtgtaaatacagtcaatcagaggtatttttatgccttctccaaggatttatcatgatttgtgattcattcaattttttcattatccatttccatgtgaagtatcaaaggtgtcaaaggaggaaattttaagcaattaggaatgtgatttatttaaagaaaattttatttcttgaattagccaaaattatgaggtatcgacatgaattccagagaaggcatgaagtttattttttggctgctacacctctccttcccttctgtactttttgttttaaagaaaaatcgtttctgtaggcttttatgtgatgttctttagtagcaagttcgtttgtttactggaagcaatgagaaaaggagtttttttgtcctcctccttttctatctcccaccaccttggtaactcctccttctcccaccaccttggtaactcctccttttcacttctctcgtcttcaagtaagttgctttcttttctcctctatttaaataatcccagcacaaaaagaatcatactaaaatgctagtcaagtcatctgaaatttcaaagggcagatacaacaaattatatgttcttaggcttgtggccagtaaacagcaaggtttgagatttcccctcagattagcacacccacctgtgtacttactcaagcccccttttagcctgtatccttttttgtcaccatgttcctccccctttctccttctcctcagctagctgtaatacggaattgaagtttgggattaattattctgtattacaaatagagtttcagctttacttttaaaaacatgtttatcagaaatacccatttcattggtttatttgtatagcattagaattttcttgtcttttccttgattcagtggctctccattttcaagtgcttcttctccttccttcttgggttcagagctttcctttttgtttccaactgtgaagcagcactatcctacaattcctacaatactagtaagacctgcttttttttttttttaaacctttctagatcaaaacttctttgcatcttcagattaacaaaaagaaagttttggttctccagagtttggatgtattagtcatctagggaaaaaaaaaaaaatatatatatatatatatatatatactcatatatatatatatgagtcttttcctgagtaggttctcacggcctgtgcatctaaaagcactggccctaggatttgatctttgagacttgtaggtccctgtttgtgcgaagtaatgaccagagggcctgttcacagccttttaataactattaatgagcttgaaaggttcctttagaggggaaatatgctctaaactactactctattttgaattcaccctgagaacagctaaagcagtttactaataaagggtttttttttagttataaaatatagaaaagaaaggtatgaaattattagaataaatctagtggttttccagagggttttgaaacagatctcttcttttcctatactaaacttgtagtcagatgatacttgtctccacatttaatcaatatgtgggtcctagtactcatgtttggagaggttgattgtgcttaagaagatagttgagagatttctccagtataatgtttcattaaaaagttctttgatgacttctttttttttttttttttttttgagacaagagtcttgctctgttgcccaggctggagtgcagtggccagatctcagctcactgcaagctccgcctcccgggttcacgccattctcctgcctcagcctcccaagtagctgggactacaggcgcctgccactacgcccatctaattttttgtatttttagtagagacgaggtttcaccgtgttagccagggtggtttcaaacttctgaccttgtgatctacctggctgggcctcccaaagtgctgggattacaggcgtgagccaccacgctcggcctctttgatgacttcttgaacatcagcttgagggaactgcctttatcctctaaatggggaggcgaggtaaagcttggctgtgagtcttcagtaacagcagtttgttgttttttaagttacggaagtatagtagaccttctagtatgaagatagtccgttctaaatatgcagagtgagataattaatgtttacagggagtatttagccctcgtcactctagaaagctgtagtggccagcagtgttcaaactgcgttgaagaatataggaaaataggcgaggcgcggtggctcacgcctgtaatcccagcactttgtggggccgaggcaggcggatcacgaggtcaggagatcgagaccatcctggttaacacggtgaaaccgcatctctactaaaaatacgaaaaattagcggggcgtggtggcgggtgcctgtagtcccagttagctactctggaggctgaggcaggagaatggcgtgaacccatgaggcggagcttgccgtgagccagatcgcaccactgtactccggcctgggcaacagagtgagactctgtctcaaaaaaaaagaatataggaaaatagagataaatggaaggttctggcctttattatttttccttctcaggaaattttgacttacatttcttaagtatattactagtctctacttcatgatacttttttatttcaaattaaattttctctaggttagcagaaaatatctacatttaggtctttcctgctgttagtagggatttgagcttttgtacaaattcacttaactggcattggtgtagtctttctactctaatttccaactgtgtaaaattgggagtaataaataacctacctcagagtaggaaaatttaataaaaataattgtttttggcaaatagaaagccttcctggtaattccaaatagcatttcttgccagagcatgtacttacaggaatacttgacttttcaaaaagtatgtttcgaaataatacctatttcttactgtgtctaactaagcttttaaaacttgctctttagtacctggcttgataaatttagaaatcctatttatttttaccttccatgtgcagtgacttaatgcgaagggaaaaagttcttttaaaacaataaaaattacataaatgcatctatatttgtcgtaatagcctgacagtttcttgatgtagtgttgtgtccaccataattatattaagaatgacaaatttatattgtcttacatcttctttctcttacaaatttcagggggtgtttcacaaacatttttgacatgcagtgattataaatttattttacatgacagcccagtatacatttactgagagaaagtatgtatttacaacaacctgattcactgtgtatgtatatttaaaattctgataaaagattcatgggacaatactttctcttaaaatatttgatcctctcatattttttctctctattctgtttttttaaatgttgctagcaacctgcagttaaaaaacattggtctattttgcccatataaatatgagcatttaggttttaatatactgactttaaatatgaaggctaagaagtgtagataatttaatgtgcatagattttgtgtgtataatcaaagtaaagcttttttttttttttgcagaaatactgtttttaagtggtgcctcctaagaattgtctatggcaggaaaaaatgtttattgttgaatattaatagagtggcttaaatggctgatgagccctttgtaagagccagcttttcctcagtttaaccaaaacgttgatcttactgaatgcccacctttgccatttgcctgcttatcctcgactgcactgtctcagtttagtaattcactgtacttattcttttagtccttttggctggagaattgttctcttgaaattcatacagttggataatctttctaagagctacttaaaaattacactttcacaaatattcctataggaaactcttatgtatatttttaaaaatttagccatacattttaagaaaggggaaaagactaatattaattgaatacctattatgtgttttaatgtcttaagtacttttctgggcatttcatttaaattatttgattctcacaacaactcagagccagagatattattccaattttataataaggaagatgcaaataaatcataaataaatcaataaatgatgtagtaatttgctcagggtaagtgaacaaaccataattaaattctgttctacttccagagtctgaaccttaaatattttttgtaaatacaatgactcttccttcaaaatgtacatttgtcctatttataatagtaatgtagtgactcattatggaggaattagaagaaacattttggtatatttcctttcagtcttttaaatattatgttataaagttgaatttatgtattttcagtcgttctgcttttttcacatagtatcattttatatatatacacacatttttatatggtaaatatttcttgaaattaacattttaatggccacttgataatgcattatgtggatatattctaaattaatttttttctattgggcattaatgtcgtttctagttacagagaggaatattggtaagcagtttatctttgtgtataaatcagtgtcagtgtctctcttttcttagatttcctggaaggatatcatttaattaaagggtatacactttctaaggccacttgatgtgtcaaatgtgtatttgacaattgttgaattgtcaaacatgctcataatgtataaattaacaaggctcaatctgattgactctaatgtgtgactataatcaattttatacataagaatagcttcagcttccttagaaattagctctgggagtgacttttcataaaaataaaatatttttgaatgaaatgcaaactagagtaactcagtaaaaaaactttactaattcaatttcgtgtatgctcatttttaatttaaatatggttaacatcaaatatggtattttgtaccttttcgcagccaatttcaaggactatctagtatagtcattggttaaatgactagaaatgtgcatctaactcatggtccaataggccttccacaaacgtaggcatgggttagtttcttggaattatgagaagtgcagcgttagtggtttctgtataaagccttttattacaatctgctttgcagcttgtgggattttttttagccagtcttttttctgtaccataatgcttacagtattcttgtactctggataaatatactgtgtctattgatcacatcaatggaactgtactattatgatgccatttaggttttttttcctgaactactctacatcatctgagaggtagatgttaatggattctgtgtctttgagatatagacccacgaaattaatcatctaagagtgattgtgcctctgtagtaaatgcttacttaagtccctcttaatcactttgatacttaaaaaaaaaaaaaccaaacccgttaactggtcatcaacttagaaaagccattgaactctttatttcagaaattatttttaaacaatttatattatcaatctgctatcctctaaattttctgaggtctagaggcaccattttgagatacagaggaataagagcattcctttttcccaaaaagcactggaagctgtgattggcttcatgtgatctctaaagcgaaagtctttaaatctagttgtaatacagtattagggatacaaattaagtctttctatactgatgtgcagagcctcacttataatttgcatcatattcaggttaagatcagattatacctttagtggtcttcaatggcaataattaaactggccgggcgtggtggctcacgcctgtgatcccagcactttgggaggccaaggtgggtggatcacaaagtcaggagttcgagaccagtctggccaacatagtgaaaccccgtctctactaaaaatacaaaaaaattagccgggcatggtggcaggcgcctgtaataccatctacttgggaggctgaggcaaggagaatcgcttgaacctgggaggtggaggctgcattgagccaagattgcactactgcactccagcctgggcaatagtgcaagactccatctcaaaaataaataaataaataaataaataaataaatctaacacttatttaatcttataatatgcagaagcctctgaaattacttaaaaattcatttctacctccttcataagaggttacttgggactaaaactttttaggtatttggagtatgaatattaaattttatcagaattactttcaatattttgtttggtaagagtcttcaagtgattcctcttaagtgtgtgtgagaagttttacacatgcctttctgaggttatgagtatttgtactaactcgcaaattactttagtaagaaagtataaatctatttaatgtttttgttatgtacaaatatattaaatgaaataatgaataatgcctaggaaaacacaacaatagcaaagcaaatacttgtggctgccacccagtcatggcaatccttggtgttgtgtgtggtctctgatgccattgtcctgtctttttcttgtctctgctctcccattatgccattggcaaggagttgagaagttagtccattacttctctgacaaagcgtggtacagtacaatttcggattttttcctaccaccttcctcataatcactttttttggtttttttttccagtttgcatgatgcatgtcagagcctgcatgaaagtacaggcatgttacagatggctctatttccaccttcctttttatggttaaaatgtatttaataataacaataaacttgtatgtacccaggaaaaaaattagctaaattctgtgtctgttatgcagtagcattattacactttagaacatttcctgctttctatttggtgcactttgacatatttttactccatcaggacttgacattttagctgccatcttttgctaataaccctagaacaagaatgcttatgaaaactggcatgagtgcttttccgtatgctaatgctgtagatctttgaagtgtcgtaaaacagtaaaggtgaactgttttgctcattggtgggtactactttgccttttttcatgttcattatgtttcccccaatgggtcactgtggaatcacctctttccagaaatactgctccacactgtggcttgagtttagtatctgaaagttatcctgggtaggctagatcatctaagaaggaaataggacattatccaggaaagttagttccttaatattggtattatatctgcctgtagtgttttaaaatatattaaaataatcatctggttatactgtatattctgaaagcctgtgaactcatcagaactaaccaaattgcacagaatattaaattttagtgctgtattttaagaaattatctgatggttcaaattctggctttgccacttgccaaaatgtttgaatttgaacacgttaacattttttaaccccagtttactcatttatagaaagaaaagaacagtatgtttcacctaggggtctcatggtaactagagatcatgcatgcagactcaagagtttgaatctatacccttggaaagaagggaacgctgttctctaagagcccagagtatgacatttctcaggtgtttatgtgtcaggcattgtactgttactggttattatttgcaacaattccatgaagtatatatactggtattaccctcattttgtaaattatgaaattccatttcagggtagtgggattatttttacccaatatctcacctcagtgatagatctataagtgatagagccaggattcaaactcagatcagcctgattgtaaaagctaagtgactcagtattgtgttgtactacctcctttgtagagagaagaaagttctctctaaacttgcatgtctttgctctggttcttatctccaggaaggcagttaaagatccttgacttctgtgtcatattaaatatgcttgatgtggattcaaaacttatagatagtgttgacattattgaactatgtatttgaagcctagcaacctcatattctagtttattattatattgctaaagaacttgcttttgtttcgaagacccagttacaaaatagctatgacttgaactcatcattcttatatgctttaataatcatagaagaaatttattgaggacatactatgtgctaggaagtcctatgctaaatgttttacatatgttgtcatatttaattattagaattttctagtagctgaatgcttgttaagatactttccccaacctatttctagtcttcagataaaaaacatttggtggctaagattttaaaaggtcattatgagaggtacttatgtataacatgcttgtgtataacatgcagtcagtatttcctgctatccttctaaacatgaatcattaagctaaccagacttatttggagggaacaattgttttttcctattagattatttttcatcagtgtttattttttgaaactagtttttatttaatcattaatgcttcatcattgacctaaatcactttggtaattcttggccaaataagtaattcttgaatataccactaatatttatttattcacttattcatttatctagcaaatgtatatttaatccctactttgtgccaaataatagaaataccaactataacgaaaaatgaataaagcatggtacatgcctgaaaggagctccaagtctttggctatctttgtaaagcagcctaaaatagacatttacaattatcattaaagatgtctaccaagcctttgcacaacccccctgtagtgcctattgctgacattattgaacttgacgcatggaactctttaatctgagaattatcagaatggtgtgctgaagtttacatgtataactaaagtaagacttgaagttgctgagttcagttagaggcacttagctctgtaagtctggggataggtcctcattttgatgcttcagtaaccaagccctccacaagtttcaggattaaagttttactcatttgtgactatagggagtagttaagatatgagatctttcgtagtggggggattccttttgccctctaggttttgtgggcttccgaggctatgaaatccatcgattagcggaaagccttcccaaaggccttttttggatacaagccaatacctcatcttgcctgtccccttcaaatctttttcagtcctctccagattttatgccaaatagcttgtgatatggtttttctgacaatttcgtccccactggttacattcctcactggttccactggagtgatcattctaaaacacacacattagatattctgattcctcttcttaaaattcatctatatctcccatcatctacagcacaaagtcatagctacttagcctgacatgagtcctaggagctggcccttagctatgcttttgcactatcctttcaaattcagtctaaaatttgaagtgaccagaacatggcatgttctttttttgcctctgtgtttggcatgtactagctcattacacagaatattcttcccttcttgtttatttgataaactcctattcaccctgttaaaactcagggcagattgttcgcggttctggaatgcctcctgtgacctctccaggcaggcatgttttctttttgttcccatatgttgttacgcttaagacatgatctcaccattcctttaccttattgtctccctcactaagctcctcaagcacaggaacaaagttatgttcagctccagattttctcactcctagtacagtacatgatacataataaacatttaaaaagtgtatgctttttgatattcattcctatttgtcttagccatgaggatatgggatctttttatatttacattctaaaaatgtctgagggcatccttttaatgaccatagaagcagcagtggatgtgagcaagatgaattaacatctggcatttatatgaacacagttgaatgtttagtatttggggaaattgtagcaacaagccatcagaacacatctctgccttgcttgctagaggttaagaggtagcttgttgttcaacttgctagcaggggtaattagcggcaatccagtccttagtgggtaaccacttccatgtagtcttccacataccaggagcaagttgtttccttgttcctcacattataggtgtttcttattcctcgtgaaagagactttttgtttttacagtagtggaattgattttccaaatatagttaccaaataaataataaagcaagacactgatttggggatagggaaattatatcatgccacaaaaattaatttttaataaaaatataaaattttatttcgcatatagaaaccactgatttagttaatgtaattcactagtagtatagatgtctaacttgtagtttagacatttatttataaaactgttaaattcctctcggttgactcaacattttgttattctttaaaaactggatgttttctaattcattaatatttgatatgaagctttattgcatttaatacaagtagcttgtctttctgactctgctgtatttccgtttatttctctgataagcagtggtcagttgggtactgtgagtaatcaaaacagtacaagtggtgagtacaaaacagtacaaatttatagtgcacaatggccctttcctgggcatttctggaggtaggttgtcttaataatcagtttattacctgtcttaattgaaaaatcatctttttatgcttttcactgatagcacatgtttataccttttttcttattggcaatagacatattacaataaagtccatttttaaattgtcactgatattttcagaagtcttaaattgctttaagagttttaacttggaactagaatatcttaccatgtttgagggtgaaaaggaaaaacaaatccccattcaaccaaccaattgatcgtgcctccttcctaattactttttattccctttggtagattttggtttgtttaatatggtcctgctctattttttcactaatctttcaaggtttttgatcactttggcacggtcatttttatctagggaaccccagggagaatctgttgatttaattatgtggtgattttagtatcttccgttttgcgggacagttcattcatttttgtgttgatgtgctgtgaaaatacccagtgactttaaagtctgggatatttagcttgaggcagcaattgagctgacttgtttatttcaaacattctgcaatacgatttgatgtgacatatttctgtacagattaattttgagtagtcactgtcttgatttttttttaatgcaagtcagctgtatgccatcatagccaaccatcctccatgagttgatgagccttgccctcagtcactcccaatccagccataatctaatccctggctgctgatcctgggcagccattgtccagtgctggtcagggaggtggaagaactgaaaaaaacacaaatgatgcagtataaatagatccgccccttctattggggaaattagagctactatgtagatttatttgtggattagcatagcaaaaaaaacttattagtgagaaatggccctctgaatttcatgttgtaaagccctttgccaaagtttttgacattttagcccacattatttaaacagtgtgtgtgtgtgtgtgtgtgtgtgtgtgagagagagagagagagagaggagagagataatgcatttgtagcaaatacccctgtatcaggacaggcccagttggccctgcccatatattttaactatttgggccattgaaagatagctttcagatttgtattttttactggatacccccaaatcatggaaatggcatagttcctctgattgtttttgaaacataactacacaatgagcttcagggaagtacatgtgaggcacacagaccctaagaaccttgtcataggcttctgttctttagttgcagttagaggcaacttcacatttgttttactctgagccatcattcaaaaggctgattattctaaatttaagtaaatgaatgtttacttttcattagggtagatctgtttttcacatgtcagccataataggagtgagacagaacaaataaactttgaaacattttatttggaaacttttcaacaagaatattaaaaataggttagcattagctaaatgtctcgacctatatttgttaaataaatagaatttcacataaactgagaatatagtgatttactctaaatcttgtttatctgctggtgcttttcattcttgacagaagaacaacacttgttaacatggtgtacaacttttttttttaactttaatgtaagtagtattccgaaggtcaccgttaacacctgaatgttttgtggaggttaaaccaaaagctgtagaatcattctgtcaagctctaaggtttaaaatacctaatgaatctattatggcaggaattttttctataataaattagtactttaatgttttctttttctcatttaattttggatcttgttcagtgtttactgcctgtatcattttttgtttgcattatcactcttgtatgtgtctaatttgcttgaatattgcagttcattttttaattaaaagaaactccacatattttccatattaaagccataataagtaccaacacagcctaattggtatttatattaaatctgggtggaatttctaagaacttgctgctaatgttgtttttaattttaacagcctcaagtactacagccttccagcagccttcccagacccacagatcacacccagggaaaactaataaagccacaacgtatcgaggcccgcagtgaatgctcaatccaagacatgcatcagggcggtgcacatccggaagaaagctttacacacgtcttgcaccaagaaagcaactatggtttggaagagcagcctttttcatcaggcccacaattaacaatggatgtggctaagagtacaccttctgaagcaaacttaaacattactgtaaatgctcaagagccttatcatttggcaaacaatcaaattagtgacatgcagtttatacccacttctcttcagacacctcccgagtcaagtacagtagaccaggctaagagagttggaagaaatcagtctccgccagtgggttatatgtctcagcccaagtccttgcagcttttaaagccatccatattgagttctttggtaccgcctccagtttctgaatcatctccaagtaggactcccacttgtaaaaagtcaccaataatcacaacatgtaattcagcaaaacttcagccaacatctagtcaaacaaatcttgcaaataatcagaatctgaaagcatctaagctccgccccccctcaggctctttcaaacaaaaacaaacaaacagcccccaactagagcctcaaagcttccaggccaagacaagcatcccaaggccactaacacaacgaaaagaaatcatgcagaatccaaatggcaatttgcattctggggattgtttggcctctaatcgatattctcgtcttcctaaaccaaagatacattaagtacatagccatcacctgccaatttgtttcttaaaaacaatctcttctgtaatagctttatgtgcagcttgcagcttgctactgtggtggaggttccattgaaagcctgcaaatcttaaattaaaatgtggaagcttctactagtttggctccttcattttatatcctggttgaagtacatgccatttgagcataattatctcaggtaaacacgaaagtttgcttacccatttcagaggcctgccaaaggcccaaatcatgttatccatccctctccacgtcagaaaattcataatattttactgagcaggcaagaagtgtgctttgctggtttagtcctattaaggtctgtatttattgtggttgtcagaacctcaccccttttcacttgtctctcctgtgaatatggctactattttaactaaagatatggtgataatggaagatggtagtctgtaagcagagttctggccagtgttttgtatatttaaaaggtctatgcaaaagctttgtgatgaataaaggagattaggcttttaatggaaagtctatgtaagttttatttttccttgccagggtcagtcagctaatgttactgttgattcatttcccaaattccccagactgaaagtgtttcttattacatataaatcagttatatattcctttacatcttgttttacaaacacatgtgcatgcacacacacatatacacacacataccatttatgtttgtatttgttactgggtaaattttggagcgcttgagatacaccttgaaacctgtacctaaagatgtattcatttgtaacatatgttggtgctagagttttgctggtaattcaggcttgaacccttaggcttgtggatccatgatagccattttaaggttccacagcattatgtctttaattgtaatatttatatttattgattttctgctaatatctgaagactgaaataatgaacttgaaacatttgcacaaaactttgatggggtataaatataccatatatagggattgtaaactattttctatagcaaaacaagttaaaatattttgagaaaaataacaaatttaaataagactatcttgagaaagctggagttcataatattctccccctcccccatctccagtctcctaggtttcccttttctgtgttttttgtttttttctgtttgttttttgagacagagtcttgctccattgcccaggctggattacagtggcgcaatctcggctcactgcaacttctgcctcccgggttcaagcgattctcctgcctcagcctcctgagtagctgggactacaggcatgtgccaccatgcctggctaatttttttgtatttttagtagagatgagatttcaccttgttggtcaggctggtctcgaactcctgacctcaagtgatccacccacctcgtctatggtgtatttttgaaagacaattttttaaaggtagatttgggaaaaaaatagaattgaagatgggaaattttgttttattaaaaaggtgctagaagatgtttcaaagacaatattcttattttaatacgctgtagaaggtaggtgtggaacctccatgctaccatgtgcacaaacctaattatgctttgggtcacttgtcagttcagtaaatctgccttcctcttctcccaaatcatgtcatctttaggttgttcacctgcagctgctttaaatgaattagtatctttcagatagataaccttacaaggagaatgtttgttttgagcagctgaccaaaaatatatcaaacaggattatggccaaaaagtcactcaaatttctagagattcctttaaaagatgtatgttgatgaaattgcccctttataagaaaaacaacagcaagtcttttagtagaaatttgaaagaagtgtttgctaccattttgacccattattcccttacctatcagatgaatttgccattcactggatagaaaccattcttggatttggtaagaggtgagcaagacaaatcttgtaccatactcttatgtaccagcacttctgatggagaagcagtgaagttcagaacgttcttcacatagtccagatactgttagagtcaggcaaatcagcaaagcactttgttatggagatgacccatgatggctgcagttgtaagtgggcatacatgttctatcattttgaaggagaaagaaaaccgttctcacatgttgcaaatatgtgaatcatactatattcccctaaagtaaaaccagtgacttagtggtttttggtttatttagaagttggtttagacccttatgaaacattatttacgagttggccttatccttaagggaaaagttctaaatttttaaatttatttttaattccctagtctgagggaaatgtctttattgtccattacataaaaatgttgactccagtaatttatttttctctattttttcctccatgtatttactccatttttctctattttttccttccctgatggatttgcagaaatgttaaccaattagctcaacttttctctacctttgttgagtcttaatcttttagaagataggcttatcgtatatttatgaagcataatatattaaaagaaaacaaatctaggatgcttgcatgacataaagtatttgcctgcagttttcattaaaaactgcaagaatatcatgcttgtctgcttcttagtaaatgttaagtctgaaatggaagtgaggatgtaactctactgaataatcaaagatcatcttagatttggcttgatctgtgtttattgcttctattaatgtaaatcaactctgtgccaaatcctcctccacaaaccatttattgtcttagttctagtggtatcaatgaagatagttacagtatatgaattctaagtcctgaggaagaaattttatggggtttgttaagtttcacattcgtgaaagaggaaattagtagagtattcagactttgatatttggctgttaatgggatgcatatcaaatttttaaaagaaggcttggcctaaggagtttattggtacaggtgcagatgattttaaggcattaaaggattatagagttatgtcatttagactgtttctaataactgagaccatctaacatttttcttttggagtctcatttttatttgtgcaatattttcaggcatataggctactgttcattgtatttatatatatattagaatttactaagtactttaacaagtaaaaatctgaatatgaaagaaaatatcagatttgcactttaaatgagcttaattgcttgaagttgtgcctgaaatatcgaattgcctcctattgggtgtggctttgttgaaataaatttgtaattgttgctgtttgaagatatcagtacagctgttcacagaaatatattcccagcatgtcacttttccattaaagcactaagttttctttgaatgttccattgttccgataagtattttacttttttctcagtacatcagagagagcgtgatccccctacagctgtcacttccaaatgttcctgtagcataaatggtgttacagacactgaggtgcactcttggtttctgagcagagttgtcatactggtttcctggtctctagggcactggggatgtactttgaaatcaccgaacaggcttgcaattaagatcaataaggctgcagcaccatttcaatttactttccatcttacccagtagtttttgtgtttttaaattcgtttgggtggttatgtttgcatgcttaagcacacatttgaaaattaattatagctgtactacccgatgtttttccttggggatgatggccttgttcctttttaaattctgatgcttgaattctattttctagtgatttttcacatctccctttaagtttttgctgcagcaatttgagagagtacttttgattaaatgattctgatggtgggcaccaatctacaactatgtcattaactgaagatacatgttttaatcttgttgggaataagcttacccactttctccttggtaaagcgtttacttaacaaaataatacccgagaatgtaaggtctctaagtcattactaacaaagagcaaaaataatatctgcagtattgtttttcccattgattttaagtcagtttagagtacaaactgtatattagaatttgcctgtaaaatgaattctaaaaagcagatgtaaagtctctcctgaaaatgttggcatagtaaataaaaataaagttcataattataaa

SEQ ID NO: 37218 - DNA, 5536 bp, Homo sapiens; identical to SEQ ID NO: 36161

SEQ ID NO: 37219 - DNA, 3386 bp, Homo sapiens
gtcccggtccgaaacgtgtctgggctgctgcgagagacagtcggtgaaggaagggaggggacatccgaagggtggcccgggaggccgggcgatggtgaggagggcgcctcctctccaccaaatcctccccatccatgcgggctagggacagaccctcccccgcccaccctaggctggaaagtgaacgttctctgcacctctcccacctacagactaagtagggcacccggtttccgtgtcggcttcaccactgactcggaatgggatctacctttctctgagcctcacttttcccatctgaaaaatggaacttccgatcccgcactcccatcccactctggccccgggactctgggatacttagagattggcttttggtggggcggcgacaggactgtggccatgaaggccagggagtctgggtccccaactcggtcccattccctagagagattcgggcagcaaccggccccacaatgctcttgagaactacacttcgccgatatgcaaagaagaggaggcggttcctgctcgtctccgacgaggtgggcccgagcaggcctggggactacgactcccggcgtgctccgcagtccaaagccggaagagcgtggacccggaaccggatgtggcttgcggctcgggtggctgagcgcgcggggaaatggtgagattggcaccgtgtgccggagataggggcgtctgggggtggggtcccgggtctgctcaggagctggggcatgggcacttggaacggggattgctctcccgcccccactattgtacggacgacaacgcggaggcctagcattctctcccagcctagaaactgatccctagtcagccctctaccatctgttgaatgggaagcttagaccgtgatcgggccgcgacgccccgcttccattagtgcgccgaaatagagggtcacttcgtcagctgagacctcccttttctccaggccacggggacagaccaggtggtgggactcggcctcgtcgccgttagcctgatcatcttcacctactacaccgcctgggtgattctcttggtatgtcattctccccgtccgctgctcaccttccccgagccctggcaccgccagagcaactactatataggctctaggcacggcgctggcttcattgcctgcctcatctcttgaactctccagaacaactctatgaggaagatgccagtggtaccgcattttatagatgagatagctgaggctaggggagaaggatctggcccaagattgcatccttagccgctacacttataactctgtttccggcttgctttgacttttgggggagttctgttccttctgggttagcctgctgactcttaggcatggcaaacgccagtgatatttgtgaaggcctttaggatatttttttcttgtgggaaaacttgttggttattgcttaagaagtgcagtgtgtctggaagtgcagaacttggtatcctttagagaaaaaatattagtgaagaagccctggaggcccaggttgggagtcagtcgaggattcctcaagtaccatttgctaggctgtgaggtgccttagggcaggtctcttgtgccctgttctcttgtccccaccaccaacctatagcaggcaccaaagcaagtgcccggtaaataccaataagaaattaaggaaagaaacaaaccacgacacccaaatgccgtaatcttaaagaaaagcaaatgcagtcccagtcctctgaatgggtcagccccttagatggaggaggtgggacgtttgggcttgggggctcggcaaggcaagcaagacacaccagagctcttccctcgatgccagccattcatcgacagtcagcatgtcatccacaagtatttcctgccccgagcctatgctgtcgccatcccactggctgcaggcctcctgctgctcctgtttgtgggtaagtcatcacctcctccccttgaccctgggcagggtttcgggaagaccccacctctgaacatgcttccacactttggcggtgctggaagctgcttgccccgaactcacccgtggggttttcctgttcatccttcgaggctgccagtcagtaacctctgggtttcctggtgccccaggctttttggactccaatgacctgtctacctctttcctgccccaaccccatcatcactctgctcacacctcagtcaccctcttgtcaccctggcttctaattcctgcacctctctctctcatggcttcctagggatggggactgtgtctccatcattactgcacatctagaacaggctgtggcactgaggctgtgctcagaaagtcatttggatgagtcagtcaacagccgggtgcctggatgatgggtggatggatgggtgggtgggtgaggtgtaggaggaggtgggtaggtatgtaggtggacagacaagtggttgaccgggtgatcgatagatgggtggatcttgttccccttggaatctgaaacactaaatgcagcatcttgcttgaggcaggcactcagttggtgtttgttgagtgaatgtgagtagacatatgccttgacgaatgactagggagataagcaggttccctggaggatggttgggtaggttcacagccctgtgtgtgggtggctctgctgtgtcatgccctggcctcccagcagccctgagcttagatcttatgtggcctttctggtctgtgtatcccaggactgttcatctcctatgtgatgctgaagaccaagagagtgaccaagaaggctcagtgaaggtcccgcagggatgaggctgccagccccttctctgcttcccctccagcacagggaccaagtgggggagcctgcagaacctgtccaggcacagtggctcctcaagcctgcctgtcctgcagagtccccatggcatggagcttacacctgactgactggagccccctccccgactcccacttccagaagctaggagggagggatacctggaagactccggtcacctccttcttgctcagggcctaaaagatgctggtcctcccaacctcactctcagactccctgccaccttttcccctgggttctgccgtcttgcctcacttcccctcctgtcacatgctgacgttggacttagcaggttctaaggccacatgtgtgacctctctgacttctcttcctccaccaaggcagctttccttaccctgacacagccccagaccccacaaagccttctggacctggaaagcctggggaaggactgacagaccccaggaccagccctggggctcagggcagccaccccgggccgctgaccgactgacctctcctcacggaggcccagccccaaagccccagggctggcccgtttgggacagctgaccaataaacactgatggtgtgtt

SEQ ID NO: 37220 - DNA, 732 bp, Homo sapiens
catcggcgctttgccacttgtacccgagtttttgattctcaacatgtccgagactgctcctgccgctcccgctgccgcgcctcctgcggagaaggcccctgtaaagaagaaggcggccaaaaaggctgggggtacgcctcgtaaggcgtctggtcccccggtgtcagagctcatcaccaaggctgtggccgcctctaaagagcgtagcggagtttctctggctgctctgaaaaaagcgttggctgccgccggctatgatgtggagaaaaacaacagccgtatcaaacttggtctcaagagcctggtgagcaagggcactctggtgcaaacgaaaggcaccggtgcttctggctcctttaaactcaacaagaaggcagcctccggggaagccaagcccaaggttaaaaaggcgggcggaaccaaacctaagaagccagttggggcagccaagaagcccaagaaggcggctggcggcgcaactccgaagaagagcgctaagaaaacaccgaagaaagcgaagaagccggccgcggccactgtaaccaagaaagtggctaagagcccaaagaaggccaaggttgcgaagcccaagaaagctgccaaaagtgctgctaaggctgtgaagcccaaggccgctaagcccaaggttgtcaagcctaagaaggcggcgcccaagaagaaataggcgaacgcctacttctaaaacccaaaaggctcttttcagagccacca

SEQ ID NO: 37221 - DNA, 24296 bp, Homo sapiens
ggcggggacagcggcggggacagcggcgggcggctgggacggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggacggtgagggcgcgttctgaggggccgtggcggggcagcggggcctgccacccggggccgccatcccgggcccgcgcccgcacctatcccgggaccttgcgcgcacacgtcggtgcggactcaactttttttggaccgcgccgctgccactggctccccgccctgcgcgcgcagacacgattttcctcggcccccggcgcccgcgcccggccgctttctccaccccagctcctcccctgtgggccccgggcgggggctgcagacgtggccgcccagggaggccagccggccgggccgcccggcttggggacagggccgagaccccatctcaggcccttcccggcccttcaacttcggtgaatcccacatccttttctcgcctcggttcctcatttgagattcagcgtctttgcctttgagacgatccgctccccaactgcccaaacccctccgtgtgcctctctgcgcctacctgcactctggccagagtgtgcctactggggggtctatgggtaactgcccgtgagtgcgccggtgtagatctgtagggacagtgggcctcagtgaagcactcacatggagccggacgtgtctaggcacttgaagtgagttaactcgtttaatcctccagcatcacccttgggataagtactgttactctcattaggaagcagtgaagggaggggtggcggttatataacttgcccaggggcagtcaagcctgggtttgagattccagcaccttaactctttaacttaggtgccagggccgagaggtaagccccatctccctcctccttcctcccaggtgcccgcgtctctccacagccctttctctatctcctaccccaggaggccccccagagggctgttcttgttaaggcccaccctcggagcacgaacacggctgaggacatgtgtctgtgtacgtagtggcatatgcatgtgtaattgtgcttgtacaagtgtgtagctgtgggtatcacagggtgaaggctggttcaggtcagggcattctcacagcccctgtttcctgcagggttgacagtgatgaggatggtgatttgactgatgataaatgcctgtgatatctgtgaccgatcatgatggagatatgtaggaagtgtgtggttgacacgtgtcaggtgacgttgtctggacctctgatccatctgtgatggtgacacgactgagatgatccatgcccaatgtgaatgatggctatgtgtgtgtatcacttgactgccatgtgcagaggtagcacaggacagtggcatgggctgctggacattgcagaggttttacaggcttgacagctgtgtgagtgccccagcctccatgcccttgtctgcccctagcttgattcaagtggtcaaagcaaaagccagcattcctgcttccctaaccctgggaggacctctctccccagagggtagactgggctgcatccccaggatcagcctggaccagtgggcaggcagagctgagcctagctgctggccccaccttggccacgccttggcccctacagggtgactggagggacctggagctacattggctgagtcctgctagatccccgcaagctaggccagctcctcccactgcctcccttcctctttctcctcctcttactcctttccagccagaccttggctgtctacaggatgggggacaccctgagccccggtgagtgattttgatccttggtggggactgcaaagggtcagagggcacaaagcacagtgagcctcagatctatctcctgccccttccccagttcagtgcccacacctctgctctgggaggcctagatgggcttgctcatccagcccaccttggcctgtgggcagggggtagggaggtgctggagggggcacctcaggcagatgtccgtgtacacagggatcaggagggtcacctggatccccacctgccactggtgcagtcacagttgctggtgggaacacagttgtgtagctcacaggcagtccctaggcctaggccatattcagatttactggggatctcaggtggtgtctgagcagcttcagcctggcaggcatgtccagacctgccctggaatttttggaatggctgaggccagaacaggaggtctgaagccgagggcagtacagacatccaggcactacttagacccttacattcccacaagcccttgggagctttgggggaactccgaggagtgcccactgggcgtctggcactaactgtcccttttctagtgcatctgggcagttggaaaaacaagtgttacaatctccacttcatagaagaggaaaccaaggccgcacagggagtaagcatgtctccctgggtcacacgggggaaggtctgggaatccaagccagtctgccgcagtctgaatgcccagaggcctaggtatgcgtaccctggccaaattgcagcactcttctctatttttaaagattgtgctgcatagatggactggagtctgtagtaggaacggaacctgcagctccgcccctacagggctctgatggaccctgggacccagatgtggccttctccctgggtgaccttgcctctgaacatctttgagcttcactctccttgtccctaaaaggtagtaaatgctctctactggaatgttgctgtgagaactagagacaacttttggaagggccccgagccatcctagagtgatagctgaagggacaagggataggctaggtcttagaggaccatttacaggcatttgtggggagctgctgtgtgctcagctgtatattttctggatagcaatacagtctacccagaaagaccaggcaacagtgatggggcaggctgtagtacatgagtttagaataaattataattgatttccagcctacttccacaaaagaatcagaagaaatagccaacaaaagtgtctccccaagtgattgttactctcaggaagattgaaaaccatgcagaggaagggggcaagcactcaggtgagacagatggtgactttatctaaagagtaaatttagcttggagattcctggcagccaaagcagaaagagaagtaagacgagctgtataactggcattttctgacaaaatgaagcacctgatttatcaaagggagacactttttttgtcacaaaaatccaaaagtaattttcaaaggcttttcactgaagagccattaatgtcattaatgtaagaggcagagtgttactgggttttcagatttttcttgggactccttctgatcctgaacaagcatggagggtacagcagatatcatagagtgtccgacatgaccccgcctggctttaacatgacacggtggactgtcttgacctctggctgcctttgtccactgtgccattggcattgacctatgtgaatgtggggctgagctgcttggctcacttagctagtccaggttgctgggtgtagcaggtgtgccactttcacatgctgtgggaaggaagaactgactttgccccagaaactgtcatgggcacacttgatttgttagtttccttgggggataaagaatccacagcacagcacctgctgagtggttgttggctcagagaaagcaattgaagcctcatgctgatagcaagagatgtatcagatacaggaggatgcctcaatcagcattctcagctgcagtcaagaaaaatgaattgtggcctatgtaaacagaaaaggttggcgggcatggccagtgcatggcccaatcacaccactagcctgggctggtggtgacagttctgttgccatctccatcactggacaccatgccagtccttctcatgtcagaactacatactgctgccatccaacaccaagatgtgtgctttccatttgctgtgaggccttgagccagggccggggctgcgagggtagctggggtggagggaacactcagcacctagaaaacgagtgcttggcgttctgcttggtgggaagctgggaatggcacccaccgagactcataagggacaagagttggaaaacagggaagaatgaatgataggaggccagaaaaaacagtcgagctttgggagttgaggcaggcttattgaaaaggagcatttcactccttttggcgagatttctcagagctggggcactggctcatcagcctagggctgtaggcggaggtttgcctggggcaagcggcgggatctgcgggcaagggggccattgtgttgctcctgccagcagtcccagctcccatttttctccctgctcagtccgacacccacccgtccgactttcttaggcaaccctagaaggctcctggaatccacttccgctctccacggcctggggcttgccccacctcccggcatgccccgggctgccctgcaggacgccccccgcgcagtgcatggtggggtagccagccggccacctttgggccatggcagccgaaggtgctgtgtgcggcttcgtctatctggagggcactgcctgggcggtccctgaggacaccgaacccttggcatcctgcacattgggtactccggaaagaccgggaaagggactggggcgtggaggcgatctgggggcgggtcaaacgctggccccgcccctctgcaggccccgtccctcagtgtccatacgtgcttgtgctagggcgcctgcgccctcacctggattcccttcactggagggaatgatgtcccaggttttggtcactggcctctctctggctatccctgggccttcaagagcattggcacggtgccatgtgaaaactgagttgcaacctggtgacactgcagctccaaagtgctccacagaaatgatttggggactggctttctgggaaggggcccaggctggggggctcaggaagcaggccctgattgtccctctctcttcacaggacatggcaaccacagagagagcagcccttttctttcccccttggaggcttccagaggaattgactactatgacaggaacctggcactgtttgaggtagctgaggagccattttgggccacaggtttggcacacagaggctttagctaagcaggcaggctggacacgtgggcctcctctgtcttgctcttcctctcatctcctcttgtgttcctggttctcatggcagccgggctgcagttcccttggccctttcaactgaaactgcctttccagaggccactcacaatcccacccccattgctacctccagggtggttcacctctgacttccttacaacccctcagcaaggaaacgcccgcttaggatttcccaactcaggatttctcctcttccttccactcctggttcttctccaagtccatggttcttcgctctcccatggattcttccttgtctttcttggttgacccttccagctctgtccctctctagttccctgagtcctggtccatttgcagctttaggggatacgtctctggaaagattcccaaatatctgcctctgtacttgagttttatcttcttcagactcaagctgagcagtgagatctggatttaagacgtagtttaagctcctaaactctgacccatgcattcagccactgcatggctgagtaatggagactccttaatctgccttttttttctctttcttcattttgagatggagtctcactctgtcgccccaggctggagtgcagtgacgcgatctcagctcattgcaacctctgccttccaagctcagcgattctcctgcctcagcctcccgagtagctgggattacaggtgcccaccacatgcctggctaatttttgtgtttttagagacggggtttcaccgtgttggccaggctggtcttgaactcctgacttctagtgatcctcctgctcagcctctcaaagtgctggaattactgctgtgagccaccacatctggccgaggctccttaatctccacatgcccccaagggccctcgtcttcctttctcacaccaaagcaacttctccctgtgtgtaggtcagaaaggagctgacagagagggaaaagctaaatgtgggcaggaggcaggtagaagcacagcctcgagaaggctgcaggagcagggatcatcgcctagaccccggtggggctgggggacctgagctctgggaggcctcctgacctgggaaagcagcaaggttctgcggtgaaggccttggcccagccccgcctgaggatgggctggaggatcaggatcccatctccgcgattgatgtgggtacttgcaggactggggtcaggggaagaccatccagggagatcagggtttgggcagacaagggagacttcacttgtcccagacatcactcttttgccctctttggttccctgaggtgactagagtggcttttttgtggggagggtaggcgtgagtcctagaggtgcagccatagccaggaggtggctgggcagagcaggcaggatgaagtatgccattgcccccctgccagccgtgttcttccctgccctctctcccctgaggcaggtggttttcacaaatgggctggcagtgattgtagccaaggcggggtagagagaagcagccgcggggctgggcctttgagtgccacgtgctggggtgtggtgtgcacacctgtccagttggatggcttggacttccccaggtaggaactgggatcaggcccaggcctgtctcagggcttggaacagggccagggaccaggcagctggctccacacagctggcacccacctggcccaatgccatcttgccctgtggctctgtttgcaggaagagctggacatccgcccaaaggtatcgtctcttctgggaaagctcgtcagctacaccaacctcacccagggcgccaaagagcatgaggaggccgagagtggggagggcacccgccggagggcagccgaggtgagctggttggggcggcagaggggccacacctgggaagacagacacagcaccatggaattgactgtttccccacatggtggtgagcacactgggggaagtgggtgccaagcatagtgagcagggaggatgggcactgaatgccttgtctcaggaggctttaagaagtgacctaatgagaatccccccggggggcagagggccagggagcccctcaggaatgacagcaggagacacagctgcctgtactcagcctttactgtgtgcgaggtaccacaccaggcctgggttctcatatgtcatctgtacaacaaaaccaagaggcaggtgcttactatcatccccatttttcagacaaggaaatagtgtcagggacattaaggaacttgtctaaggtgactgagctagacaagatcaatgtgtaatgctgggagatggattcgtagattttatgggagacagatttgtgggatatgtaactatgcaaaatgccagatcagtgacattgtgtgaggctggctaagagtgttgcccttggagccaggaaccaggttgtctctcggaggtcatgcaatccagagcaagtcacaaaccctcctgctgctcgcagtgttggcccaaggctctattggcagaagcctccaacaaccccctgggttccttgagtgccagtgtcaggggacatgtgtatgtgatcggagcctgatgctgccttgtggggctttcctgtcccactttttggtcactaatccagttctctggcccttcagccctcttctctttggggtgactgttacctctttgcctagctcctctgtgtcattgcggctcagtgtagctgagggctggggatttttctacatttttcatttggaggctagggaccctccctctccacacactgactccctgaggtttgggaagcagtggtgttttaagaggagctgacgtctggcactggctgtagtattctcagaggtcggcacaagcagaaggcgctcctggctgggataagccaggcctgcagcctcacacctggtcgtgagatttgggcctttctggggtggggccagcagagaaggtagaccccactgaagcgcgtctctcaccttgcccttcagggaggcaaaccagcccacacttcagagagggcagctgataccttgaggtcgcacagacctgaccctgaccctgtgcagccaggtgtgactagatagcagagaaccctaactgcgtctggccatgtctgtccagcactgcaggggtgtctcaacctctgagagtgctctgcccacagtgggtgacaggatccttaggtcagagcctcatccttgtcccttcaggccaagccagggagctggtggcggggagtgaagaggcccctgagaacggctagtgcacatctcagcaggaatgtgggagggatgcctgggccagagagagcccatcatcccttggcccaatggggaacccgtgaggatgcttagcttagctatccagcttacctggccacagggtaaggatgggagagggtgactgggtgtcttagctgcagtagttttttcatggaagaaggaggagctgggtcaagtctttaaggagtcagtaggaagttagggatctggggctgctgagctgtggtcctcacccagggcaggcccgagcaggggcctcggaaaaggaaggcttgaagcaggaagggtgggcctccgaccagaccatgccaagacccaaagcagcctctccccagcagctgctccagctccagcaccggcttgatgaccttctgaggctgccagaggttatttggggatgcagaaagcatttccggcccaccctgccctttcccacactgtccttttcttagagtgactcagcctgggatgggggtgggactgggagctcttgctgtcgctattctgtgggtggcatcctctgagaagggctcagacaaagcccagatgagggggatccgtcccctgcactgctccacgcaggacaggttgaggagccatttgtttttgctgaggctcttctgaagtcctttaggtcgctcacaggtcttgccccaggccaggacccttcaggaggggcattaaggaacttgtctaaggtgactcagctagacaagatcatggccatggagttctcttctccctagcttcagggcagcacgggcactgtctcgtgggtcttccctgtcccctctccccgtatgattttcactaatctagtcctttggatcagtgaggaggctttgctggggctccagtggaagctgtcagggccacacttcggaggctgcactcttgggggctcagtgcctcaaaaagatgtcagccagcctctgtgctctcagcctctgccctggcctcctggctggcccctactctgccctgagttgagaaagcctgcctggatttgcgtattagatcttcctcacctgccctacagcctgagcactttctctgtaggattttcccaacaggatgtcccaggggcttccaaagcaccactcactgggttcagaagcaccttttgggtacctgcagggcctgctggtgatagaaccataaacaagccaagcctgccctaatatagtaacaaaatatacaagcacattctgttaccatgacctgtagtgaccactgtgatagggagtatcagatgccaaaggaatgtgagagggagaaccaactccacctgaggcaaccttcggacatcttcccgagagaggtaacagtttcactgaagagtttgccaggccgtgaggcagggccgactctcccaggcagagtccagcacattctcaggttcgcagaatctgagggacccatgtggtcaggggctggagctaataagagaggtgatgggacacatctggtggcccaagccaaggagttggacggcacactggattacaagacaacagagggttttcagcatgggtgatgagattagacttgctttcagagacctactatagcagcagagtgggctggagtgtggagaggttgacaggctcaggagggtaccacccaggtgccccaggttcaagggactaaggctgggacaaggcaggctgatctcagggcagcagggagacagactgggtaggagttagtgtctaccgggactagagttgggggttgagagggagggccagggatgacttctgggactttggcttgggtgacttagggcctgctgggtgagaaggtggagatctgagacaaacctctctttctagaagtttaacagaagagaggaagggaaggaggcagtaccttgagagagagttaaggttccaaagttcaatgtgggtttttaaaaagaatcaggttttacaccttcccagactcaactgtcttcctatatgaaagtcaatagagacatcctagctgtcacccctactctctgtgttccctggggccccactgggggagggggcctgctgagtgactagggctgactctccatggtgcatccctctgatgctctactcgccccctccctttgtgttcgcataggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtgtgagtgtcctggcgtgggagggttgggctgggcatgggccacggctgcccccacagagcccacccagctgagccgctcacccaggccctccttcccacagaccctgctgacggccatctccatgagtgccatcgccaccaacggtgtggttccaggtcagtgagcgccacccaaggcctggtggaagagaaaaggacccagtatctgccttgacctacctgggaacccccatagcacacccctgccccaagcagttctgtagtgggctcccaatccctgatgccaggacagtgcccacgtaggagctttcctgcttgacagagttggagagtgccattgtggtttttgttaatataaaagcaataccaaaaaagaaaaaaaaagggcaatgtatgtttactgtaagagggtttgaaagtgcaaaaaaaggccaggcgcggtggctcatgcctgtaatcccagcactttgggaggccgaggtgggtggatcacaagggcaggagatcgagaccatcctggccaacacggtgaaaccccatctctactagaaatacaaaaaattagccgggcgtggtggcgggcgcctgtagtcccagctactcgggaggctgaggcaggagaatggcgtgaacctggcaggcagagcttgcggtgagccgagattgcaccactgcactccagcctgggcgacagagcgagactccgtcgcaaaaaaaaaaaaaaaaaattagccaggcatggtggtgggcacttgtaattccagctacttgggaggctgaggcagagaatagcttgaacccaggaggcagaggttgcagtagtgagccaagatcatgccactgcactccagcttgggtgacagagcaagactccatctccaaaataaataaataaataataaaaaagtgcagaaaggtatagaatggaaaattaaaagcacccataatcccaccatcctgaaatcactactgttcgccttttggtatatataagtcttagggtcttatgaagtattgcacacgcacactctatttacataaattgtatatatatatatatatatgtgtgtgtgtgtttgtgtgtatttcccaaaagtatatgtgtgtatatatacatatgcatttatgtgtatatgtttacgtgtgtatgtgtgtgtgtatgtttcccaagtgttgaaaacagttttttgattttggttttttgggttttttttgagacagagtctctctctgtcacccaggctggagtgcagtggcatgatctcagctcactgcaacctccatttcccaggtttaagcaattctaagtgattctcatgcctcagcctcctgagtagctgggattacaggcgaccaccacatttttgtatttttagtagagacgaggtttcactatgttggccaggatggtttcgaactcttgaccttaactgatccacccacctctgcctctcaaagtgctgggattacgggtgtgagccactgcaccctgccgaaaatggttttttgaaaacaggattctccatggtacaccataacctaattaatgtgattattctcctgcctgtgggttccactttttcaccattgtatacattgttgtcatgaacatccttgaacatgaatctttgttcatgccccagcagttcccttaggagagggtcctggaggtggattacggcatgaaaaagattgacttttcgtttatttatttatttatttattttgagacggagtgtgtcgcccaggctggagtgcagtggcacgatctcagctcactgcaatctccacctcccaggttcaagcgattctcctgcctcagccgcccgagtagctgggattacagacatgcaccaccatgctcagctaatttttgtatttttagtagagatggggtttcaccatgttggctaggctggtctcaaactcctgacctcaagtcatctgcctgcctcagcctcccaaagtgctgggattacaggcgtgagccactgtgcccagctgacatttttttttttttgagacggagtctcactctgtcgccaggctagagtgaagtggcatgatctcggctcactgcaccctctgcctcccaggttcaaacgattctcctgcctcagcctcctgagtagctgggactacaggtgcacaccgccacgcctagctaattttgtattttagtagagacggggtttcatcgtgttgcccaggctggtcacgaactcctgagctcaggcagtccacccatctcagcctcccaaaatgctgggattacagatgtgggccactgcacccggcctttttttaaaaatgtatatttttatcatttcctttttttagtagagacggggtctcgccatgttgcccagactggtctggaactcctgagctcaagcaatccactcaccccagcctcccaaaatgctgggcttacaggcatgagccaccacgcccagccaagattgactctttgaaagaatttcttgatccctgttcccagattttcaccagagacattgtctcagcagcagatacaaccagcaacatgagatgactcttgtccccctgtgcttgtcaccctggggcctggtcatgactctctgagtcttttaagggtgttagactttgatagaagcacagattcagggcagggagccgtggacactcacctggtggcaggcactgtgcggggccttagggccaaaaggctggatgagacagtccctcctctggtctggaggagtcagactaacaaaggcacaggcctcaggagggtgaggtgggctgagataggacacacccagccagaggaggctgtgggctgtgcacagggcattggaggatggtggccagtcagccactgctgcagactagagctgctcccgcaaagcagttatttccacgggccgtgctggacattcgagtcagatggggataggatcgaatgtcagcctagatgcttacccaccgtgcagccctgggtaggtctcccagcccctctactcatccacaaacaggaaaagcagtccctgtccctctgggtggttgtgcaggcttgtcacagggagaccccttgaagaagaaccagccttgacctgtgcacactttcatttctctgctgtagctgggggctcctatttcatgatctctcgttcactggggccagaatttggaggtgctgtgggcctgtgcttctacctgggaacaacattcgcagcagccatgtacatcctgggggccatcgagatcttgctggtgagtcaggctgagccctggccaactctggccatgtccaaacagtccctttggactccaaacagaaggctcaggctgttcatccccacatgtctggccaaggcctgggtattataaagtaggaagcctcttcgagagacaaagacctttactcaggctggtcttcctttcacctccatgccagtttgggccaggcaaggcagaggcctggctgccttcacctcggccctggatgttccatccacctgggcaccattgcagccatggcaagggttccaggaactgttgtattcagctcagtgacagatcttggtggtgatgtaggcttccttctgggcttgtgtgagctctggccagctctgtgtcctccggggctctgtgccagggcacttcagatccaccttctccttgtccttcaatcagggtaagcagccacagaaccctgctggaggtcggcgctccctccacgagccccatgggagctctgtcagcctcagcttctcattccccagtgaactgccgtaccagtgggagaagaggcaaggagctgcgggaggcatggggtgacaggtgcccgcccctggggatccagagggtaggagatacctggagggactgcctggctgttcttgtctccaggtcctctacctgcagcaggaccctgcacctgaatcttctgatttgggggggctttggcttgttttcatttctcatatcccttctacattcattatgtgggatttgtcccttctcctgtttatctattcagccatgtcattatatctgtatggacttctggatatttactttattctttgggttgtaatccaatactatcattatttattttcttgctcaaactgttccactttggctatttaacgattcaggttggcatctatgtttggatcctttttgtttgcttgtttttaagtaacagctttattaacatataatttacataccatgcaattcccataccaatttatataccattgaaagtgtacaattcaatgttttatagtatattcacagagttgcgcagtcaattctagaacattttcatcatcccaagaacccccattagcagtcactctccattccccgccagccctggcaaccaggaatctgctttctgccttgggatttgcctattctgggcatctcatataaacagaatcatataatatgtgaccttttgtgactggcttcttttaggtactcttattttttatttttatttatttatttgttttgagatgcagtctcactctgtcgcccaagctggagtgcagtggcatgatcacagctcactgcaatttccgcctcctgggttcaagtgattctcctgcctcagcctcccgagtagctgggattacaggctcatgccaccacgcccagctaattttttgtattttagtagagatgaggtttcaccaagttgcctggggttgtctcgaactcttgagctcaggcagtcggcctcccagagtgctgggattataggcatgagccattgcgcccggcctattcatttatttttttgagacaaggtctcactctgtcacccagactggagtgccgtggtgtggtctctactcactgcaaccaccacctccgagactgaagtgattctcctgcctcagcctcccgagtagctgggattacaggcgtgtgccactactaccagtttttgcaccactaatttttgtatttttagtagagatgaggtttcaccatgttggccaggctggtctcaaactcctgacctcaagtgatccaccgcctcagcctcccaaagtgctgggattacaggcgtgagccacggcgctgacctattttttatttttttttgagacggagtccccctctgtcacccaggctggagtgcagtggtgcgatctctgctcactgcaacctctgcttcctggattcaggcgatcctcctgcctcagcctccagttgctgggattacaggcacgtgccaccacgcccggctaatttttagtagagatggcgtttccccatgttggccaggctagtcatgatctcctgacctcaagtgatcccccacctcagcctcccaaagtgctgggattacaggcgtgagccactgcgcccggcctcttttaggtactcgtaaaaagaaaaccaaaacgacaagtttcactttccaaataagaaataaaaccctccttatccatcttcttgtttcagacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccgtaagtaacccaggaatttatctgggcattgcatggacatccctcccatgtagccagcctttgatgccccagatcccagagactgcagggtgggcacaggcaggggctttgacctgagcaggtgccggtgcttctgtccctcacagggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccagggtgggtcctccctcccgtcgtcttgctcttgagcccacaggctgagcaggggcacagagcacagagctgtccttgtgtggccagcttgggaacgggggcaggactggccgccttcccagccccccagtgtcctcccagcctggctcctggcagccgagtttggagtgagtggagcctgtctggccagcgtccaaggcctgcagcagcctgtcttccccagccaccagcccctgacactgcctggggatgttcccacaggatccataaaggcctctgtggaaggcgggcagtggcgggctctgggtgacggtggttcagccacctttgtctgtcgacttctagctgggcagctccttctctgtggtcagggtagccctgtggctgacgctgcagtcattgggctgaagctgttccctgagtccccaaagttgccctgcatctgcgcctctggctaggctgccccaaactacctggggtagtggggggcagctgtggtggtgacacagctacccctgcagaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggtgagccctgcctgcctacccacccagccctgtccccaatcccggggagcccctgagggagtctcatctgtttttggaggcatcatggctggctcaaaccgctctggggaccttcgtgacgcccagaagtctatccctgtggggaccattctggccatcattacaacttccctcgtgtgtatcctttcccaggcctggggcaggtggggcagaggacgggaagcgcttggcctgtgtacgttgccaggtcacatgcacagacaccccacacactcatatatagctccccttctcatgcacacatgcacatacacaccacgagactcccagctgtaggtgtcctggtagtctggctggggtgggggcacgtggtactattcagggacagtggggtggcagaggccgagttttccttgacgccgccgcagacttcagcagtgtggttctctttggtgcctgcattgagggtgtggttctccgggacaagtgagtgagctgggcccccctctttagcagcggctgggctttggcctgccctcacaccagctcccaaccccgtgggtggtcctaagcctgctggctgcctttggtggtctgtgccatccttccggacccctgacatccctcactctggtggcccctgcaggtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgagcccctctgcactcccccatggcctggctgctcccaggccctcgcccggctggggagagagatagggaacacagatgcagcacgtcctgcccttattggcccccggggccaggcggccatccatgaggagctactgagaagtgccctgggcctggcactcacctgggcctggagctgcctggacccagaatcttcatggcctgtttagggctcatccaaaggagagaggcctggtgaggtggaatcagggagactggtgacacccatagggatagacacaggggcggcctgagcccccaaggcgggccctgggggtgagggaggccaggctggggtctggggcccaaggtgtggaatgggggtgacaggacccagcttccttcctggtgcacacaggtgtttggccacgggaaggtgaatggtgaacccacatgggcactcctcctgacggcactcatcgccgagctgggcatcctcatcgcctccctcgacatggtggcccccatcttatccatgtgagctggggccgggcagggcagggggatggggaaaggcttcctgaaccccagcacctccccgtggctgcgtctggtgttggaggtccagctgggagatgtggcaggctgcatggggagatgtggcctgacagggctcagcccacccctgcatttaggagcaagcctggcacctatgccaaagctataaggtgaccaatatgtccacacctccctgaggcccccagagcaggtggccggcagaccttcccactggacagggcaaccaccgcgtccctcatgcctccatgaagccactgctgccccttccatctgttagtttgttttttggtttttgttttttttttttgagacagagtctcactctctcacccaggctggagtgcaatggcatgatcttggctcactgcaatctccgcctcctgggttcaagcaattctcctgcctcagcctcctgagtagctgggattacagaaatgcaccaccacgcccagctaattttttgtatttttagtagagatggcgttttaccatcttggccaggctggtgtcgaactcctgacgtcagatgatccacctggctcggcctcccaaagtgctgggattacaggcgtgagccaccatgcccaacccatccattttcaaagtcatttgcttttaacattctggaatcagccaggcaaatctgcgtgccagtgccttgcagggagtggccagcatgtggtgactcccagggaccccgaggcagcgcttgtttggttgactctgtccaggctggggtcctcgcccaccctgctccgtggctgacgctccttcttgcttgtgcggttatgaaaggcctcctcttccctgcccactcagcctgcagacttgacaggggccctgtacccctgagcaggctccatcccagctacagccaggcctgctggagccagcaccctcttgtccacccccccacaccccttcctctcacccaagagcacacctgaaactgttttgccacagccatcttgggtggtgaccccccttgtgcccaaatcagaggctacatctcagcctttatctcgggcctcctgctgggagcccctgccccctggcatgccctgtgtgggtcctcctgccttcctgcgcacccgtcctcgggtgccttcctggagggctcatgcagctggccctgcccatgcgtgggactcccacgcccaccgcagtgactcttaagtatctctgactggttgcattcaaatggtccagcttatcttccatcctccccttcatgcatggcagcctctcatccagctggtcactcaggccagaggcctgaatgtggcctagagtctccaggcactgagctcttcctgctgcccctgcaccaccctcttcagctctgccctgttactccccttcctacctcctccaacagcaaacccttgcccatcctctgcgatctggctccgaggactcctccacagtagtctcattgcctcaggccatggaggtggcagcaatgaggttgagaagaccttgctgagccatgcagggcagggccgggccacgccccgtttctgggccaggcccagcctgacatcaggtccccagctgccgaggaggctgctcttcgccaaccgccctctgtgccgcaggttctttctgatgtgctacctgttcgtgaacctcgcctgtgcggtgcagacactcctgaggacccccaactggcggccccggttcaagtactatcactggtgagccatgcctctgacacgggagaccctggggaggccaggagcctcattctgggtgaggcttgggtttcctgggtagggagctcttgaaacactgtggggagggagattatagggctgcgggggactggacctaggtcttacacccagtgacctgaccacccacctgggacctcccacccgggacctgacagggctaccagggcatgggccaggctgtggccaggggtcctcctggtcctgccctgactctgccctcccctctcgtccagggcgctgtccttcctgggcatgagtctctgcctggcccttatgtttgtctcctcctggtactatgccctggtggccatgctcatcgccggcatgatctacaaatacatcgagtaccaagggtgagtgagcactgccacctggcctctgccagctgagggggcccggccgagcaggcagggtggtctggcattggggtgggcagggagctgggccaccgtgggtgccaggactggggactgtaactcaggacccctgggtggtcttgaggggcagaacccctccacctcgcatccacatagacagaaccccctgggcggcaccaggggctcaccagctgtggtggaatctgcagggctgagaaggagtggggtgacgggatccgaggcctgtccctgagcgctgcccgctacgcgctgttgcggctggaggaggggcctcctcacaccaagaactggcggtgagttcccgccagaccctggccagggcgcagaggttcttaggggtcgctgtcggggtcagagggtcgagaggtgccggctccccatcctggggctgcccggggcaccctcctgggccatgctacccaaacctgcagggaccacgacccgagaagggaagaagaggaggggctccctagaacggccggccctggtctcaggctccccccacccggccactgcaggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcaggtacttgctttggggagggagagctgagccagactacaggggtctggactgcagctggcacggaggggagggcccagtcttggccagggtggccagccaggcagccagcactgctgccacctgagagctggcacaagggggagccagcagtcccatcttgaaaacttggcctctgggtaggcagcttgttgcccccaggccctcctccacccaaaagtcgttttgttcccgaggggccttgggagggagcccagaggcaggaagctgatggcctcccattggccctgggtgtgttccccacagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattggtgtgtgaaggcctggggcctggtgggcaggggtgaagtgaggtggcagtgggcggagggccacagactggtggtcagccgtgctcctcctccccagacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtagaccagggggtgggtgcagatgagaggggctaggcccttggaggagcagctgtgaccaaaccgcccacctggtcccttgcctcaggtctggaggaagtgccggatgcgcatcttcacagtggcccagatggatgacaacagcatccagatgaagaaggacctggctgtctttctgtaccatctgcgccttgaggccgaggtggaggtggtggagatggtgagccctctgccctgccctggccccgtggataccatgtcccgtgcagctgggtcctcacggccaaccctgtccccagcataacagtgacatctctgcatacacctacgagcggacgctgatgatggagcagcggtcgcagatgctgcggcagatgagactgaccaagactgagcgggagcgagaagtcagtgccctttgtggttcacgccagggcgggtggcagggtcaggcctttggagaccgcatcggtgggtgcggaggaatcagaatgactcaccgcagccctacccaagctagtgctcatttcccggaggcaaggtggtcacattgggccagacaggccccatcccccttttcctatgggaccaaggctatctcctgcaattgtcctcaggcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccgtgagtgcagcaaaaacagccccagcggcactggaatctaggggtggaggtggggtggggcagacaagtagtgttagatgggccaggggtggggaccctccttgcaggatggctcatggcgacctgtgactggctacactacgtgtagggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactgtatccctttgtggagaggcaggcagttgggaggtggatagcatgggaggtcaagccagcggcttctctcctgggcacccctgggtgggcatggcccaggtggcccgggttgcccgttgattctgttgttgcctccttgacttgaggccctgcagacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacgaagggaagggtagccagggagggagtccagcccagctgcctgcaggaagatctggctcagtctactatgggcagggccccccaccaagctgagccgaatggagacagctgagctgaggcctgactttttcaataaaacattgtgtagttctgggc

SEQ ID NO: 37222 - DNA, 24296 bp, Homo sapiens; identical to SEQ ID NO: 37221

SEQ ID NO: 37223 - DNA, 10898 bp, Homo sapiens
gttacacacaggcagtggtatctgtgagcagctctgtggactcaaaggttttctccctgagaggcatgacccaggccagctgattcatcagaatcaggtgagcgtgacctgctctcttccctccaggcggacttggggacagtggctacggtgcgggcggtgttggcctctgtggggcagctaccgaggagggtcatccctgagcactcaccaggcgcccgttctacactgcccgtgtagacgattggctctttcgtctccatggtggcttcgtagagtgggtgctgttcccaaatgtccccattcgacagatgagacgtctggggtcagagaggcagtaaccggcctgggaatccggacatgaccctgagttttgctctcagccctgccgtgtgctgtgctggaattcaggcctgaaccctgtgacctccctgccctagatcccaaatctgcccaggtttcccatcccgatggggcagagcctggtcctggcagagccactggtatagagccactggtacagatccactgacggtcctcagaacacctctgtgccctaagctgggtcctgatggtcgctgtgggccccactgaacacacatggtcccttgtccaggggagcctgctgcccttgggcagctgtggaaaatgaaggagccctggagggctggctgaggggagactatcttcccttgtgttcaaaggggtccgggcactagggttctccccaggtatttcttgctctgcgtggtcctcttgaggcctcgccctccttttgcctcgagtattcccaggagggacggtccatccagctgttctccaggaccaaggacccactgttcttcctcagtgacccaggaaaatgaagcctcctcctgttgggacggctcagaatggtggactccacagtccctccgcgagagacgtggtttccatgcgtacaatagatctttctcatcccccaaacccaacaccctcctgctcaacaggcgttattcctaaagtggcttcactgttcagactgaagagccacggtagccaaagtgatgagcggagtagaaccgagcagtcgggagagatcttgttccctgtaggaaactgggcatcgctgaggccctgagcatcccaggaggccgattgcacagagacctctggtcgctgaccccagtctgcctccacatccctggaatagcccatcatgggcccttcacccttggcaggtggaaaccattcaacctgctggggccggtgtgtccccatttcatggcattgggggacaacaggattctctgtctaggtcccactgtactcaagtccttgggaagatgcccacccctgcttgggacttgagactccagagactggagcagctgtgggccactgggtctggcccctttttccctgggggcggcggtggaatgggggttacgcagccagccagcatctgggagcccggcgagagcggttcaggtgttctccgaagccgccgcgtacagtgtgacctttagacaattctgtctcacaggatggacgtggtagaggtcgcgggcagttggtgggcacaagagcgagaggacatcattatgaaatacgaaaaggtacaagtcggtctgcttcttggagggaggcctcttccagtgtgccctggtcaaagggtcctgggctccctaggagcacagggcagggacgggtggccaatgcccccaggcccttgcaccctttaccttggacccctcaccaaggctccctctgggctacagggacaccgagctgggctgccagaggacaaggggcctaagccttttcgaagctacaacaacaacgtcgatcatttggggattgtacagtgagtcctctgcactcccctcacccctaaagcacctgtctcagctcagggatgggtttgcttttagaaaggcctttctgacgcaggacatgtctcaccaggtcgggtcaacctcctttccagggacagaactcctccctgactcccctgcaggtccagcccgaggttgttaggccagaggtgtggggcccatctagggagccggtgggaatggagactgggctaggtcaggcccctgggcgctcagcagttctgtcggcaagtgagcacaagaggagcggggcagcctgagggtctggccctgtctacttggagacaaccccggtgagatgcaagggttatggccacagggtgaggggacgcctggcccagcctcagggctgttgtccagcaggtctctgagggcccacctgcccctgttctcccccattcccctagagctacagccctcactgtcccgtgaggggaaaaggcatggtgacaatgggggctgtagccctaggagaacgggggagaagatgggcagggccccgttctgggcatctcacggtgaggccagggaggcagcagggctcgcggctaaagacctgggtctggtgctgggaagggatctggggccgggtaagaggagcccagccaggagcccatccctcagggatcacaggatggagagacagaggatccctggggaggtagggcgggagggagctgacgagccgtgccacttctgaaacgcagggtgtgtggctcgggtgcagggagaggcaggtggatgctgggaggtcagaacctgcaagggccttggggctgtcaagtggggtgggcccctggtgcagccagagtacaccgggcaggtctcagggcaggctcccttgaccctggcggggggatgtggtcactccctgagggactcctgtcagggcccggtcgcccaccctgggcggcccccatcccatctcagggctaacctttctcagctccagcagaaagcaccacctcgagtccaggacgggcagccccactgggcagcctgaccgccccccacgccaggggccccagtaaccccggccaggctgtccctacactccttcttctcccaggtcctgcccctcctgggagtcagccccacaggaaggcccttgtcctcccttccctgtgccttctcctgggctgagccctgagctggaaagggacagagccagtcctttctgggggtcggcacccaggctggggccgctccaggccccgtgcagttcctcagctctgcctgggttgccttacagtgagacggagctgcctcctctgactgcgcgggaggcgaaggtaagagcctgatgcgtggaggggctggtccagggacgtagggactgggcgggtggtcagtgaggcagaggaagcagctggcctgagcggtggcgggtgagggcaacacgctgtcactgggaggggcagcagtccctgctggacctgaccccaggttgctgttcactttggcagtttgataaaattccaaaaggagaaccacagtcctggcttgggggtggctgcgcgcttgtgtcaggaccccacctagaggctgggacctaagactggtgtgtctgtggcctgaggatggtacatcccggggtcccaaagccagcccactggtgctcatttgctcaaaggctctcagcccttgaggtctgcccttccctggctccttccagctggctcccaccagggctccagagcccaagacccagcatccgcgggcggctctgggaagcctggcagctccgctaactccaacatgcctcatttgacagcaaattcggcgggagatcagccgaaagagcaagtgggtggatatgctgggagactgggagaaatacaaaagcagcagaaaggtaacgtgtggagggaggaagcactctctgcagagacaggggacaggcacccatggctgtggcctggcaccatcagcctctcagagggtgggcggcacactgtcctcgcccagaggactgcaggcctggtcgccagatttcctgcctattcgtgcaagcgtcaccttgcagggagggaatctgaatctagggctgggactacccggagctcaaggctagggatgccctggtgacctgaaggaaggaaaaggttcagatcagagtttcgactctgagtgtccatccactctttcagtcctgggaagggagaccctgtcccagcttgatctcacctctactgaggaatcatggggccaaaaccgacaatttccagaatccccgggctctggtcctcactggggtcaccccgtggcctgtgacaccagatcgttttctgcccacagctcatagatcgagcgtacaagggaatgcccatgaacatccggggcccgatgtggtcagtcctcctgaacattgaggaaatgaagttgaaaaaccccggaagataccaggtacgctcagccagagcacaacaaacaggacaggccgtgtcggggcccaggtctccagctggagggaacgtcaagaccaccctggggagctgggggtgaaggtcagatgaacaccctgggcacagatggtgacacagtcaccacagacaaactcagctctggtgaccctccctggcttcagtaacaagccaaaatgcagctttctgcagaaggaaaccttccttctgtccttccttcccgaagtgctgactgtgggctgactgccactgggggcagggagtcttccatctgttctgagactgcttcctcctcttggccctgccctacagatcatgaaggagaagggcaagaggtcatctgagcacatccagcgcatcgaccgggacgtaagcgggacattaaggaagcatatattcttcagggatcgatacggaaccaagtaagcctacgggagccacagggtcccagcagagatggggtgaatgagagggatgggggcttccccggagcagaagccagggtcacccaggagggatgacacagctgccaagagctctcccggcccagggagcagccggcaccatgaaccgagcacctccctggttccaagccctgggccagactggaacatgtggggccagaacccaggaggatcctgaggagatggaaggcagcaaacaaaatcatgcacaatggtgaagggtgctctccctgacccatggggacccatggtaggacccacgggagggtggcaggatagagggcccatgagccccccccaggcaacagtgacagcaccaaatgctgggagaattaggggtcctggaaactctcatccaggtccgctgggaacatgacatggcacagccacgttggcagcccgttgggcagtggctcacaaagctcgatggacttgaaccacacatccccaaagtgtcacagatattgaacccactgatttgcaaactgacatccacatgaaaccagcatgccaggttcactgcttgactcctcgtcactcacacacggagccttcggggacggccttcaacacggggatggggagagcaaggctggtcctcccttcaaacggaagacccagtgagaaaagggaacgagccggtgatgcccgcacgaacgtgggtggatcctagatgcattttgctgagggacagaagccagacccaataagctaccacagtaggattcccattcctaggccattctggaaaaggccaaaccacagggactgagaagcagtctgggtggccaggggctgacggatcggggagaggctgggtgcataggggccaccctggagacttggaggatgaaggagtcgccccaggaggggctggagcggtggccgggagactctgcacattggtttggaaccgtggaggaactgtacacccacagactgaactggcgtgtgtgcaaactgaaaaaaaaaaaaaaaaatcattcagagtgaaaaggatcaggcaagtcactgtacaactgggctatttgcatgtcacagatgtggattttactgaaacatttcttcaagagtctcaggccctgaagagctcactgcttatctggtgaaacatctgaacctgaaatgggatttgctgttaggctttgtagacaaagtgaaattaacaacatctgcacaaaacaaaccaaagccccctttctctgtttcctaggcagcgggaactactccacatcctcctggcatatgaggagtacaacccggtgagtattcccggcagtgaggttcccgggccatatttccatattgacaggagtgggtgtctggtgggggtgtcgttgcttcttttaaagttagtatttgtgacccaccaggatataggaggtaggatgtcagctcaccgctggcataaacctccaaggaagggggtggtctcaaggggtcaagctgagacacagaggagtcagggcctggactcctggtgtcacctgggcctgaccaccacttctcagaacaagaaatgacgccctcctcctggggctgccccaaagcccaggagcttggcagcatcgcacacaggatggtgctatcagcagacattttggacaaggtgctgaagtgcctgatggacttggctcttgtcatgaaatgaatgtgcatcctgaggaagcctctttttcagaggaagcctctccttcagaggaagcctctccagtcacctctgccctctccaatgacatgagtcctcccaggtgacctcagccctcccaggtgatgtccttccatggtgactctggctcttgcaggaggtgggctactgcagggacctgagccacatcgccgccttgttcctcctctatcttcctgaggaggatgcattctgggcactggtgcagctgctggccagtgagaggcactccctgcagggtaagtgaacagctgccccggggacctcctgcagccagacctggggatggccaccctggccaggtgatcacagctttcagccaaggcaccctccttgtgtcgccagcttgttgggagactttaggatgtctctgctgagggtcccacaggagtccacggctgacccccaaagcccaaatcagacgcctctcatccccatcagcagagggcatctcatcctccccgtggccaccctctgtgtcctggagccacgccctccggctctgattctgtgcagctgactctcccctccctgagagtcctcctgccctccagctgcccgggctcctgctgccatcggtgcccacgaatgggccgaccaagcccaggtggcagcatctccccatcccctgttccctggcccgaccccactaccaggagatgaccgggaagcccagcgcccacccagttccggccaccctgtcgtggcctgaaagtcaggcttgccctttttgcaccctggcccaggaggcctccaggggaacctccagccaggctccagggaatgttcccgccccacctccccagggtaaaggccgcatgttggggtcaccagatgggagggtgggaggccttggggtttgggggcctctccagctgcccagctcttgcagctgatggctccacatcttgggggaaggctctgatttcatgatgggctgggggcttctcaggatttcacagcccaaatggcgggaccgtccaggggctccaagaccaacaggagcatgtggtagccacgtcacaacccaagaccatggggcatcaggtgagtttatggtcccctcagctcttcccagaggccctgcctcccgtggggctgtaggagcaggggggctggagcccctcgtggggctggtgactggctgagtcccagccagggcctgacctgggacgtcgggttctccatgggctgggagttggtttcctttcctgccctggaggagacagaggcacagggatgggggcccagctcccgcagagcagggcaaagggcagtgtgtccaccgggagtgtgggaaggtgacagtgttgtggggagctctggacaccgcccagtgttctgcactaggggaagggtcttcagaggccctggaagagggaggtttttagggcagcccagtggcctgagcacctctgttgcttccatcaggacaagaaagatctatgtgggcagtgttccccgttaggctgcctcatccggatattgattgacggggtaaggaggcatagggagaccctggctcagggaccttccttgccctgcagtgccctgcttccccagcccgggggtctggctcactcccagcccacaggaggctcaggcgggtccccaaaggacacacaagcaaaaccctctgcccaaggggggtcatcccagggccatggctggggctcaggcccagcctcatgggcagactgggccaggacccgacttgagagggctcagggaagcctcaagccctgggcaagcccctctctccaggagccacatccccactcaaatgagtgccccccatgaggagcttcaagaccttgtctgacccagcgtcctggagggctcaggcgaccctcatggggaaggtcactgactctggagactgaagccccagtgtgcgcagctcgagccaccagccccagcctggaaggaccaggttctttcacacctgctgtccccacagatctctctcgggctcaccctgcgcctgtgggacgtgtatctggtagaaggcgaacaggcgttgatgccgataacaagaatcgcctttaaggttcagcagagtaagtctacgtgtgcccagcggggcctggggagccctggggtcagaccccgactggcccgagggcagcttcctcacactgtcctcatgatcctctgttctggcccagagggaggtctggccaggtgggctgggcaggacactgtgacaccgagcccatcccccacatgacccagatgaaagtcgagagtgtggtgagcacttccctgtccggatcgccccccagccacagtctcctgtgtatatctggacacctggggtggccacaaaaggatccggcaccgcccagtaggagactgaagtggccacggggtatgagctgtgaccattcccaggtaactcccctggcctgatatccaccctgtccctagagcgcctcacgaagacgtccaggtgtggcccgtgggcacgtttttgcaaccggttcgttgatacctgggccagggatgaggacactgtgctcaagcatcttagggcctctatgaagaaactaacaagaaagaagggggacctgccacccccaggtgggctccagtgccatgtcccctcccatgtcaccctctggggtagtcagtagtaggggagtgcccgggacccgcaaccctactacctgggccttcctcttcaccttttcttcctcctcttcctcctggactctaagaaagtacaggaggcccaccggtcctcagggcaggcgctcagtgcgtgtatactggacatgctgtgcacgcaggagggggatgtgggcaagaccctccaacaagccccctcccactttccacggtgtctccctctccccctcgcagggccctccaagttactagacgagcccagacccatttgtgggagaccccgcccctccctgcaagcacccacagcctcagagagcagcagaggcccctcactcctgcacgctcctccaaggttgccaggacaagaagcctggagccagggagacaagggaatccgtgtccctgacccacagagcattcagggagagggcacaggcgggaccccgggcccagagccagagccaagagttcagccagaagtgggaacggtcagtcctggcatggactgggcagcccaggagggcagagggtgacccacgtccgggcccaatcacccactgcggagacgggtccccacgtgaggtgacaaggggctgggtgacatccaaggcccctcccacctgagttctgactgggggccgtatcccaggcccaacagccctgggacgaaggtgtgtggcaggaagcccccagccagtctgaaccctgggggcagtcccaggagccacccgccatgccacgacagcttccccacgccaggcagcacgcacccctccctctgggatcagcagactacaggcgtgtcctcggtgtcaggccacgggggccacacagagaccccgaggactccagagacgcaggcaggtggggcccagcccggaaaggcctgcgtgggctcactggagatgctgaccgcgtctgttttcctttcagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccggcccctcccagcacccccagccccacgaccatcgttctgaattctgacgacaccgtgagcctgcctttgtacttcaaactcatggaaggataaccaccttcatgttttgaaataaatgtttcctgttgaaatg

SEQ ID NO: 37224 - DNA, 190317 bp, Homo sapiens
  misc_feature (73167)..(173166): n is a, c, g, or t
gttacacacaggcagtggtatctgtgagcagctctgtggactcaaaggttttctccctgagaggcatgacccaggccagctgattcatcagaatcaggtgagcgtgacctgctctcttccctccaggcggacttgggggcagtggctacggtgcgggcggtgttggcctctgtggggcagctaccgaggagggtcatccctgagcactcaccaggcgcccgttctacactgcccgtgtagacgattggctctttcgtctccatggtggcttcgtagagtgggtgctgttcccaaatgtccccattcgacagatgagacgtctggggtcagagaggcagtaaccggcctgggaatccggacatgaccctgagttttgctctcagccctgccgtgtgctgtgctggaattcaggcctgaaccctgtgacctccctgccctagatcccaaatctgcccaggtttcccatcccgatggggcagagcctggtcctggcagagccactggtatagagccactggtacagatccactgacggtcctcagaacacctctgtgccctaagctgggtcctgatggtcgctgtgggccccactgaacacacatggtcccttgtccggggcagctgtggaaaatgaaggagccctggagggctggctgaggggagactatcttcccttgtgttcaaaggggtccgggcactagggttctccccaggtatttcttgctctgcgtggtcctcttgaggcctcgccctccttttgcctcgagtattcccaggagggacggtccatccagctgttctccaggaccaaggacccactgttcttcctcagtgacccaggaaaatgaagcctcctcctgttgggacggctcagaatggtggactccacagtccctccgcgagagacgtggtttccatgcgtacaatagatctttctcatcccccaaacccaacaccctcctgctcaacaggcgttattcctaaagtggcttcactgttcagactgaagagccacggtagccaaagtgatgagcggagtagaaccgagcagtcgggagagatcttgttccctgtaggaaactgggcatcgctgaggccctgagcatcccaggaggccgattgcacagagacctctggtcgctgaccccagtctgcctccacatccctggaatagcccatcatgggcccttcacccttggcaggtggaaaccattcaacctgctggggccggtgtgtccccatttcatggcattgggggacaacaggattctctgtctaggtcccactgtactcaagtccttgggaagatgcccacccctgcttgggacttgagactccagagactggagcagctgtgggccactgggtctggcccctttttccctgggggcggcggtggaatgggggttacgcagccagccagcatctgggagcccggcgagagcggttcaggtgttctccgaagccgccgcgtacggtgtgacctttagacaattctgtctcacaggatggacgtggtagaggtcgcgggcagttggtgggcacaagagcgagaggacatcattatgaaatacgaaaaggtacaagtcggtctgcttcttggagggaggcctcttccagtgtgccctggtcaaagggtcctgggctccctaggagcacagggcagggacgggtggccaatgcccccaggcccttgcaccctttaccttggacccctcaccaaggctccctctgggctacagggacaccgagctgggctgccagaggacaaggggcctaagccttttcgaagctacaacaacaacgtcgatcatttggggattgtacagtgagtcctctgcactcccctcacccctaaagcacctgtctcagctcagggatgggtttgcttttagaaaggcctttctgacgcaggacatgtctcaccaggtcgggtcaacctcctttccagggacagaactcctccctgactcccctgcaggtccagcccgaggttgttaggccagaggtgtggggcccatctagggagccggtgggaatggagactgggctaggtcaggcccctgggcgctcagcagttctgtcggcaagtgagcacaagaggagcggggcagcctgagggtctggccctgtctacttggagacaaccccggtgagatgcaagggttatggccacagggtgaggggacgcctggcccagcctcagggctgttgtccagcaggtctctgagggcccacctgcccctgttctcccccattcccctagagctacagccctcactgtcccgtgaggggaaaaggcatggtgacaatgggggctgtagccctaggagaacgggggagaagatgggcagggccccgttctgggcatctcacggtgaggccagggaggcagcagggctcgcggctaaagacctgggtctggtgctgggaagggatctggggccgggtaagaggagcccagccaggagcccatccctcagggatcacaggatggagagacagaggatccctggggaggtagggcgggagggagctgacgagccgtgccacttctgaaacgcagggtgtgtggctcgggtgcagggagaggcaggtggatgctgggaggtcagaacctgcaagggccttggggctgtcaagtggggtgggcccctggtgcagccagagtacaccgggcaggtctcagggcaggctcccttgaccctggcggggggatgtggtcactccctgagggactcctgtcagggcccggtcgcccaccctgggcggcccccatcccatctcagggctaacctttctcagctccagcagaaagcaccacctcgagtccaggacgggcagccccattgggcagcctgaccgccccccacgccaggggccccagtaaccccggccaggctgtccctacactccttcttctcccaggtcctgcccctcctgggagtcagccccacaggaaggcccttgtcctcccttccctgtgccttctcctgggctgagccctgagctggaaagggacagagccagtcctttctgggggtcggcacccaggctggggccgctccaggccccgtgcagttcctcagctctgcctgggttgccttacagtgagacggagctgcctcctctgactgcgcgggaggcgaaggtaagagcctgatgcgtggaggggctggtccagggacgtagggactgggcgggtggtcagtgaggcagaggaagcagctggcctgagcggtggcgggtgagggcaacacgctgtcactgggaggggcagcagtccctgctggacctgaccccaggttgctgttcactttggcagtttgataaaattccaaaaggagaaccacagtcctggcttgggggtggctgcgcgcttgtgtcaggaccccacctagaggctgggacctaagactggtgtgtctgtggcctgaggatggtacatcccggggtcccaaagccagcccactggtgctcatttgctcaaaggctctcagcccttgaggtctgcccttccctggctccttccagctggctcccaccagggctccagagcccaagacccagcatccgcgggcggctctgggaagcctggcagctccgctaactccaacatgcctcatttgacagcaaattcggcgggagatcagccgaaagagcaagtgggtggatatgctgggagactgggagaaatacaaaagcagcagaaaggtaacgtgtggagggaggaagcactctctgcagagacaggggacaggcacccatggctgtggcctggcaccatcagcctctcagagggtgggcggcacactgtcctcgcccagaggactgcaggcctggtcgccagatttcctgcctattcgtgcaagcgtcaccttgcagggagggaatctgaatctagggctgggactacccggagctcaaggctagggatgccctggggacctgaaggaaggaaaaggttcagatcagagtttcgactctgagtgtccatccactctttcagtcctgggaagggagaccctgtcccagcttgatctcacctctactgaggaatcatggggccaaaaccgacaatttccagaatccccgggctctggtcctcactggggtcaccccgtggcctgtgacaccagatcgttttctgcccacagctcatagatcgagcgtacaagggaatgcccatgaacatccggggcccgatgtggtcagtcctcctgaacactgaggaaatgaagttgaaaaaccccggaagataccaggtacgctcagccagagcacaacaaacaggacaggccgtgtcggggcccaggtctccagctggagggaacgtcaagaccaccctggggagctgggggtgaaggtcagatgaacaccctgggcacagatggtgacacagtcaccacagacaaactcagctctggtgaccctccctggcttcagtaacaagccaaaatgcagctttctgcagaaggaaaccttccttctgtccttccttcccgaagtgctgactgtgggctgactgccactgggggcagggagtcttccatctgttctgagactgcttcctcctcttggccctgccctacagatcatgaaggagaagggcaagaggtcatctgagcacatccagcgcatcgaccgggacgtaagcgggacattaaggaagcatatattcttcagggatcgatacggaaccaagtaagcctacgggagccacagggtcccagcagagatggggtgaatgagagggatgggggcttccccggagcagaagccagggtcacccaggagggatgacacagctgccaagagctctcccggcccagggagcagccggcaccatgaaccgagcacctccctggttccaagccctgggccagactggaacatgtggggccagaacccaggaggatcctgaggagatggaaggcagcaaacaaaatcatgcacaatggtgaagggtgctctccctgacccatggggacccatggtaggacccacgggagggtggcaggatagagggcccatgagcccccgccaggcaacagtgacagcaccaaatgctgggagaattaggggtcctggaaactctcatccaggtccgctgggaacatgacatggcacagccacgttggcagcccgttgggcagtggctcacaaagctcgatggacttgaaccacacatccccaaagtgtcacagatattgaacccactgatttgcaaactgacatccacatgaaaccagcatgccaggttcactgcttgactcctcgtcactcacacacggagccttcggggacggccttcaacacggggatggggagagcaaggctggtcctcccttcaaacggaagacccagtgagaaaagggaacgagccggtgatgcccgcacgaacgtgggtggatcctagatgcattttgctgagggacagaagccagacccaataagctaccacagtaggattcccattcctaggccattctggaaaaggccaaaccacagggactgagaagcagtctgggtggccaggggctgacggatcggggagaggctgggtgcataggggccaccctggagacttggaggatgaaggagtcgccccaggaggggctggagcggtggccgggagactctgcacatcggtttggaaccgtggaggaactgtacacccacagactgaactggcgtgtgtgcaaactgaaaaaaaaaaaaaaaatcattcagagtgaaaaggatcaggcaagtcactgtacaactgggctatttgcatgtcacagatgtggattttactgaaacatttcttcaagagtctcaggccctgaagagctcactgcttatctggtgaaacatctgaacctgaaatgggatttgctgttaggctttgtagacaaagtgaaattaacaacatctgcacaaaacaaaccaaagccccctttctctgtttcctaggcagcgggaactactccacatcctcctggcatatgaggagtacaacccggtgagtattcccggcagtgaggttcccgggccatatttccatattgacaggagtgggtgtctggtgggggtgtcgttgcttcttttaaagttagtatttgtgacccaccaggatataggaggtaggatgtcagctcaccgctggcataaacctccaaggaagggggtggtctcaaggggtcaagctgagacacaaaggagtcagggcctggactcctggtgtcacctgggcctgaccaccacttctcagaacaagaaatgacgccctcctcctggggctgccccaaagcccaggagcttggcagcatcgcacacaggatggtgctatcagcagacattttggacaaggtgctgaagtgcctgatggacttggctcttgtcatgaaatgaatgtgcatcctgaggaagcctctttttcagaggaagcctctccttcagaggaagcctctccagtcacctctgccctctccaatgacatgagtcctcccaggtgacctcagccctcccaggtgatgtccttccatggtgactctggctcttgcaggaggtgggctactgcagggacctgagccacatcgccgccttgttcctcctctatcttcctgaggaggatgcattctgggcactggtgcagctgctggccagtgagaggcactccctgcagggtaagtgaacagctgccccggggacctcctgcagccagacctggggatggccaccctggccaggtgatcacagctttcagccaaggcaccctccttgtgtcgccagcttgttgggagactttaggatgtctctgctgagggtcccacaggagtccacggctgacccccaaagcccaaatcagacgcctgtcatccccatcagcagagggcatctcatcctccccgtggccaccctctgtgtcctggagccacgccctccggctctgattctgtgcagctgactctcccctccctgagagtcctcctgccctccagctgcccgggctcctgctgccatcggtgcccacgaacgggccgaccaagcccaggtggcagcatctccccatcccctgttccctggcccgaccccactaccaggagatgaccgggaagcccagcgcccacccagttccggccaccctgtcgtggcctgaaagtcaggcttgccctttttgcaccctggcccaggaggcctccaggggaacctccagccaggctccagggaatgttcccgccccacctccccagggtaaaggccgcatgttggggtcaccagatgggagggtgggaggccttggggtttgggggcctctccagctgcccagctcttgcagctgatggctccacatcttgggggaaggctctgatttcatgatgggctgggggcttctcaggatttcacagcccaaatggcgggaccgtccaggggctccaagaccaacaggagcatgtggtagccacgtcacaacccaagaccatggggcatcaggtgagtttatggtcccctcagctcttcccagaggccctgcctcccgtggggctgtaggagcaggggggctggagcccctcgtggggctggtgactggctgagtcccagccagggcctgacctgggacgtcgggttctccatgggctgggagttggtttcctttcctgccctggaggagacagaggcacagggatgggggcccagctcccgcagagcagggcaaagggcagtgtgtccaccgggagtgtgggaaggtgacagtgttgtggggagctctggacaccgcccagtgttctgcactaggggaagggtcttcagaggccctggaagagggaggtttttagggcagcccagtggcctgagcacctctgttgcttccatcaggacaagaaagatctatgtgggcagtgttccccgttaggctgcctcatccggatattgattgacggggtaaggaggcatagggagaccctggctcagggaccttccttgccctgcagtgccctgcttccccagcccgggggtctggctcactcccagcccacaggaggctcaggcgggtccccaaaggacacacaagcaaaaccctctgcccaaggggggtcatcccagggccatggctggggctcaggcccagcctcatgggcagactgggccaggacccgacttgagagggctcagggaagcctcaagccctgggcaagcccctctctccaggagccacatccccactcaaatgagtgccccccatgaggagcttcaagaccttgtctgacccagcgtcctggagggctcaggcgaccctcatggggaaggtcactgactctggagactgaagccccagtgtgcgcagctcgagccaccagccccagcctggaaggaccaggttctttcacacctgctgtccccacagatctctctcgggctcaccctgcgcctgtgggacgtgtatctggtagaaggcgaacaggcgttgatgccgataacaagaatcgcctttaaggttcagcagagtaagtctacgtgtgcccagcggggcctggggagccctggggtcagaccccgactggcccgagggcagcttcctcacactgtcctcatgatcctctgttctggcccagagggaggtctggccaggtgggctgggcaggacactgtgacaccgagcccatcccccacatgacccagatgaaagtcgagagtgtggtgagcacttccctgtccggatcgccccccagccacagtctcctgtgtatatctggacacctggggtggccacaaaaggatccggcaccgcccagtaggagactgaagtggccacggggtatgagctgtgaccattcccaggtaactcccctggcctgatatccaccctgtccctagagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccaggtgggctccggtgccatgtcccctcccatgtcaccctctggggtagtcagtagtaggggagtgcccgggacccgcaaccctactacctgggccttcctcttcaccttttcttcctcctcttcctcctggactctaagaaagtacaggaggcccaccggtcctcagggcaggcgctcagtgcgtgtatactagacatgctgtgcacgcaggagggggatgtgggcaagaccctccaacaagccccctcccactttccacggtgtctccctctccccctcgcagggccctccaagttactagacgagcccagacccatttgtgggagaccccgcccctccctgcaagcacccacagcctcagagagcagcagaggcccctcactcctgcacgctcctccaaggttgccaggacaagaagcctggagccagggagacaagggaatccgtgtccctgacccacagagcattcagggagagggcacaggcgggaccccgggcccagagccagagccaagagttcagccagaagtgggaacggtcagtcctggcatggactgggcagcccaggagggcagagggtgacccacgtccgggcccaatcacccactgcggagacgggtccccacgtgaggtgacaaggggctgggtgacatccaaggcccctcccacctgagttctgactgggggccgtatcccaggcccaacagccctgggacgaaggtgtgtggcaggaagcccccagccagtctgaaccctgggggcagtcccaggagccacccgccatgccacgacagcttccccacgccaggcagcatgcacccctccctctgggatcagcagactacaggcgtgtcctcggtgtcaggccacgggggccacacagagaccccgaggactccagagacgcaggcaggtggggcccagcccggaaaggcctgcgtgggctcactggagatgctgaccgcgtctgttttcctttcagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccggcccctcccagcacccccagccccacgaccatcgttctgaattctgacgacaccgtgagcctgcctttgtacttcaaactcatggaaggataaccaccttcatgttttgaaataaatgtttcctgttgaaatgattttagattttagacagaaatattgaaaaggcactatagtatcctcctataccttccatccagctgcccctaataatgatgttttgcagtcccatggcacataagaaatttaggccgggtgtggtggctcacacctgtaatcccagcaatttgagaggtcgaggcgggaggttcaggttcacttgagtctagaagtctgagaccagcctgggaaacctaggtggacccggtctctagagaaaagtcaaagaaattagccaggcatggtggcgtgtgcctatagtcccacctagtcaggaggctgaggcaggaggattgctggagcccacgagttccaggaagcagtgagccatgattgcaccactgcactccagcctgggtgacagagtgagactttatctcttaaaaaaatttaagaaatttaatgtgggtacagttctattaactaaataataatgtgaactattatctaaggttatgaaggctagaattatcccatttttgcctaacttctcgtacctgtcccaagatcccaccttggactcaccctctgccttcagctcacgtctcttcagcttcctccacatggtccagcaaacacacacctgggctgaatggtagagctgattgctcatacacaaaggtagaccggtgggcagggattttcagacttacacagtcaatgagttttccttggtgttctggagagcaccgtttgagaaacactttgacagtgaatctaggcctcaagatccatcagctgctctagcttgaattttgctcaagctcagtgaacacctgctctgccgggtgcacgtgaaaggggcaaggatgagaaagctgtagataaagaagacaggacgcagggggtctgtctaagctctatcccctgccttcagcactgagggatgaaatccaactcttagggaacggtggccacgtgctgggccagccccaggctctcaggatctgacagtgggtgacgcagagccaggccttgcccctggggagctctccagcatacacctccctctcccctcccagcgtgccgcaaagcaggcgtcaacgccattgttaatgcacggaggaggaacctgactgttagacctgggttttccagggttgcacggcttctgggagacggatgtgaccctgaggacagggcacaggccagtgtaatgccaggatggaatgagctgtgatctgtgctgtatagaggcctaggccaaggtgggactgacggatgaccaggtcagccgggtcactgaaaacactcttgggtcctcacctgccggttcccaggagtccggaactgccaggagagtggtggcaggtcccccatcctcagctgggtgggcctggatagaacagcaaggcgagggcacatttccctggccattccctccaggcacagctgtgacctgttcattccaaatttgtggaagtatttccacacacacagaactgcaaatagcagtggacatggtgagaggcgtttgcacatgggataggcaggattttggaggcagagcctccagggcttgccgatgggttagctgcagggcttgagagggaacggagaatccaggatgatgtgttcaaatcggtccattcacctcttccgttccacgcctgtgctgggcactgggagagacagatgcacacaggagccccggccgaggggaggtgtggggggaagcccagagtgtctgggcagggtaggaaacccagagcgtctactgggagctgaaggcttaggtccacctgggtgccgtccaggttctctgcatgtagaagtataggctgagcttcccggaggaggagcagctgctgttgctggtgaccagcacattcaggaacggagactactctgtcaacagacagggggatgacctgaggtctggatggtctagggggtggtagggcccaggaggacccaggaaagggtctcggggatgcagaacatcctatggagggcatttgggagtcagtgctcaggccactccgggtcactcaggtcatttgccggcccctgtcataattattgccatatgagagtgccacccgtcctatgacatattttatatatttctgtgaatggcctacttgtttgtatttatgaatttatgtttaaaggatgggcaggggtgctcgagaggtccccaggagtttccctctggggagagaggggcccaccccttcccagcagccctctgagccccccgatcgcttggccacagcctctgcctggagaaagcatccccctcggagatatatggacatcagaagaaacctttctctgtcaccaggacaaatcctgttcttatttgaaccaaggccagttttcctaatgaatgcagggaggacagcacagatcaatgaaaccagcagataatccacaagactgtttcccagagctgggagatttccttccctgccaacacttttcctgaaaggtcttaagaatgaggcaaacagtttaagtctctcttgcactgttcttttagtgaaagagttcaatgaggaaggagaggaagtggagcatatgcttagtttccaagctggaaaagtggcccatggttaaccaagactagatgtaaaagcacaggtggccgcgggtccaggtgagtcggtcctacgatggcacggctgctaatgccagcagatgctcctgtcctctcctttcaagactgacttcttctggtctttcattcgttaaaataaaattgacagggcatcatccaagaagctctacactttcccttacttggatttcagactctagattctgctgagatttgagcttcatggtgaacacattcttgttgtgcttgctgctgaggggtgtggaggacagagagatggtgaaatggcaaagtggctcttgagcatgggtgggggaagcccccacatatctgagtcagtgccacctggacactacccttggagcatcctgctgaggtggccattcaggttttctttcctttccttttattccactgtttctgaatcacaaataaagatccaaggcaaacagcacattcagatccccaagctctccacctccaatgtgaccagggacgtgcaccacttcaggctcatgcaggacccacagcctttggacctcagctaagggacctgcttctcttcagcacacggggcttgtttgtgttggggtctgagccctgagcgcatggtcaaggagacccccaggtctttctgaacagagacagctggcctggcggcctccctctcactgcatgcaagagtctgttagggcggctgtcttgcttctgtgtgttgggaaattcaatttaggtacctaaaaatgaaaagtcccaggacatctccatggcttgggatccacaggagagcatcattgatgctggggacaatttaaacatatagaaacccacagggctaccttagacagggcacagggcacagcacccggggatgcagagtggaaagttcaccactacagcctggaattgcctctgtgatgccttcttcatgacacttggctgccttcgtggctggaaggctgaggcccagatcccaacatggccacaggctagcagcttgcttcaccttcctgaactgcaatttctccatctgagcctctctcctaagaggagtgtgcagggtcacttagcccatatgggccagaaaccccacacggtgccaggcacacagtagggcctcggcagatgctgcccccttctgtctccaccaccctcctggggctccctcctgaaacagcctccctcagcgccttgagtcttgcaccctaacagcctcttgcacgcagtgagagggaggcccccaggccagctgtctctgttcagaaagacctgggggtctccttgaccatgggctcagggctcagaccccaacacaaacaagccccgtgtgctgaagagaagcaagtcctttagctgaggtccaaaggctgtgagtcctgcatgagcctgaagtggtgcaggtgcctggtcacactggaggtgtagagcttggggatctgaatgtgctgtttgcctcggacatcaaacatctcacagactgcctggaagaaggtggagcagactggggttaatggtcagcagcagcagcatccccaccactggggctatccctttttaggcccttaccatgggccaaacactgagccgtgtgcttcgtgtaacttctaagcacgcttacctgatagggtgccagcaaagactcgaagaggtgcctgggcttggcacatagtagctattgctactattatgaatgttgttttgtctttgtttttgttttgagacagggcctcactctgttgcccaggttggagtacagcagtgccatcatagctcactgaagcctcaacctccctgggtttgagcaatcctcccacctcagcctcccaagtagctgagactacaggtgtgcgccaccaagcccagccaattttttgtattttcagtagagactggttttgccaagtcgcccaggctggtttcgaactctggggttcaagcaatctgcccacctcagcctcccaaagtgctggcattacaggcgtgtgccactgcgcccagccattatgaatgtcaatattgacatgatcttgtatccttatgcccacactgggagaggtctgattgtccccatgttcctggtgtggaaccacatggaagaggcctatgttatcccaacagtgcagaagcacagcctgagtctcttctttggctgagccaagggcgtgctggagaggcctgacagaagaaggagcggcccttgtgaccagtgcccttttggttcacaaggaacttctcctcttgttgaagtgacttggctgagcttgctacttctgctttgagagtcaaatatcaggatcaagactttaattatccccaatttacagatgatgaaaccatattgggcaggaaagaaagtcaccccaggagagcaagttggacctgagcactggctgaggacaaaggggaatgataatttgggatgtaacttgttaaggggtctcacaagtgttcttgtgatccaggtgtcgagaggatacagcagaaaggttgccagggagatgagggtagggtacaccacaagagtgggagaaattaaagagaacacgcaacaaagccttgggacactgggagggggatggaccacccagttttgtgctatgggagaagagagcaagaaaaggaatctgtgttaaatcccgacagcctgcatgagaagcaaatgcccttcattttcttcatcagcggcgagactggcatccctgcagctttgggagaccatgctagtgtagatgccagctcacgccagcgggcctgactgggagaccttgggctggggttctggtctggggctcctaggcctgatgggaggagagttcagccccaggtttcctgtacttcagctcatatccacacaatggtaattattgaaatgagagactcaaaagaagatggaacgtgaacttttttgttgtcccatgtggacacctgtgttcggtttccagttctacctttgctgtctgtgtgttcttaagtaactcacttaaacctttctgagtctcattttcttcatttataaaataaaagacgtaacatttatgtcagatattgtcctgaggattaaatgggagaatgaacaagcctcttctgcattcccctggcatccagtgggtggaggccagagaagctgctaaacatcctgccaggtgcaggacagcccccatcacaaagaattgaccggatcctgatgtcagtaaggcagaattgaggatccttggtgtgggggaaaaagaataaactcagaagcttggcagatctcagttcaaaccctggttgtatcacctctagctgagtgaccttaggcaggtctgtgaactctctgagactcggcctcctcatcggtagaatgaggtagataaaaatgccaagctcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgtgccactgcagtccgcagtccggcctgggcgacagagcgagactccgtctcaaaaaaaaaaaaaaaaaaaaaaaaaaggtcttaattttaaaaaataggccaggcgtgatggctcatgcctgtaattccagcactctgggaggccaagtcaggcggatgacatgaggtcagaagttcaaaaccagcctggcgaacgtggcgaaaccctgtcactactaaaaatacaaaaattaggcctggcactgtggctcatacctgtaatcccagcactttgggaagccaaggcagatggatcacaaggtcaagagatcgagaccatcctggccaacatggtgaaaccccatctctaaaaaaaaatacaaaaattagctgggtgtggtggcacatggctgtagtcccagctactcgggaggctgaggcagaagaatcacttgaacttgggaggtggaggttgcagtgagctgagatcccaacactgcactctagcctgacgacagagcaagactccgtctcaaaaaaaaaaatttagccaggagtggtggcaggcacctgtaatcctagctactcaggaggctgagccacgagaatcacttgaatccgggaggcggaggttgcagtgagtcgagatcacgccactgcactccagtctgggcgacagagagagactctgtcaaaaaaaaaaaaaactcaaaattcatttttatataatttcgatgacaccataatcctattcttttggacagcagttaagcaataagaatcaagaaaaaaaatctgatttaattgcttcacttttagagagccaaagcaaataatataagatatagcatgtataaattacctttgtgtcttttatatcatttatatactttatcttcaagacatgaaaatgtatgcacaaagatattttatataaccatttataaccatacaacttttataaaagtctggccggctgcagtggctctcacttgtaatcccagcactttgggaggccgaggcaggtggatcacttgaggttaggtgttcaagaccagcctaggcaacatggtgaaacccatctctacttaaaaatacaaaaaattagctggacatggtggcgtgagactatagtccagctattagggaggctgaggtcggaggatcacttcagcccagggggtcgaggctacagtgagctgaggtcacaccacagaactccagcctgggtgacagagtaagatctcatctcaaaaaaaaaaaaaaaaaaaaagatctggccgggagtagtggctcacgcctgtaatcccagcactttgggaggccaaggcaggcagatcacaaggtcaggagatcgagaccatcctgaccaacatggtgaaaccccatctctactaaaaatacaaaaaagtagccggatgtggtggcacaagcctgtagtcccagctactcgggaggctgaggcaggaggatggtgtgaacccgggaggcggaggttgcagtgagccgagatcgcaccactgcactccagcctgggtgacagcgggagactccgtctcaaaaaaaaaaaaataataaaataaaaattcactgaacattaaaagaaaatacacaaaatacgctgggcacagtggctcacgcttgtaattctagcactttgggaagccaaggcaggcagatcatgaggtcgggaattcgagaccagcctcaccaacatagtgaaaccccatctctactaaaaatacaaaaaaaaataagccaggcttggtgtgcgcctgtaatcccagctactggggaggctgaggcaggataatcgcgtgaagccaggaggcggaggtttcagtgagccaagatggcgccattgcattccagcccaggccacactgcaagactccgtctcaaaaaaaaaaaaaaaaaaaccacaaaatatattaataggactgtggtaaggatggtaagattatgagtgatttctttcctctattgcaaactataccatttcctttataatgtgaagtgtttttttgttttgttttgttttgagatggagtctcactctgtcacctaggctggagtgcagtggctcaatctcggctcactgcaacatacacttcccgggttcaagcgactctcctgcctcagcctcctgagtagctggggttacaggtgcacaccaccgcgcccgactgatttttgcagttttagtagagatggggtttcactgtgttagtcaggctagtctcgaactcctgacctcgtgatctgcccgcctcagcctcccaaagtgctgggattacaggcgtgagacaccgcgcctggtctataatgtgaaattttatagaaaaatgtcgctaaatgctaatcaagtctgcccaccaaagataaacctataataaaacagggtgtctcagcaacaacaacaacaacaaaaaaaaaaaaaaaaaaaaaagaaaccataagccaagcatggtagcaccaatctgcagtcccaaatactcagaagggtgaggcaggagaatcacttgtgcctgggagtttgaggctgcagtaatataatcgcaccactgcactccagcctgggcaaaagagcaagactcggtctcaaattaaaaaaaaaaaaagatagaattttttaaatactaaaaatacaacatgtgaagtgaaaatttcactcggcaagcttcacaacaacaaatctgagatgacagaagagtcagtgaacttgaagctacatcgatagatagaatctaatgtgaggccaggcgcggtggctcacacctgtaatcccagcactttgggaggccgagatgggtggatcacctgaggtcaggagtttgagaccagcctgaccaacatggagaaatcccatctctactaaaaaatacaaaattagccaggtgtggtggcacacacctgtagtcccagctactcagcaggctgaggcaggagaatcgcttgaaccaggaggtagaggttggggtgagctgagatcccaccattgcacttcagcctgggcaagaagagtgaaactctgtctcaaaaaaaaaaaaaaaaaaaaaagaatctaatctgaaagagaaaatagaggttaaacaaacaaacaaaaaacagggcttcagggacctacagcacagtaccaaaaggtcttacatacataaccaaaggcctaaaaaagaagacagaaagaatatgaggcaggaaaggaacttttgaagaaatgatggctgaaattttcttcaatttgaaaaaagacaaatccacagattcaggaatctcagcaaacctcgaatagtcaaatgccttgctaaaaagcaaacacagagggaaaactcttgaagcaccaaaagaaaatgtcacattacacagagggaaccatgactggataaacggcagatttctcatcataaaatatggaagccaaaagaaaataaactaaaataccccttgctaaaagataaggcactgtcaacacagaattctatatccaaccacaatgcccttcaaaaatagaggtgaaatagatactttcagataaaagaaagcaagcacaatttatcaccaaaagatacgccctgcaagaaaggctaaagaaattcttcaggattaagagaaatgatgctagaaaatgcaaatcttcagaagacaaagaagactaccacaaatggtaaatatctgggtaaacttagatgacttttagctcttaagttcttaacattacatgattattgaaagccaaaattacattgttgttttctggggcttataatgtacatagttccaacacacatgacaatagcataactgacaacaaacagaggtgatataaaagaacaacttacaagctttgtatactttacaacttgtacaatattagtcagaagtggtaatactataaaaacagactgaaaagagtaaagaaatatatttaaattgctagagaaatgtgccaaagaattaagttgaaacccttcctgatattaaaaaattaattcaaaagtgaatcgcagacctaaatgtaagagctaaaacaataaaactttagaaaaaaacataggaggtaagtctttaggacttggttgaacaacagtttttagacataacactagataaaagtagaggcaacaaaagaaaaaataactagaatttaccaaacctacagacttttttgctacaaacaaaatcatcaggaaagtaaaaggatggaagaaatatttacaagtcatatgtctgataagtagtttgtatccagaatacagagctcttccactcagaaataaaaagctatacagcccagttaaaaattgaacaaaggggccgggcacggtggctcacacctgtaatcccagcactttgggaggcctaggcagggggatcacctgaggtcaggagtttgagactagcctggccatcatggtgaaactccgtctctgctaaaaatacaaaaattggccaggcgtggtggcgggcacctgtaatcccaggtactcaggaggctgaggcaggagaagcgcttgaacccgggaggcagaggttgcagtgagccaagatatcacaccactgcactccagcctgaacaacagagtgagactctgtctacaaaagaatataatgaaaaaagataagtaaaaatcaacaccacaatgagatactacctcatgccctgtaggatagctaaaatcaaaagccaaacaataaaaaatgttggcaaagagatggagaaattaaaaccttcatatattgttgctggtaatttaaaatgttacagcctctttgtcagtttttcaaaaggttaaacagagttgcagcatgaaacaaaaatcctaggcccaagagaattgaaaacaaatgtctggatttgcagacaaatgttcataataataacattattcataatattgcaaaagtatatacaacctaaatgtttatcaattaatgaatgagtaaagaaaatgtagtatagccatgcaatagaatattatttgacaacaaaaaggaatgaagttctaataaatgctacaaaacaaatgcttgtacatgatgctaggagaaagaagccactcacaatacaccaaatgattccatttatatgaaatgtgacaaatagggatggagacagaatgaagattagtgattgccaggagctgggcaagtagggtaatggagagtgactgttaatgggccaaagggcttctttttgaggggatccaagtgttctaaaattgattgtagtgacatagagactctcaaaaaaaaatagtgtattagcacacatagaaaagtaaaactcaatcacaaggtgtctgtaagaaacacactttaagggaagacacaaacaggtccaaagtaaatggataggctgggtgcgcggtggctcatgcctgtaatcctagcactttgggaggccgaggcgggcacttgatcacttgaggccaggggtttgagaccagcctggccaacatggcaaagccctgtctctactaaaaatgcaaaaattagccaggcatggtgccacacacctataatcccagctactaggatggctgaaacaggcgaactgcttgaacctgggaggcaaatgctgcagtgagccgagatcacaccactgcactccagcctgggtgatagattaaaactccatctcaaaacaaacaaacaaacaaacaacaacaacaaaaagatggtgagtggctacatagtaaagagagggagggacatttcacagtaagtcagacaatgaagaagtcataataattataaatgtatgcacctaaaaacaaggcttcaaaatacatgaaggaaaatttggcataaggcataaacagtcagaatactcagtgccccaaacatggtaagatattttagcatccctctttgtgattgacaaaaccagaccaaataataatagtcatcatcatcatctagcaatgttaaaaccactataaacattcttttcaggtaaacttggtgcattccccatgaaagaccacatactgagccacaaagctggacacaatagaatgaaaataatgggaatcatacagattatgttccctaaccacattagaaaaaaagatatgaaatgaatgacctagcagccgggtgcggtggctcacggctgtaatcccagcattttggaaggccaaggcaggcggatcacctgaggtcgcgagctcaagaccagcctggctaacatggtgaaaccccttctctattaaaaatacaaaaattagctgggcgtggtagcggatggctgcaatccgagctactcaggaggctgagctgaggcaggagaatcgcttgaacctgggatgcggaggttgcagtaagccaagattgcattactgcactttagcctgggtggcagcgcaaaactctgtcataaaataaaatgaaatgaaatgaaatgaaatgaaataatgaaatgaaatgaaatgaaatgaaatgaaatgaaataaaataaaataaaataaaataaaataataaaataaaataaaataaaatatgtagggttctacctaaagaacctatatataaaagggtaaagtaaacccaaagtaagtagaaaaaaaaaaagaaatagtaaaaataagagcagaagaaatgaaacagaaaagtaacagaaaatttgaagtcaaagctggtccttttgtcagagacctctgaaccagagtgcttctatcttgaacaggtgctgggtcaaataaggctgagtcctgctgggctgcattcccagtaagtcatgcattctaagtcacagaatgagataggaggctggcacaagatacaagacagaaaaaccttgctgataaaacaggttgtaataaagaagggggccaaaacccaccaaagccaagatggtgataaaactgacctctggtcatcctcactgctcattatacactaattataatacattaacatgctaagagacactcccacaagcgccatgagtttacaaatgccatagcaatgccagcaagttaccctatatagtctaaaaaggggaggaaccactagttctgggaatagcccacccctttcccagaaaactcatgaagaatccaccccttgtttagcatacaatcaagaaatactcataaaaatgggaaaccagtggcccatggcactgctctgcctatggactagccattcttttattcttttactttcttaataaacttgctttcacttgatgaatccgccccaaattctttcttgcatgacatccaagaacctctccttggggtctggattgggaccccttctggtaacacgttggaaagacctacaaagttgacagtctgcaagcgaaattaatttatttttaaataggaagaatacaaattaccaagaataaaaggggaattagctctacgatcccaaaggtattgagggccaaagattattattaatgacttcatgctaactaattcaacagctgagatgaaaagaagaaattctttgaaaacaaaacttatcaaaactgataaaacagaatatctgagaagcattttaagttgaattatcaaaatcctttccaaaaagaaaactctagactcagattttttcactgataagttccttcaaacactaaagaaaaaatagcatcaatctcacacaaacatttccagaaaacagagaagacaatgcttcccaaatcattttctaagttgagcatgaagaataccaatgcatatgccaaaaataccagcacctgacaaaaagcagcaaggttacaccaaaatccctcacatataaagatgcgcaaatatttactgttagcaatttaaatccaacaatatattaagaggaataggccagttgcgatggctcacacagattacgaaagtaatcctggcacttttggaggccaaggcgggaggatcacttgaggtcaggagacctgcctggccaacatggtgaaaccttgtctccacgaaaaaaattagctgctcatggtggcacgtgcctgtaatcccagctactccggaggctgaggcaggagaatcacttgaacccaggaggcggaggttatagtgagcagagattgtgccactgtacccatctccaaaataataataataataataatacaccatgacaccaaatggcatttagtataacatttgaaaataaaacaatgaaatttacattaatatatttaaatatatagcattatctcaatagatacagaaaaagcttctgagaaaactcaatatccattcaggacataaaccctcaggaagctagggctagaccttactcaactgtgtattctccatggcatggcatgattattcctcttagggtctgtgactataactatcttttcaatggcagttatgttgggttctgttgtccttgtcatatctaaacagtaataaaacctatatttgaaaacaatctgataaagttcatcaatgaaacccctacagctgacttataattagtggtgtaacactgaatgctgtattcaaagaatgaaaacaagattaagtcaattctgtgagggaagagaataaaaggcattacaactagggaaaaaaagagataaaactgtgttttatgacaatcatctattagaaaaatctaagaaatgtacctaaaaaaactcgtagaattaatatgacttaaggttgtaagaaacgggtcaatatacaaaaattctatttccaacaaaaaattagaaatttttataatacttcataattgctgaaaaagtatttaatattttaaaatacaaatagcatcaaaaaaagacaaaatacttaaaaataaaaataattttaggccaggcgtggtggctcatgcctgtaatcccagcagtttgggaggccgaagcaggcagatcatttgagatcaggagttgaccagcctggccaacggggtgaaaccccatctctactaaaaatataaaaattagttgggcttagggtacatgccagtaatcccagctgcttgggaggctgaggcaggagaattgtttgaacccaggagatggagtgagccaagactgggccactgcactccagctaggcgacagagtgagactctgtctcaacaaaaaggaaaaaaaataagtaattttaaaaacagaagacatgcgagaccaaaggctaaaagcaacaaacgactgctcagacaaaacaaaaaagacctaaataaatggagagatatactatactaatgactaagactcagtggttgttaagatgtcagttctcctcaaactgatcaacagattcaagacaattacaatcatgatcccatcagccttttttggagaagacagaaaagagatgattaaaatttatacggaaatgtgaaggacgtagagtatgcagaacttcgaaaaagaagaaaaaggttttaggacttgcaattctgacttcaagacaatataaagttaccaaagaatccgaatactctaacagggctagacaaacagatttttgaagcagaataaagatttctgaaagagatcccacttaggcagccacgcgatgttcccaaagcaacccggtgagaaaaggagactcttttcaacaaatggtgacaaacaactggatagccacatgcaaaaaactcagacctacaaaaataacttcagacgcatcacagacctaaatataaattagcaaaagcaagcccttttacaggaaacaaaggaaattaccttcaagactttgaggttaggcaaaagtgtcttagctcacagtaagcaataactacaaaagaaaacactgataaattaaacctagcagatataaatatttctgctcatcaaaaggtacagttaaaataaataggccgggcgcggtggctcacgcctataatcccagcactttgggaggccgaggcggacggatcacgaggtcaggaggtcgagaccacggtgaaaccccgtctctactaaaaacacaaaaagttagccgggcgtagtggcgggcgcctgtagtcccagctactcgggaggctgaggcaggagaatggcgtgaacccgggaggtggagcttgcagtgagccgagatcgcgccactgcactccagcctgggtgacagagcgagactccgcctcaaaaataaataaataaataaataaataaataaataaataaataaataaatgggtaaaccacatagacttggggaaagtatttacaaaacatttgtctaacaaaggatgagtatttaggacatataaacaccttctgcaactcaaatagatgaaaaacgaaaacaaagaacagtaaaggcaaaatgaacaaactcatcacaaaagagaacacacaaatggccaacacacaagctaaaacgtgctcaatatcaccagttatcatgaaaatgtaaattcaaaccacagtgataccacttctggtcaagatggagtgaataaaggggaccagatttagcctccttgcgtgaaataataaaaacctaataaaatgaatgaaacaacagcactgaagatattggacaagtaacaaaagacagtgatccctggaagacaaaaaacaaacgggccacacgtgtgcccagtttactgccttgagagagttttccaggtcgtggaacagggaggaggaacccaggcagagcctgtcgtctccccaagttgaggaaatggagctggaagtccaaggaggccaaggtgcctagagctcacaagggagaccagcactgagtagagagctggagagagagagagaaatgaagagatctacaagggctcaccctagaacttttggttgaatgacaaatcagcacttgcaatgtaaaggagctgtccaagggcaaggtgagaaatcaccaaaacaattagacgtaatagcatccaggactgacttaaggaggtgtatagtacccacacccaaaagtccaaaaggaaatgacgtgatataatttatatcacattggagatgtgacattggaatactaagaaagaaaaggcttcagaaggaggaaaaatttaaccctaaacacaaccctggtccaatcaaggaaaacataaaagacccaacagaaagaaactgttttcaagcaacttaataatgccacagaacaaagtccacaaatatttttaaaaggcaaacaaaactagagaaactagaaaacaaggtaaaattcacactggctcaaaagtcaatccaaatttataagacttacatagaagcaggaaattataccccataatgaaacaaaaaacaaaccaattttgaaatgaaacagaaaatagaattggtagacaagtcctttaaaacaattatgatgatatttcatatgatgagaaggctagaagaaacaacatattaagtaaaaatatgaattatttttaaaatttgaacttctaaagatgaaaattacaaagtctaagatgaaaaatacaccttgaaatttgcaacacatgaaatcaaaattactaacctaaatgaaacacagaaaaaaacactaaaaaatgtaatacgtgataattgaaataacttcaagaggccaaacatatttgtaactagagccacaaaacaggagataatattgaaaaaaaatttttagaaatcatggccaacaacttttcacatatttgagggaaattataagcatatataacaaggcactcttttaatgaattatcattcgctagaaacatgaagaaaagtggctgagcgcagtggctcatgcctgtaatcccagcactttgggcagccaaagtgggaaaatcgcttcaggccaggagttcgagaccagtgtgggcgacgctgcagaacccatctctaaaaacatacataccccccccacacacacacacacacacaccacacacatgaaaaatggcctggcatggtggctcacgcctgtaatcccagcactttgggaggccgaggtgggcaggtcacctgaggtcgggagttcgagaccagcctgaccaacatggaaaaaccccatctctaccaacaatacaaaattagctgggcatggtgactcatgcctgtaatcacagctactcgggagactgaggcaggagaattgcttgaacccgggaggtggagattggggtgagccaagatcgtgccattgactccagcctgggcaacaagagcaaaactccgtctcaaaaaaaaaaaaaaagaattagccacgggtagtggcacacacctgtggtccttccagctactcaggaaggctaaggcagaaggaggtcaaggccatagtgagccatgactatgccactgcactccagcccaggtgacagagtaaaagcccatctccaaaaaacagggtaaaccatgaccaaaatgactacaatcagaaattaaaattccagtgcagccaagaaaaagatcttattacacactacaaaatcaaaagaaagttgaaatcgttataatactatcatgtaaagtggacaaaaataaaaattttatcaggaaaaaagagcatcattttatatacattaagggtttaattcatcaagaacacacaaaaatcctaaacatttatttacctattaataacagggcttcaaaataaataaagcaaaaatgagagaactgtaagaagaaatgaaagaatccacaattatattttaaaatttcagcaaacctctctgtgtaatagaaccaggccaggcatggtgaatgacacttgttatccctgaactttggaaggccgagacaggattgcttgatcacaggagttcaagaccaacctgagcaacacagggagaccctgtctctacaaaaagagttttaaaaattaactgggtgggccaggcgtggtggctcacacctgtaatcccagcactttgggagccagaggcaggcggatcacctaaggtcagcaattcaagtccagcccagccaacatggtgaaaccctgtctctactaaaaattcaaaaattagccgggcgtggtggcacacaacagtaatcctagctactcgggaagcttagataggagaatcgcttcaacccaggagatggaggttgcagtgagccgagatcatgccactgcactccagcctgggcgacagagagagattccagaccagcagacagaaaatcagtaaggatacagaagcttgaataacaccaaactgacctaactaactttagaacactctacacaacctaccagaatacacattctgttcaagtgcatttggaacattcaccaagatataccatattcgggccaaaaaaaacaactcttggtacatttaaaaggtttgaagtcttatcatgatttttttcttaccactatgatatttagaaatcagtgacagaaaaaaaaatcaataggcaatccccatatttgaaatcaaaacatacttttaaaataaccaatgggggccaggagctgtggctcacgcctctaattccagcactttgggaggtcgaggcaggtggatcacaaggtcaggagttcaagaccggtctggccaagatggtgaaaccccgtctcttctaaaaatacaaaaattacccgggcatggtagccggcgcctgtaaccgcagctactcaggaggctgaggcagagaattgcttgaacccgggaggcggaagttgcagcaagccaagatcacgctgctgcactccagcctgggcgacagagcgagaatctgtctcaaaatataaaataaataacataacataacataacccataacaccaaggggtaaaaaaaggacaaatatatcaagtattttaagacagttaaagcagtgattgaaagagaaatttatacaattacatgactatattagaaaagaaacaaatcagtgacttcaccttgttccttaagaaactagaagagcaaaagaaagatcgagcagaagtcaatgaaatagaaaacagaaaaatagggcacactcagtgaaatcaaaggttagacttacacttctgggacgatggaatggacatacttttccctattcctcccactaagtacaaatttaaaatgtgaacattgtaaataaaacgaatattctctgaaaggtggagagaaggcaaattagctcaggatcacaggacacaaggcacaatatagcagtaaattccctgggtattcttctttttgcctaatgtatcctactcctggaatggaagaagtgagtacatcaggacaccgatgaacacagaccaaaaaaaaagaatccccaacagggcccggcgcgatggctcacgcctataatcgcagcactttggaaggccgaggcgggtggatcaccagaagtcaggagttggagaccagcctggccaacatggcaaaaccccgcctctactaaaaataaaaattagctgggcgtgttggccggtgcctatagtcccagctactccggaagctgaggcacgaaaatcgcttgaacttgggaggcggaggttgcagtgagcagagatggcgccactgcactccagactgggtgataaagatggtctccaaaaaaaacaaacaaacaaaaaaactaaaacagttgtttaagtaagatgcatagtctcatgacaacacaaaaatgcccaggtttcaatcaaaagttatttgtgataccaaaaagatatgaagaatccagaagatttcaaattgaatggaaaaaggcaataaacaaatgcaaacatcaagatatcttaattctaatatctcacagatacatcagaattaactgaaaaaattttttgtttgtttgttgttgctttttgtttgtttgtttcttgagacggagtctcgctctgttgcccaagctggagtgcactggcatgatctcagctcacggcaagctctgcctcccaagttcaagcgattctcctgcctcagcctcttgagcagctgggattacaggtgccgccatcgctcctggctaatttttgtatttttagtagagacgggttttcgccacgttggccaggctggttttgaaccccggaccccaggtgactaacccaccttggcctcccaaaaacaatttttaggccgggcatggtggctcacgcctgtaatctcatcattttgggaggccgaggtgggtggatcacctcaggtctggagttggagaacaacagcctgaccaacatggacaaactccgtctctactaaaaatacaaacttagccgggcatggtggcacatgcctgtaatcccagctacttaggaggctgaggcaggagaatcacttgaacctgggaggcggaggttgcagtgagctgagatcacgccattgcacttcagcctgggcaacaagaacgaaagtttgtctcaaaaaagaagaaaaaaaaattcagcggaacaaatatccaaaccatatcaatgaactaaaataagcagatataaaatacaataaagaaaaatggttttggcgtagtgaattggggtagaaaaaaaatacgacaagaaaaatgggattccaaaaatgttcaagtaactcaaaagaaagcaggaaaaagaacaatcaaaaaactaaaactaaaacgaggcgtggtggctcagacctgttattctagcactttgggaggccaaggtgggtgaatcacctaaggccgggagttcaagaccagcctggccaacatggtgaaaccccaactccactaaaaatataaaaattagctgggcgtggtagcacatgcctgtaatcccagctacttgggagactgaggcacaagaactgcttgaacccgggaggcagaggttgcagtaggccaagattgagccactgcactccagcctgggcaagagtaaaactttgtctcaaaaaaaaaaaaaaaaaaaaaaaaaaaaaggattctgacaacatctgtaagtatgtaaatgacccaaatacctaaaaacagcaaataaaagacaaaaactggccaggtgcaatggctcacaaccataatccaagcactttgggaggctgaggagagcagatcacttgaggttcggtgttcgagaccatcctggccaacatggtgaaaccctgtctctactaaaaatacaaaaaaaaaaatttaggcagtcatggtggtgggcacctgtaatagctactctggaggctgaggcaggagaattgtttgaacccactaggcagaggttgcagtgagccgagatcataccactgcactccaccctgggtgacagagtgatgaactccgtctcaaaaaaaaaaaaaaaaagaaaaagacaaagattgacaaactagatttaaaaaacataacctacagccaagcatggtggctcacgcctgtaatgccagcactttgggaggccatgacagaagggtctcttgagcccatgagttcgagaccaggctgggcaacataacaagacctcgtccctacaaataataaaaaaattagccgggtgtgatggtgcacatgtgtggtcccagttacttgggaggctgaggtgggggaattgtttgagcccaggaggtccaggctgcagtaaaccatgattgtgccactgcagtccagcctgggtgacagagcaagaccgtgtctcaaaaaaaaaaaaaaaaaaaaaggccaggcacagtgactcacacctgtaatcccagcactttgggaggccaaggaaggcagatcaagaggtcaagtgttcgagaccagcttggtcaacatcgtgaaacccggtttctactaaaaatataaaaaattaaccaggcatggtggcgggcacctgtaatcccagctactcgggaggctgaggcaggagaattggttcaacccgggaggtggtggttgcagtgaaccaagatgacgccattgcactccagcccaggtgacagtgcaagattccatctcaagaaaaaaaaaagaaagaaagaaagaaagaaaacataacctaacactgttttgtgtacaagacatttacttcgaatataacaatctaagcacattgaaagcaaaaaaaaaaaaaaaattcaaaaggtatatgatgcaaccattcactaaggaaaagtggatgactatattaatatcagaaacagtatacttcagagcaaagaaaaagtactagagactaagaaggaaattatttattgagagaggggtcaatccaccaagaggacataacattcctaaatgtgtatgcagcaaaaaaccagactacgaaatctgtgaaagaaaacctgatggaacagaatgaagaaatacacaaatccactatagagacttcagtatttctctgtaacaactgttaaaactatacatatgatcacagcaagagtatttacttcaaccccatgaactaactggatccatggacatttacaggacattccacccagcaagagtggaatactttttttttttttttttgacagagtctcactctgtcgctcaggctggagtacagtggtgcaatctcagctcgctgcaacctccgcttcctgggttcaagcaattctcctgcctcagcctcccaagtagctgggactacaggcatgtgccaccatgcctggctaatttttgtattgtttttgagtagagatagggagactccgtctcaaaaaaagaaaatagccaaaagtgatgaacaggggatatataaaggtactactgcttgtctcagcagcacatataccaaaattgaatcaatacagagaagattagcatgctccctgcacagtgatgacatgcaaattcttaaagtgttccatatttttaaaaaaagataccaaataagcacccgaaaagatggtcaacatcattagccactaagtaaatacgtattaaaaacacaatgaggtgtgtgtagtggtctgtaatcccagcactttaggagaccagtctggagcatgacttgagctcagaagttcaaaaccagcctgagcaacatagcaagaccttatctcttcaaaaacatatttctaaaaacattggctgggtgtagtgtagcacacacccatagtcccagctactcagagggttaaggtggcaatgagacatgatcatgacactgcccttcaaagcctaggtaacagagcaagaccctgtctcaaaaataataataataataataataatacacacaatgagatatcactacccacctatcaacattactaaatgaagacttacgttcacatgaaaacctgtgtgatgtttctaacagttttattcataataacctacaagtggaaataactgagattatctttcagcaaataagtaaacaaagtgcagtataaccgtaacaaacactaagcaacaacccggaggaatctccaaggaattaaacttagtgtaaaaaactcaatcccagaaaattacatgttgttttgttttgttttgtttttagaccagaatctcattctgtcacccagggtggagtgcagtggtgcaatctcggctcactgcaacctccacctcctgggttcaagcaattctcatgtctcagcctcccaagcagctgggattacaggttaatccctgtaatttttgtattttcagtagagacagggtttcaccatgttggccaggctggtttccaactcctgacctcaagtaacccacccacctcagcctcccaaggtgctgggattacaggcgtgagccaggcacctggccttcagaaaattacaagttctatcatcccatttatataacatccttgagataacaaaattaccaaaatgaggaatacattagcagttacgactaagtctggcggcaggaggaaagcaggtgtggctataaaagcacaacaggaagggagaggattctgggaagatggtgcaataggaagcaccaggaacctgaggtcgggagttcaagaccagcctggccaacatggacaaaccccgtctctactaaaaatacaaaattagtcgggcgtggtggtgcatgcctgtaatcccagctactcaggaagctgaggcaggagaattgctccaatccaggaggcggaggttgccgtgagccaagatcgcgccattgcactccagcctgggcagcaagagtgaaactccatctcagaaaaaaaaaaaaaaaaaaacaagtatatataagtcagcaatgaagaaaatgcaggacttgtacacagaaaaatcataaaactttactgaagtaaactgaagacaacatatataaatggaaagacatttcatgttcttggattgcaacaccttaatgttgctaagatgttactactccaaagcaatctacacattcaataaaatccctgtcaaaatcccaagaatgttttttgcagaaattaaaaaaaaatacattctaaaactcatgtagaatctcaagggacctcaaatagtcaaaacaatcttgaaaaagaataaatttgaagacatcacacttcctgatttcaaaacttactacaaagctacagtaatcaaaacagtgttgccaggcttggtggctcatgcctgtaatcccagcactttgggaggccgaggcggacggatcacctgaggtcgggagtttgagaccagcctaatcaacataaagaaaccccgtgtctactaaaaatacaaaaattagccgggtgtggtggcacatgcctgtaatcccagctactcgggaggctgaggcaggagaatcgcttgaacccaggaggcagaggttgcagtgagctgagatcaggccactacactccagcctgggcaacaagagtgaaactccacctcaaaaaaacaaaaacaaaaacaaaacacagtgttgtactggcataaaaacagagcactgaaagagaatagagagttcaaaaataaactctcgcttatatggtgaagtgattttcaacaaaagtgccaggatcattcagtgggaaagagactcttttcaacaaataattttgggaaaactgcattatctacatgcaaaagaatgtaggtggacacttctcttacaccgcacacaaaaattgactcaaaatggatcaaagacctaaacataagagctacatctggtggccgggcgcggtggctcacgcctgtaatcccagcactttgggaggccgaggcgggcggatcacgaggtcaggagttcgaggccagcctggccaacatggtgaaacccctgctctactaaaaatacaaaaattagccaggcatgctggcaggcgcctgtaatcccagctccttgagaggctaaggcaggaaaatagcttgaacctcggaggcagagattgcagtgagccgagatcgcaccactgcactccagcctgggacccagcgagactctgtctcaaaaaaaaaaaagaaaaaaagaaaactatgtattttattacatgtacacatttgtctttcatatacttgtaactcagaaaaccatgctttcacaaatgtaataatagaaatacaataatattagcaatcataacatttgtgaaagtgtaaagaataaactggccagatgctgtctcttacaccctagaacccaggttctggtcaaggcttgtcttggttgtatgaactcacttcatggacctgtcataaggctcaaaagagatactgtaaacaaaagcatcttgtaaactgcataagcctgtagatttgtggtccatctaaatccaggcactttaacgactgatagctgtccccccagaacctcctttctcgattcttaacataaacaacttatacttccaagtccagttcaaaagttatattcttggaagcctccgcgtccctcctgtccatccaggcagaactaatccatctacactctagtattatgctctcataactcttggctcttccccagttcattcaagagtgtaacgagcagttaaaatatgtcagacatcatgctatgcactggagaaaaaatcttaaatgtgtgaagcttacaaagctttttcacacacattatctcatttcatactttaaaaatatcccataggatcatgattatgtgtttacaatttctctaaccagaataaattcccagggggtagagactaagtgtgattcatctttgattccccagagtctaatgcagtgtctggcacccagaaggcacccattaagcacttgataaatgaatgagtaaaggagtaacaaacacttgttcgattactaaaatgtcaatcagggttaacactgaaataatctttccacaaagtttccacaggggagaggggaaaaatacattatattatatacaaacacatctggggagcgaaaattcctccctatagcagagcatctccaactcaagtttaactgtttaacaaagccacatagcaactgaggatggatttgattttactactggactaacaagctcttagtgaagaacaatgagttctgcataaaagctcctatgtagatcattctgcttggtaaaactggacattattacacaaatattaaaataaacacttaaagagcttctgcacagcaaaaaaaaaaaaaaatcatcagagtgaacaggcaacctacagaatgggagaaaatgtttgcaatctatccatctgagaaaggtctaatatccagaatctataaagaatttaaacagatttataagaaaaaaaaaccatcaaaaagagggtgaaggatatgaacagacatttctcaaaagaagatatttatgcggccaacaaacatatgaaaaaaagctcatcatcactgctcattagagaaatgcaaatcaaaaccacaatgagataccatctcacgccatttagaatggtgatcattaaaaagtcaggaaacaacagatgctggaaaggatgtggagatacaggcatgcttttacaccattggtgggagtgtaaattagttccatcattaccgaagactgtggcgattcctcacagtgaccaattgaaattatattttacatgtaataaaaccattttctatttacaaaaatcaaataaattctcgtaaagcaaacacgcctccatttatttcccactttttgcacaaaattggattttcactgtaactgaggtgtgctaaatgcatggttaatctagtgtcagcatcatcttcctataaattacagatgccttctgtgagcaggtctcctgcaggctcatgtatgttgtattttgaaatctactttagaggatattttaagacttttagaaccagaaataccatttgacccagcaatcccattactggctatatacgcaaaggattgtaaatcattctactataaagacacatgcacatgtatgtttattgcagcactatttacaatagcaaagacttggaaccaacccaaatgcccatcaaggatagactgcataaagaaaatgtggcacatatacaccatggaatactatgcagccataaaaaagaatgagttcatgtcattttcagggacatggatgaagctggaaaccatcatctcagcaaaccaacacaggaacagaaaaccaaacaccacatgttctcactcaaaagtgggagttgaacaatgagaacacatggacacagggaggggaacatcacacaccagggcctgtcaggggatggcgggcaaggggagggatagcattaggacatatacttaatgcatgtggggcttaaaacctagacgacaagtcgataggtgcagcaaaccaccatggcacatgtatacccatgtaacaaacctgcacgttctgcacatgtatcccagaacttaaagtataattttaaaaaatttaaaaaataaaaaataaaataaagtcttgtttcagggtaatattaatttgcgttaccacctatttcaacacggcagacaattgtaccatctgagacaaatggagctttgacatgaaatcttaaaataccccataaatggtggccgggcgcggtggctcacacctgtaatcccagcactttgggaggccgaggcgggcagatcacagggtcagtagatcgagaccatcctggctaacacggtgaaaacccgtctctactaaaagtacaaaaaattatcggggcgtggtggcaggagcctgtagtcccatctactcctgaggctgaggcaggagaatggcgtgaacccgggaggtggagcttgcagtgagccagatcgggccactgcactccaccctggtcaacagagccagactccatctcaaaaaaaaaaaaaaaaaaaaaaataccgcatgaatggattgatagacaaaaagcgaaaaaatccaatgctaccagctctcataagctcaaaattcaattctctactctacaaaaatccctggtataagtgagagatatacttcaagatctttgcatattccaaagtttatggctattactgccacagagcttcttccataaacttcaaacgtttgcactgaagagcactgtgtctggggactactttactatcactagcttcataatggtgttttctccttggtgtaatatttcacaaggagacaaagaatacgtatgtgtgtatgtgaatcattcatgctagttaccacgtaaataacaacaagcagcaaatacgaagttaaaagtgaagttgcagtgtaaatgctgctgtccagatgggtgaggcttactcatccgccaagcgaagtcctcaacctcgcctccaccgcacacagcgttcaagtttccatctcaacagaacttacgcatcatgaacctttacggttcataaacagttgagaaagctaacatcaaattcttgcatgccaagagtctacaaattattccattcacagatgttataatcggatttttttttttttttttttttttttttgatacggagtcttgctctcacccagactatagtgcagtggcgcgacttcggctcactgcaacctccgcctccggggttcaagcaattctcctgcctcagcctcccgagtagctggaattacagacacgcgccaccatacccgctacttttttgtatttttagtagagacggtgtttcactatattggccaggctggttttgaactcctgacctcaagtgatccgcccacctcagcctccccaagtgctgggattacaggcgtgagccacctcgcccgactctgatcattacttaattaggataaaaccattccttagaaaggtcattcaattctgatgattgtatatctcatatttttcaaatactctcattgttaataagcatttcactccactaaggctaccctggcatcaaacgtatttcagatttggccaggctcggcagctcatgcctgcaatcccagcattctgggaggtcgaggcgggtggttcacctgaggtcaggagttggagaccaggctggccaacatggcaaaaccccatctctattaaaactacaaaaaattagctgggcgtggtggcacgtgcctgtaatcttagctactcgggaggttaaggcaggagaatcccttgaacctgggagggagaggttgcagtgagccgagattgcaccccactgcactccagcctgggcgacagagcaagactccatctcgaaaataataataataaaatacagtgaggtgtttttttttgtttggttggttttttggggggtttttttgtgttttttttgaccgagtctcgctctgtcacccaggctggagtgtggtggcgcggtctcagctcactgcaagctccgcctcccgggttcacgccattctcttgcctcagcctccctagtagctgggactacaggcgcccgccaccacgcccggctaattttttgtatttttagtagagacggagttttaccatgttagccaggatggtctcgatctcctgacctcgtgatccgcccacctcggcctcccaaagtgctgggattacagacgtgagccaccattcccggcccaacacaatgagttttaatagacagagtcaggtgacattcatctatctagtcctacacgccattttggcattgaagggttccacagggctggagtcacttagctctaggtgcacaattctagtgtatgagtatacttttctattctaaagccgcaatgagcaaaatgggtcagtgtaattgtagaattcatcttctacatatcaagcactgtaataggtaaacattttatatacatcctctctaatctttgcaacattccacaaagtaagggttattttacccattgaaaaatcactggaaagtcagaggatttagggccattgcccccaacatctacagcccacaccaagatttgaacccagatctctctggtttcaaaaccctgccctaatcatttcactgtattaccaatccaaggaataaataaagttaaggtatcttagtcagataaaagtggcaaattagaccaggcgtggtggctcacgcctgtaatcccagcactttgggaggccgaggcaggcagatcacgaggtcaggagatcgagaccatcctggctaacacggtgaaaccccacctctactaaaaaaatacaaaaaattagtcgagcgtggtgacacacgcctgtagtcccagctactcgggaggctgaggcaggagaatcgctcgaagctgagaggcagaggttgcagtgagccaagattgtgccactgcactccagcctgggtgacacagtgagactccatctcaaaaaattttttaaaaatgtggcaaattaatgagaggaaaatttaaaaagttaaccccacaaaccaagaaatctatttatgattatgtttgttgtaagagacagagtcttgctctattgtccaggctagtctcaaagtcctgacctcaagcaatcctcccgactcagcctcctgagtagtggggattataggcgttacaggcatgagccaatgcccccagcaagaagtctgtatgttcttatcatacgtgcgactaaacaaaattatacttaagaaactgacaaatcatggtaatattttaaatatcatgactacactgaaaccctgccagaggtatttttaaaatgtcaaggatttttttgatttttttttttttgagacagagtctccctctgttgcccaggctggagtgcagcagtgagatcttggctcactgcaacctctacctcccgggttcaagcaattctcctgcctcggcctcccgagtagctgggatggcaggcacgtgccgccacacccggctaacttttgtatttttagtagagacggggtttcaccatgttggtcaggctggtctcgcactcctgaccttgtgatccgcccaccttggcattcccaagtgctgagaatacaggcgtgagccaccgcgcccggccaaaatgtcaaggatttttacgctgatgtgcttaatgtgcccaatctgcaattctagtggtaatcagtgacgtacccataaatcagagagtacttctatgaaaataatcacagcctacaaatacggataaaactcctcagctttacctcttagatggttctagacagtttcagaattcgtgcctctttcttcaactctctcattaattttattacccttggcagtaaaataatcttaccaattgctctccctatgaaattgtgaatgaaaattcccatttctctttgctaggtcttgttagctgccatctctgggaaggagaaagtgtttttatagataggcatggcaaggacaaataatggagttgaaatgcaagggtggatggcaaataaattgcatcttgtgaactacctccaactaacttctgcctggagcactgtgtttaaaaggattcctaggccacatctggagggatccgggaaaaaaaaaaaacaaaagagatgtaacgaaggtaagcggagaaccagtaaagtgtagtgctacagtagcctagggtttcaaggaaaggagattataatatccagtcaggcagagcagcagtcaaacaacatgaagaaaaatgtccacgagacttggcatgtaggagatcactgatgtgcctattgacaagttcagtagcgttgtgagggaaaagtcaatgggctaaagcggaaatgagtgctgacacagagacagcaggtgtaaaccagagacagagccagtgtaccggatggctgaagtcaaatacttacgtagcaaatggggatagagacacgtgtccgatggatgtattggccttctcaggacaaatattccatcccctgaaaaccacaggaaaggggtaaagaaggatactcctataggtcaatttacagaagagagcaaaaccttaaaattgtcaacgaagtaggagctaagaacctctgtatcaggtgaagagacaggaaggtcaagacggggaaggagaagatttgctaaagatgttgaagagaatgagagaactaaacagggctgggcaagcaaaggcatcaggcaaggctgagtactcagatgaggttgaaattatgtaatagttacattaaaacagggttaatctgtatgaccaggtgctttttctttagccttcagatacagaagtagaacaacagactgtggattgggctggcattttgccaggatacagcaggaagacaggggcacaggaaaggcccaatgttgggagtatttccattaatctcctatgagatccaggctggctagggtagcaaggcaggttataagaagaaaaatacagacaaactcgtgagactgcagaggcttggaaggagaaaatgtgttgggtgacagtgagatgcagaagatttctaaggtgatacacctgcagaggagaaggtggaggtcccagcccggggaaaaggtggctaatctgcccctggtgatgaccactggcattaaaggaatccagaagagacgaggctttttctgtttgtggaagttatctccttgtccaagtttctcttcaccactgaaaacctctgaaagttgtcaacttcattaaggtagattcagaagacctgtttgattcaaaatgacaaaatgcttctagagaaaaagcacatatgtctggtcagataatgcgtgtatgacttcggacaaatcatagcatttcagtgtttgaggtaatctagtctgtgtgtcctctttattccttaactctccatctgtacagacagaaacaatgtaatcagccacataacttgtataaaataaatatgaagagagaaccaattatgaaggtagaagttcttggggtgaggggaagaattttaaaatacaaaattaactagctacttcttcaagaagaaaaatatcagggagtactgaaagagaacaattgcagaaaggaagagaaattaacgtgaacagcaaccaaaaaccttctaagaatgtatcaacagtccagtggaaaacaaatacccaccctgatgacaccttgatcttggacccatggcctccagtactgtgagacagtaacattctgttgctgaaggtgcccagtctgtggtactgtaaaacagccctaggaaactaacacagcctgttagcccacagatggtggagagaaggaatgctcagtggagctccaggcttactgtctacagctcccaaagtgtgctacaggacccctggatgggtgtaggtatgcaagataattttgggtggtgcagggtgaataatttcaaatgacataaaaatgtgtttctcttactgggtaaatcaggggtccccacctgttaggaaccaggcaacacagcaggaggtgagcagccagccagggagcaaagcttcatctgtagaaacagccgctccccatccctcgcattaccgcatgagctctgccacctgtcagatgagtggtgccgttccattctcacagaacccaactgggaactgagcatgccagggatctagattgcgtgctccttatgagaacataatgcctgatgatctctgactgtctcccatcacccccaagtgggaccacgtaattacaggaaaacaagctcagggctcccactgattctatgttatggtgagttgtgtaattatttcattatatattacagtgaaataatcatagaaataaagcacacaataaatgtaatgggctcgaatcatctctgcaccatcccttccccttctcccaggtccgtggaagagttgtcttcaagaaaactgctctctggtgccaaaacgtttggggaccgctggtgtaaatgtttctaagaatagttaagcaacttaagcttcacatgctacgaagaatacagctttaaatgctaataaaaataggtgcaaatgaaaacattctttctgtggtccagggaatcttaaccattctatcagaaagacttgcagcttggagctgcagctgccctcccacatcctgtccgctgtaaagccctgcaacacacacatacaggcgcacacacacacacgcacacatgcacatacatgcacatgcatatacttgcacacacacatgcacacacacatgcacacagatgcacatacataaatacattcacatgtatatacctgcacacacacacatgcacacacatacacatgcatattcctgcaaacacacacacacacacacacacacacacacacacacacacacgctgtgcttcatgccctcactagggtggcctgggaggaaatgcgtgtttttaggagaaatgaagacaactcaggcccctcattctcctggtgtttgcacaagtgccttctctgcagaccatgcttcagcctctttcttggttctccctcttactgaaagagagaagcagaggcccggcacatactcggctgcttagggctcaagccaagttcgcaagcttcctggggagcctagtgagatgaaggcactgcagagcctccccaaaagagtcgtcggcttttcgtggatccttgagcccaggaaggcgataggtgagacatcacagttcatcagaagacacgagcaaactccggcgagaaagggcaacggtcaaagattttattctctcggaaaagggttctcgggctgtaagcagcaggcagaagactttattgcacgcgtagttaggtgatggcgacctacggttttcactggggactgggatcgagagtgatccgacctcctactcatgctcgtctctccctgtctctctctttgccttttgtgtctctctgcctgtctctctcgctccttttcctctcagcctcctctgtctctctccttatctctcatcctccctctctctatctcactcccttctccccatctctctttctctctccttcttttccacttctctcaccctcctcatctctctgcctgccactgttcaggctcctggggccccacgtggatgggcggacacaggactcctaggctacctttcatagcgcaagcagagggctgcaggaccttggtccccacctcccagcatcctcaaaatgaggggtgtggggtgtgccgtgctctcctgagtgggcgccccacactccaggaagcagaaactgcaggtcacagctggctcgagtggtgcccacggggctgccagcttccatcgtgtgatctgctgaggccaaagcagaggacagcagcccaggcccatctctgcagcagggtgggggtaggggtgggcttgggggtggggatggggatgggagccgccaatgcaaactggcccctggctggtttcctaccctgcaccctgccatgcaagtcctcctctcctacccctacccctgtctgccccacctccacccctaggctgccccacacccaggctccagaagtctcccaggatccaggaactaagggcagccattgggttccatagcccctagtccatgagtcagccacccctctgcgtgctgacaaaccttggctctcatgccccaccccaagccaagcacacagccctgtccccccaccagcattatcaccgcctcctgattttggccctgacagccctgcttcctggtaacctcgccccctcccaccctgctccaggcaagcccaaaggccaggccctccacccacccttcctgggggccactctactatctccttgcccagatgtcttaacctggctttaccaagatagaataaataacagggatgaggccccggaccccgccaggaagatgtgccaaaataccctccatttagaagcgggaacagtgatggggcctatggatgaccccaggattgtcacccaagcagcaagaagggcaaggagcccggtttcctgcccttacctggggaggacgtggccagggctccaaaaggccctggagaggggtgggcaggagagcagatccaccctcctcttgaggaagcagccaccatccccaggaagagcagatgggggcacacaggcagagtccccacgtgctgtagagcagggccagcagaactgtactcagccccagccccaggggagctgcaagatagactgagaccctcacaggttgggctctgtgtccccacccaaatctcatctggaattgtaatcctcctgtgtcaagggaggaacctggtgggaggggatgggatctggggacaggttcccccctgctgctcccctgatagtgcgggagttctcaggagagctgatggtttgaaagtgtggcacttcctgcttctccgctcactccctcctgccgccttgtggagaaggtgcctgcttccccttcgccttctgccatgactgtaagttccctgaactgggagtcgattaaacctctttcctttataaattacctaggctcaagtatttctttatagcagtgtgaaaacaaactaataccccttccctgaggcgccttctccttaggcaacccgctgcccccatgctcctcctctgccccctgttctttcttttcccctcatgaggcccaagtgataaacggggccagccccagtcccagccccagccccagccccatcctactgcaggcctgtgtggctgctggagaggccgtgttcctttcctctccccgagcctgcctgatatgctttctggatcctggaggaaactgaccccctattctcatactggtgcaacatcttccaagacctcaaaactgtaccatttgagccagtcttttttcttatctccacttgctagggctgtcattgggacagtcctagagggtggtgccaatggatgaatggatggatggacagtagtccagggatgatgtccctgtctgtcctgaaccgggcccttcctccaatgagaagccttcctgagtgagtatatacagtcatcccttggtatccatggaggattagttctagggtccccgggaatgccaaaatccatggatgctcaagtctctgatataacgtggcctagtatttacgtataagctacgcgcatcctcccgtatacgttagaccgttactagattatttatgatgtgtaatacaatgcagatgctacataaatggtcgtgatactgtattctttagggaatgatgacaagaacaaagtctgcacatgttcaatagaaacataaccgtccaatttattttctgaatattttccatctgctgttgctgaatctacagatgcagagctcctggatacgagagccaagtgtgctttgagagtagggtgggtgaggttgctaatgagtacaggggagcaggtgttgatcaggaggaccctgcactggggcatctggacgtcctgcctcaggacttgagactccagttggatggcacaggtagactcagcccaggtcaaagccgtccccttgaagtttctttttatcccaagctctttctggcccctggaattcggcatcccctaggccctgcatggaaggacagatgaaccaggttttagataacatgtctagaagagtgagcccctactgtgtgcccggcactttccccacaggatcctctagctagaatatccaagggtcatggagagaaatacccagttaaaatatcagaaatgaaaaagtgataccattagagacactaaaaagaccattaggtaatagtattagcttttgtattctgagatccaatagcagcagtcacttccctccaccgctatgtgtatcccaggaccaccctgggcggggagggctggggttagggagcagccatggatgctctgatgctggccctgggcctcgggggtgacagtgatgaggaactgggtgcacacatgagtggggcagccgggcctggccagagaagcagcacacacgtgcacagatgtgtttacccacatacacatgtgcacgcacgtgcacaaacacattgcaggcaggcatgttgacgcctcaggcagcggaggaccctgactctgggcgctgctgacccgggcaaggccccactgtgattcgtgccatgacctcagaatgtcactggtgcttagcacctgtctgctctctggcctgcctcagtggtctacagcagttacacacaggcagtggtatctgtgagcagctctgtggactcaaaggttttctccctgagaggcatgacccaggccagctgattcatcagaatcaggtgagcgtgacctgctctcttccctccaggcggacttggggacagtggctacggtgcgggcggtgttggcctctgtggggcagctaccgaggagggtcatccctgagcactcaccaggcgcctgttctacactgcccgtgtagacgattggctctttcgtctccatggtggcttcgtagagtgggtgctgttcccaaatgtccccattcgacagatgagacgtctggggtcagagaggcagtaaccggcctgggaatccggacatgaccctgagttttgctctcagccctgccgtgtgctgtgctggaattcaggcctgaaccctgtgacctccctgccctagatcccaaatctgcccaggtttcccatcccgatggggcagagcctggtcctggcagagccactggtatagagccactggtacagatccactgacggtcctcagaacacctctgtgccctaagctgggtcctgatggtcgctgtgggccccactgaacacacatggtcccttgtccgggggagcctgctgcccttgggcagctgtggaaaatgaaggagccctggagggctggctgaggggagactatcttcccttgtgttcaaaggggtccgggcactagggttctccccaggtatttcttgctctgcgtggtcctcttgaagcctcgccctccttttgcctcgagtattcccaggagggacggtccatccagctgttcttcaggaccaaggacccactgttcttcctcagtgacccaggaaaatgaagcctcctcctgttgggacggctcagaatggtggactccacagtccctccgcgagagacgtggtttccatgcgtacaatagatctttctcatcccccaaacccaacaccctcctgctcaacaggcgttattcctaaagtggcttcactgttcagactgaagagccacggtagccaaagtgatgagcggagtagaaccgagcagtcgggagagatcttgttccctgtaggaaactgggcatcgctgaggccctgagcatcccaggaggccgattgcacagagacctctggtcgctgaccccagtctgcctccacatccctggaatagcccatcatgggcccttcacccttggcaggtggaaaccattcaacctgctggggccggtgtgtccccatttcatggcattgggggacaacaggattctctgtctaggtcccactgtactcaagtccttgggaagatgcccacccctgcttgggacttgagactccagagactggagcagctgtgggccactgggtctggcccctttttccctgggggcggcggtggaatgggggttacgcagccagccagcatctgggagcccggcgagagcggttcaggtgttctccgaagccgccgcgtacagtgtgacctttagacaattctgtctcacaggatggacgtggtagaggtcgcgggcagttggtgggcacaagagcgagaggacatcattatgaaatacgaaaaggtacaagtcggtctgcttcttggagggaggcctcttccagtgtgccctggtcaaagggtcctgggctccctaggagcacagggcagggacgggtggccaatgcccccaggcccttgcaccctttaccttggacccctcaccaaggctccctctgggctacagggacaccgagctgggctgccagaggacaaggggcctaagccttttcgaagctacaacaacaacgtcgatcatttggggattgtacagtgagtcctctgcactcccctcacccctaaagcacctgtctcagctcagggatgggtttgcttttagaaaggcctttctgacgcaggacatgtctcaccaggtcgggtcaacctcctttccagggacagaactcctccctgactcccctgcaggtccagcccgaggttgttaggccagaggtgtggggcccatctagggagccggtgggaatggagactgggctaggtcaggcccctgggcgctcagcagttctgtcggcaagtgagcacaagaggagcggggcagcctgagggtctggccctgtctacttggagacaaccccggtgagatgcaagggttatggccacagggtgaggggacgcctggcccagcctcagggctgttgtccagcaggtctctgagggcccacctgcccctgttctcccccattcccctagagctacagccctcactgtcccgtgaggggaaaaggcatggtgacaatgggggctgtagccctaggagaacgggggagaagatgggcagggccccgttctgggcatctcacggtgaggccagggaggcagcagggctcgcggctaaagacctgggtctggtgctgggaagggatctggggccgggtaagaggagcccagccaggagcccatccctcagggatcacaggatggagagacagaggatccctggggaggtagggcgggagggagctgacgagccgtgccacttctgaaacgcagggtgtgtggctcgggtgcagggagaggcaggtggatgctgggaggtcagaacctgcaagggccttggggctgtcaagtggggtgggcccctggtgcagccagagtacaccgggcaggtctcagggcaggctcccttgaccctggcggggggatgtggtcactccctgagggactcctgtcagggcccggtcgcccaccctgggcggcccccatcccatctcagggctaacctttctcagctccagcagaaagcaccacctcgagtccaggacgggcagccccattgggcagcctgaccgccccccacgccaggggccccagtaaccccggccaggctgtccctacactccttcttctcccaggtcctgcccctcctgggagtcagccccacaggaaggcccttgtcctcccttccctgtgccttctcctgggctgagccctgagctggaaagggacagagccagtcctttctgggggtcggcacccaggctggggccgctccaggccccgtgcagttcctcagctctgcctgggttgccttacagtgagacggagctgcctcctctgactgcgcgggaggcgaaggtaagagcctgatgcgtggaggggctggtccagggacgtagggactgggcgggtggtcagtgaggcagaggaagcagctggcctgagcggtggcgggtgagggcaacacgctgtcactgggaggggcagcagtccctgctggacctgaccccaggttgctgttcactttggcagtttgataaaattccaaaaggagaaccacagtcctggcttgggggtggctgcgcgcttgtgtcaggaccccacctagaggctgggacctaagactggtgtgtctgtggcctgaggatggtacatcccggggtcccaaagccagcccactggtgctcatttgctcaaaggctctcagcccttgaggtctgcccttccctggctccttccagctggctcccaccagggctccagagcccaagacccagcatccgcgggcggctctgggaagcctggcagctccgctaactccaacatgcctcatttgacagcaaattcggcgggagatcagccgaaagagcaagtgggtggatatgctgggagactgggagaaatacaaaagcagcagaaaggtaacgtgtggagggaggaagcactctctgcagagacaggggacaggcacccatggctgtggcctggcaccatcagcctctcagagggtgggcggcacactgtcctcgcccagaggactgcaggcctggtcgccagatttcctgcctattcgtgcaagcgtcaccttgcagggagggaatctgaatctagggctgggactacccggagctcaaggctagggatgccctggtgacctgaaggaaggaaaaggttcagatcagagtttcgactctgagtgtccatccactctttcagtcctgggaagggagaccctgtcccagcttgatctcacctctactgaggaatcatggggccaaaaccgacaatttccagaatccccgggctctggtcctcactggggtcaccccgtggcctgtgacaccagatcattttctgcccacagctcatagatcgagcgtacaagggaatgcccatgaacatccggggcccgatgtggtcagtcctcctgaacattgaggaaatgaagttgaaaaaccccggaagataccaggtacgctcagccagagcacaacaaacaggacaggccgtgtcggggcccaggtctccagctggagggaacgtcaagaccaccctggggagctgggggtgaaggtcagatgaacaccctgggcacagatggtgacacagtcaccacagacaaactcagctctggtgaccctccctggcttcagtaacaagccaaaatgcagctttctgcagaaggaaaccttccttctgtccttccttcccgaagtgctgactgtgggctgactgccactgggggcagggagtcttccatctgttctgagactgcttcctcctcttggccctgccctacagatcatgaaggagaagggcaagaggtcatctgagcacatccagcgcatcgaccgggacgtaagcgggacactaaggaagcatatattcttcagggatcgatacggaaccaagtaagcctacgggagccacagggtcccagcagagatggggtgaatgagagggatgggggcttccccggagcagaagccagggtcacccaggagggatgacacagctgccaagagctctcccggcccagggagcagccggcaccatgaaccgagcacctccctggttccaagccctgggccagactggaacatgtggggccagaacccaggaggatcctgaggagatggaaggcagcaaacaaaatcatgcacaatggtgaagggtgctctccctgacccatggggacccatggtaggacccacgggagggtggcaggatagagggcccatgagccccccccaggcaacagtgacagcaccaaatgctgggagaattaggggtcctggaaactctcatccaggtccgctgggaacatgacatggcacagccacgttggcagcccgttgggcagtggctcacaaagctcgatggacttgaaccacacatccccaaagtgtcacagatattgaacccactgatttgcaaactgacatccacatgaaaccagcatgccaggttcactgcttgactcctcgtcactcacacacggagccttcggggacggccttcaacacggggatggggagagcaaggctggtcctcccttcaaacggaagacccagtgagaaacgggaacgagccggtgatgcccgcacgaacgtgggtggatcctagatgcattttgctgagggacagaagccagacccaataagctaccacagtaggattcccattcctaggccattctggaaaaggccaaaccacagggactgagaagcagtctgggtggccaggggctgacggatcggggagaggctgggtgcataggggccaccctggagacttggaggatgaaggagtcgccccaggaggggctggagcggtggccgggagactctgcacatcggtttggaaccgtggaggaactgtacacccacagactgaactggcgtgtgtgcaaactgaaaaaaaaaaaaaaaatcattcagagtgaaaaggatcaggcaagtcactgtacaactgggctatttgcatgtcacagatgtggattttactgaaacatttcttcaagagtctcaggccctgaagagctcactgcttatctggtgaaacatctgaacctgaaatgggatttgctgttaggctttgtagacaaagtgaaattaacaacatctgcacaaaacaaaccaaagccccctttctctgtttcctaggcagcgggaactactccacatcctcctggcatatgaggagtacaacccggtgagtattcccggcagtgaggttcccgggccatatttccatattgacaggagtgggtgtctggtgggggtgtcgttgcttcttttaaagttagtatttgtgacccaccaggatataggaggtaggatgtcagctcaccgctggcataaacctccaaggaagggggtggtctcaaggggtcaagctgagacacaaaggagtcagggcctggactcctggtgtcacctgggcctgaccaccacttctcagaacaagaaatgacgccctcctcctggggctgccccaaagcccaggagcttggcagcatcgcacacaggatggtgctatcagcagacattttggacaaggtgctgaagtgcctgatggacttggctcttgtcatgaaatgaatgtgcatcctgaggaagcctctttttcagaggaagcctctccttcagaggaagcctctccagtcacctctgccctctccaatgacatgagtcctcccaggtgacctcagccctcccaggtgatgtccttccatggtgactctggctcttgcaggaggtgggctactgcagggacctgagccacatcgccgccttgttcctcctctatcttcctgaggaggatgcattctgggcactggtgcagctgctggccagtgagaggcactccctgcagggtaagtgaacagctgccccggggacctcctgcagccagacctggggatggccaccctggccaggtgatcacagctttcagccaaggcaccctccttgtgtcgccagcttgttgggagactttaggatgtctctgctgagggtcccacaggagtccacggctgacccccaaagcccaaatcagacgcctgtcatccccatcagcagagggcatctcatcctccccgtggccaccctctgtgtcctggagccacgccctccggctctgattctgtgcagctgactctcccctccctgagagtcctcctgccctccagctgcccgggcccctgctgccatcggtgcccacgaatgggccgaccaagcccaggtggcagcatctccccatcccctgttccctggcccgaccccactaccaggagatgaccgggaagcccagcgcccacccagttccggccaccctgtcgtggcctgaaagtcaggcttgccctttttgcaccctggcccaggaggcctccaggggaacctccagccaggctccagggaatgttcccgccccacctccccagggtaaaggccgcatgttggggtcaccagatgggagggtgggaggccttggggtttgggggcctctccagctgcccagctcttgcagctgatggctccacatcttgggggaaggctctgatttcatgatgggctgggggcttctcaggatttcacagcccaaatggcgggaccgtccaggggctccaagaccaacaggagcatgtggtagccacgtcacaacccaagaccatggggcatcaggtgagtttatggtcccctcagctcttcccagaggccctgcctcccgtggggctgtaggagcaggggggctggagcccctcgtggggctggtgactggctgagtcccagccagggcctgacctgggacgtcgggttctccatgggctgggagttggtttcctttcctgccctggaggagacagaggcacagggatgggggcccagctcccgcagagcagggcaaagggcagtgtgtccaccgggagtgtgggaaggtgacagtgttgtggggagctctggacaccgcccagtgttctgcactaggggaagggtcttcagaggccctggaagagggaggtttttagggcagcccagtggcctgagcacctctgttgcttccatcaggacaagaaagatctatgtgggcagtgttccccgttaggctgcctcatccggatattgattgacggggtaaggaggcatagggagaccctggctcagggatcttccttgccctgcagtgccctgcttccccagcccgggggtctggctcactcccagcccacaggaggctcaggcgggtccccaaaggacacacaagcaaaaccctctgcccaaggggggtcatcccagggccatggctggggctcaggcccagcctcatgggcagactgggccaggacccgacttgagagggctcagggaagcctcaagccctgggcaagcccctctctccaggagccacatccccactcaaatgagtgccccccatgaggagcttcaagaccttgtctgacccagcgtcctggagggctcaggcgaccctcatggggaaggtcactgactctggagactgaagccccagtgtgcgcagctcgagccaccagccccagcctggaaggaccaggttctttcacacctgctgtccccacagatctctctcgggctcaccctgcgcctgtgggacgtgtatctggtagaaggcgaacaggcgttgatgccgataacaagaatcgcctttaaggttcagcagagtaagtctacgtgtgcccagcggggcctggggagccctggggtcagaccccgactggcccgagggcagcttcctcacactgtcctcatgatcctctgttctggcccagagggaggtctggccaggtgggctgggcaggacactgtgacaccgagcccatcccccacatgacccagatgaaagtcgagagtgtggtgagcacttccctgtccggatcgccccccagccacagtctcctgtgtgtatctggacacctggggtggccacaaaaggatccggcaccgcccagtaggagactgaagtggccacggggtatgagctgtgaccattcccaggtaactcccctggcctgatatccaccctgtccctagagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccaggtgggctccagtgccatgtcccctcccatgtcaccctctggggtagtcagtagtaggggagtgcccgggacccgcaaccctactacctgggccttcctcttcaccttttcttcctcctcttcctcctggactctaagaaagtacaggaggcccaccggtcctcagggcaggcgctcagtgcgtgtatactggacatgctgtgcacgcaggagggggatgtgggcaagaccctccaacaagccccctcccactttccacggtgtctccctctccccctcgcagggccctccaagttactagacgagcccagacccatttgtgggagaccccgcccctccctgcaagcacccacagcctcagagagcagcagaggcccctcactcctgcacgctcctccaaggttgccaggacaagaagcctggagccagggagacaagggaatccgtgtccctgacccacagagcattcagggagagggcacaggcgggaccccgggcccagagccagagccaagagttcagccagaagtgggaacggtcagtcctggcatggactgggcagcccaggagggcagagggtgacccacgtccgggcccaatcacccactgcggagacgggtccccacgtgaggtgacaaggggctgggtgacatccaaggcccctcccacctgagttctgactgggggccgtatcccaggcccaacagccctgggacgaaggtgtgtggcaggaagcccccagccagtctgaaccctgggggcagtcccaggagccacccgccatgccacgacagcttccccacgccaggcagcacgcacccctccctctgggatcagcagactacaggcgtgtcctcggtgtcaggccacgggggccacacagagaccccgaggactccagagacgcaggcaggtggggcccagcccggaaaggcctgcgtgggctcactggagatgctgaccgcgtctgttttcctttcagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccggcccctcccagcacccccagccccacgaccatcgttctgaattctgacgacaccgtgagcctgcctttgtacttcaaactcatggaaggataaccaccttcatgttttgaaataaatgtttcctgttgaaatgattttagattttagacagaaatattgaaaaggcactatagtatcctcttataccttccatccagctgcccctaataatgatgttttgcagtcccatggcacataagaaatttaggccgggtgtggtggctcacacctgtaatcccagcaatttgagaggtcgaggcgggaggttcaggttcacttgagtctagaagtctgagaccagcctgggaaacctaggtggacccggtctctagagaaaagtcaaagaaattagccaggcatggtggcgtgtgcctatagtcccacctagtcaggaggctgaggcaggaggattgctggagcccacgagttccaggaagcagtgagccatgattgcaccactgcactccagcctgggtgacagagtgagactttatctcttaaaaaaatttaagaaatttaatgtgggtacagttctattaactaaataataatgtgaactattatctaaggttatgaaggctagaattatcccatttttgcctaacttctcgtacctgtcccaagatcccaccttggactcaccctctgccttcagctcacgtctcttcagcttcctccacatggtccagcaaacacacacctgggctgaatggtagagctgatcgctcatacacaaaggtagaccggtgggcagggattttcagacttacacagtcaatgagttttccttggtgttctggagagcaccgtttgagaaacactttgacagtgaatctaggcctcaagatccatcagctgctctagcttgaattttgctcaagctcagtgaacacctgctctgccgggtgcacgtgaaaggggcaaggatgagaaagctgtagataaagaagacaggacgcagggggtctgtctaagctctatcccctgccttcagcactgagggatgaaatccaactcttagggaacggtggccacgtgctgggccagccccaggctctcaggatctgacagtgggtgacgcagagccaggccttgcccctggggagctctccagcatacacctccctctcccctcccagcgtgccgcaaagcaggcgtcaacgccattgttaatgcacagaggaggaacctgactgttagacctgggttttccagggttgcacggcttctgggagacggatgtgaccctgaggacagggcacaggccagtgtaatgccaggatggaatgagctgtgatctgtgctgtatagaggcctaggccaaggtgggactgacggatgaccaggtcagccgggtcactgaaaacactcttgggtcctcacctgccggttcccaggagtccggaactgccaggagagtggtggcaggtcccccatcctcagctgggtgggcctggatagaacagcaaggcgagggcacatttccctggccattccctccaggcacagccgtgacctgttcattccaaatttgtggaagtatttccacacacacacaactgcaaatagcagtggacgtggtgagaggcgtttgcacatgggataggcaggattttggaggcagagcctccagggcttgccgatgggttagctgcagggcttgagagggaacggagaatccaggatgatgtgttcaaatcggtccattcacctcttccgttccacgcctgtgctgggcactgggagagacagatgcacacaggagccccggccgaggggaggtgtggggggaagcccagagtgtctgggcagggtaggaaacccagagcgtctactgggagctgaaggcttaggtccacctgggtgccgtccaggttctctgcgtgtagaagtataggctgagcttcccggaggaggagcagctgctgttgctggtgaccagcacattcaggaacggagactactctgtcaacagacagggggatgacctgaggtctggatggtctagggggtggtagggcccaggaggacccaggaaagggtctcggggatgcagaacatcctatggagggcatttgggagtcagtgctcaggccactccgggtcactcaggtcatttgccggcctctgtcataattattgccatatgagagtgccacccgtcctatgacatattttatatatttctgtgaatggcctacttgtttgtatttatgaatttatgtttaaaggatgggcaggggtgctcgagaggtccccaggagtttccctctggggagagaggggcccaccccttcccagcagccctctgagccccccgatcgcttggccacagcctctgcctggagaaagcatccccctcggagatatatggacatcagaagaaacctttctctgtcaccaggacaaatcctgttcttatttgaaccaaggccagttttcctaatgaatgcagggaggacagcacagatcaatgaaaccagcagataatccacaagactgtttcccagagctgggagatttccttccctgccaacacttttcctgaaaggtcttaagaatgaggcaaacagtttaagtctctcttgcactgttcttttagtgaaagagttcaatgaggaaggagaggaagtggagcatatgcttagtttccaagctggaaaagtggcccatggttaaccaagactagatgtaaaagcacaggtggccgcgggtccaggtgagtcggtcctacgatggcacggctgctaatgccagcagatgctcctgtcctctcctttcaagactgacttcttctggtctttcattcgttaaaataaaattgacagggcatcatccaagaagctctacactttcccttacttggatttcagactctagattctgctgagatttgagcttcatggtgaacacattcttgttgtgcttgctgctgaggggtgtggaggacagagagatggtgaaatggcaaagtggctcttgagcatgggtgggggaagcccccacatatctgagtcagtgccacctggacactacccttggagcatcctgctgaggtggccattcaggttttctttcctttccttttattccactgtttctgaatcacaaataaagatccaaggcaaacagcacattcagatccccaagctctccacctccaatgtgaccagggacgtgcaccacttcaggctcatgcaggacccacagcctttggacctcagctaagggacctgcttctcttcagcacacggggcttgtttgtgttggggtctgagccctgagcgcatggtcaaggagacccccaggtctttctgaacagagacagctggcctggcggcctccctctcactgcatgcaagagtctgttagggcggctgtcttgcttctgtgtgttgggaaattcaatttaggtacctaaaaatgaaaagtcccaggacatctccatggcttgggatccacaggagagcatcattgatgctggggacaatttaaacatatagaaacccacagggctaccttagacagggcacagggcacagcacccggggatgcagagtggaaagttcaccactacagcctggaattgcctctgtgatgccttcttcatgacacttggctgccttcgtggctggaaggctgaggcccagatcccaacatggacacaggctagcagcttgcttcaccttcctgaactgcaatttctccatctgagcctctctcctaagaggagtgtgcagggtcacttagcccatatgggccagaaaccccacacggtgccaggcacacagtagggcctcggcagatgctgcccccttctgtctccaccaccctcctggggctccctcctgaaacagcctccctcagcgccttgagtcttgcaccctaacagcctcttgcacgcagtgagagggaggcccccaggccagctgtctctgttcagaaagacctgggggtctccttgaccatgggctcagggctcagaccccaacacaaacaagccccgtgtgctgaagagaagcaagtcctttagctgaggtccaaaggctgtgagtcctgcatgagcctgaagtggtgcaggtgcctggtcacactggaggtgtagagcttggggatctgaatgtgctgtttgcctcggacatgaaacatctcacagactgcctggaagaaggtggagcagactggggttaatggtcagcagcagcagcatccccaccactggggctatccctttttaagcccttaccgtgggccaaacactgagccgtgtgcttcgtgtaacttctaagcacgcttacctgatagggtgccagcaaagactcgaagaggtgcctgggcttggcacatagtagctattgctactattatgaatgttgttttgtctttgtttttgttttgagacagggcctcactctgttgcccaggttggagtacagcagtgccatcatagctcactgaagcctcaacctccctgggtttgaacaatcctcccacctcagcctcccaagtagctgagactacaggtgtgcgccaccaagcccagccaattttttgtattttcagtagagactggttttgccaagtcgcccaggctggtttcgaactctggggttcaagcaatctgcccacctcagcctcccaaagtgctggcattacaggcgtgtgccactgcgcccagccattatgaatgtcaatattgacatgatcttgtatccttatgcccacactgggagaggtctgattgtccccatgttcctggtgtggaaccacatggaagaggcctatgttatcccaacagtgcagaagcacagcctgagtctcttctttggctgagccaagggcgtgctggagaggcctgacagaagaaggagcggcccttgtgaccagtgcccttttggttcacaaggaacgtctcctcttgttgaagtgacttggctgagcttgctacttctgctttgagagtcaaatatcaggatcaagactttaattatccccaatttacagatgatgaaaccatattgggcaggaaagaaagtcaccccaggagagcaagttggacctgagcactggctgaggacaaaggggaatgataatttgggatgtaacttgttaaggggtctcacaagtgttcttgtgatccaggtgtcgagaggatacagcagaaaggttgccagggagatgagggtagggtacaccacaagagtgggagaaattaaagagaacacgcaacaaagccttgggacactgggagggggatggaccacccagttttgtgctatgggagaagagagcaagaaaaggaatctgtgttaaatcccgacagcctgcatgagaagcaaatgcccttcattttcttcatcagcggcgagactggcatccctgcagctttgggagaccatgctagtgtagatgccagctcacgccagcgggcctgactgggagaccttgggctggggttctggtctggggctcctaggcctgatgggaggagagttcagccccaggtttcctgtacttcagctcatatccacacaatggtaattattgaaatgagagactcaaaagaagatggaacgtgaacttttttgttgtcccatgtggacacctgtgttcggtttccagttctacctttgctgtctgtgtgttcttaagtaactcacttaaacctttctgagtctcattttcttcatttataaaataaaagacgtaacatttatgtcagatattgtcctgaggattaaatgggagaatgaacaagcctcttctgcattcccctggcatccagtgggtggaggccagagaagctgctaaacatcctgccaggtgcaggacagcccccatcacaaagaattgaccggatcctgatgtcagtaaggcagaattgaggatccttggtgtgggggaaacagaataaactcagaagcttggcagatctcagttcaaaccctggttgtatcacctctagctgagtgaccttaggcaggtctgtgaactctctgagactcggcctcctcatcggtagaatgaggtagataaaaatgccaagctcggccgggcgcggtggttcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtggtcccagctactcgggaggctgaggcaggagaatggcgtgaacccgggaagcggagcttgcagtgagccgagattgcgccactgcagtccgcagtccagcctgggcgacagagcgagactctgtctcaaaaaagaaaaaaaaaaaaaaaatgccaagctcacccagaaataaccccgtgcatatatggtcaacagatctttgacaaggccgtcaaggatatacaatgtagattcttttattgctttactttcttaatagacttgctttcactgtactgtaaaaaaaaaaaaaaggcacaatgtagaaaggaaactctcttcaatgaatggtgttggggaaagtgcatgaaaaagaatgaaattgcacacttgttttacatcatatacagaaaattagctcaaagtggattaaagatttaaatgtaatatctgaaaccatgtaaatcctggaagtaaacatagggaaaaatctcctcgacattggtcataattggcaatattttttttgatgtaacaccaaagcacaggcaacaaaagtgaaaataaataaatgggactacatcaatcttaaaaggttttacacagcaaaggaaaccatgacaaaatgaaaaggcaacctacgggatggaagaaaatatttgcgacccatatatttgataaggggttatttgaaaaaatataaggaattcacacaattcgatagcaaaaattaataaatacatgaataacgcaattaaaaataggcaaaggaccccaatggacttttttccccaaggaagatatacaaatggccagccagcatatgaaaaggtgctcaacaccactaatcatcagagaaatgcaaatcaaaaccacagtgagatattgcctcataggataggatggctcttataaaaaaacgacaagagataacaagtgttggcgaaagcatagaggaaagagaacccttgtacactgttggttggaatgtaaagtggtataacctttacagaaaacagtatggaggttcctcaaaaaattagaagcagaactaccatacgattcagcaatcaggttagaaccttgaagagagatctgcgccccatgtttattacaacactattcacaatacccaagatatggaaacagcctaagtgtccagcaacagatgaatggataaataaaatacatataaacaacggactattagccattcaaaagaagaaactcctgtcctggataaacctggaggacattacgctaagtgaaataagccagacaccgaaagacaagttttgtatgatctcacttatatgtgggatctaagagagtcaaactcataaaaacagatagtagaatggtggttgccaagggctggaggtggggaaaatgggaagctattaatcaaagggtgtaaactttcagttataagatgaacaaattctggagatttaatgtacagcataggtggtaatggatgtaataaatttgattgtgataattagtacacaatatatacatatatgaaatcatcacattgtatgcattaaatatacacaatccttgtcaactcaatatttttaaaaaaatgtttaaaatgcctaggtcataagaattctgagaatgaaatacaacaacatacatgaatggacctgctacacagaaggtgctaaataggtttgttttgttttattttatttcaactctggcagatgtagacctattgggaaagaatatagaatgcacttgtgcacaaggattatctatacgatggttaaatatcctgcatacatgccatgtcatttctactcctcagtcaatggataataaaagcagaaccagccttctggtggtcacaaaacattttgacatgagaaaggctgatcatgagcaatctggcaatgtacatcccagagcgtgcatgccctttgacccacagctaccatgatgtcatgtctagcaattagccctaaggagatgatcagagatgtgtaaagagatttcattctaacagcatcctctgtagtggtatatgtcaggggctggtaagccatgtccagaggagcaggctgcatctagtccaccacctgtttttgtaaagtttatcagaacacagtcatgcccattcatttacaaattgtgtatggcttctttccctgcaacagcagagttgagtgttgcaacagaaacctatggcctgcagagtttaaaatatctaccctttggccttttataaaaaaagtttactgattcctggtgagtatattaaaaagttaggaaaacctaaatcttccagagtggagaattagaaagtaagacgtgttgtatataagacagacagtttgtgtgtgcgtttatttataaatatattattctgaaataatgttgtcgacatatgttgcaggtcttaaaaattggtcaatatatagtgttaatcaaaaaatggcaaattgtaaaatgtagacagaatgtgattgtgtattttgtgcatacaccaacagaaaagggtgctaggaaacctgtggaccaacatactaagtgtggctcttttgatggtggtatcatggatttttaaaaatcttcttggttttctgtagattctgactttcctgtaatgagtatgaataagtatgtatttcttgagaaatgtgaaaataactttatcttcccagatttctcataattgaaaatgttggaataaatggtcctgggacagatctttccattgagaagggcagaagggaaaccctggggattcagctgggtttctgttgcatttctggtaacacacagttgtgaaaagccagtgttggccgttccccaggacagtctggggtagaggaggtcaggatttaactacttgagggtccggggaacagatgtggccacagtccttcctgactcactgttttcccttccacagtccccgtcttctcttcactgatgcacatagatgcctgaccagaggagagatttagttttcgtccaaggattatctgttatgttgcagttctgaaattcccataacgtttaggctagaacacaagtgatttcattatctccaatgtgtatggcttgatagaaatagattccattatgtagcaccttaaatccagataaaacataaggaatttctattccatgtttgtatgatcaatgttaataatctaagaaaatctaaaaagaagctacttcctatattacagtatgaaataaatatgctgaatgatttgttttggggggtggaatggaaaggtataagactgaggagggtgcctgtgggaacagtgataggaatcctttcttaagggttgggttttacatacgtcttttaaaatagatgatatcattagtaaattatctgtgggcatcatgaaaaaagtgtataacgtacaactttatgagcttgacagttggtgaaaacttttctgtttaaaattttatttggccctccccaaaagaaatgtttatttatgagtattaggatagttccagcagtaatgcctcaaaagaaccaggaggtatagtgttgtctaaaatgtggactcaggagccagactgcctggctgtgcaactagccttgtcacttcctagatatgtggcaagttaattaacttctcagtgttcttatctgtagaatggggataatcctaatatacatctcagggttatattacaaattaaaaaagttaattttgtaaaggacttagaatgatatctggcaaataaaagtgttcataaaagtaaaccctataaaagtgtttactcattaaatacaataatctgaaaccattagtaatttaaacatttgtggctgacttggtaatatttatgaaaataaatactgtatttataatctttgaccttatttgactcctaggaatttattgtccagcaaacattttcacaggcagacaaaaatattactataaaatcacgtttattacaccaatctgtgcaaaaggaaaaaatagacaattaaaatggccatcaaaaggagtattgattaagtgaatgatagtaaatccattcaatagtaatcatattatccaaaaagaatgaggcatagtcatgtgatgtgggaagatccacggctaatgttaaacggtaaatgatacaaactgttatgcccaataaaatactttctgtgagagaatatatgttaatttatgcgagtggcgccaatgtggagggtttatgctaatttcattatacctcacagacagacctgggctctcccactcattttctatgtggcctggggtaagtcatttaactgctggaagcctcagcttcttcatctgtcaggcagtgataccctgactactctgcagggtaactctgagatttcaacgtgatcatctcagaatatgcctggcaaacagtaggagctcagaacttgatgtttttttcctacagcaactgctgtaggggatagcagctaatgcaagaggttggtaaatccttatatatatcaaatattgtagaaacataactacatgctactattttttcaaaccctcccctcacccttttttttcccctgagacagagtctcactctgctgcccaggctggagtgcagtggcgccatctcggcttggctcactgcaacctctgactcccgggttcaagcgattcttgtgcctcagtctcccaagtagctgggattacaggcatgtgccaccatgcccagctaatttttttggtatttttaatagagatggggtttctccatgttggccaggcaggtctccagctcctggcctcaagtgatctgcctgtctcggccccccaaaatgccgggtcaaacctcctatatccagtaaaacagcctcactgggtcaatggatatcatgtggctgcctaacatttttactttataaaaggtcttcctgaggccatttgaaagtatggatcaaaacactttatgaacagggccacaggtttgcatgaggcttgtcagtggacctccaggatgaagaccaaagtgactgtgcaatttctagtggaataatttacacttaagatcttatttatttatcaaaagactgctgtgaggtaggaattcttaacccccatttgcagaaacagactttgcctgacaccacagagctaggaaaaagtgggcataagatcctcatcaagtctgacttccaaaagaagattcaaaaagaaacctccttgctacccgccaaatctctgtagagccagccatgttcacacatgaaacaggacaatgacaatagcaccaggaatagctactcctggtcagatgccctcatgaggtcaactccgcgggatggggacaccgggccctgcttaggggaaaggaagggggtttgtagaggaagcccagccagccaagcaaccagagatgggaaaaacctattgggaagaacttgcttgctctagctgggctttgcaaagaacaggaaaagatgagtctgcacagacagaaatggtctagaatggctgaatgtttcatgtagaaattttattttatgattaatacactcgtgccatttcttggaaccacttgcttgtttaattctagtctatcaagtgataattttgttgatatttagaggctcctcagttaatttctgtgggatttttggttatatttaataaggaaaataatatgaaatgtctaagaaaaaaagaaacaaagtcaactattcctgagaatgtttaaatttattgaagtacacttgttaattgttagtatagaacctacatttcatgatagaaaaccttggacttgccagttgtagctgctggaatgaggtgtttgtccagtacatccagaacgtcgccacagattaactttagctcagtctcaacctgaaaaaataaaaataaatttaaaaaatcagatcgttgaagtctagaaattctgtaaattattacacattctatctacctctggttttgaggaagagagcttagtgttacagagaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaggcatgtgccaccacgcccggtaaattttgtatttctagtacagacggggtttctccatgttggtcaggctggtctcgaactcccgacctcaggtgatctgaccgcctcggcctcccaaagtgctgggattacaggcatgagccaccgcacctggcctgatcttccaatttttttttttaaaagctacaaattcagatttcatgtgcagtctctctattttttattaatggtaactaattcaagttttcagaaacactgtatagaccaaacaaaatctgtgtgcagatcaacaatgctcttagacaactgaacataccacaaaactaggtaagaacatcagagtagtacgatatctgcatgaaagacctgtatacgggtaatcatttattaataaccaatacatatttaaaatgattagctggcaactaaaattacctgcctaaatgagagacagtaaattacaaagtctataatgagctattcaaaatctgtaacacataaagtgaaactactttggcttacaaaaaaaatgcttctcataagtcttcatgtttcaaaacaaagacgtcatttaatgaatggcttatcttttaagcagcaatattccttcacactatttcaccaaaacatacctaaatagcactaaaacctttgtgtccaactggcgatttatagcactaaagttgaacaaaaaaacaaaaagaattctttgcctattcagaagttgacttaaaaattcagaaacatggctgggcacggcagctcatgcctgtaatcccagaactttgggaggccaaggtgggtggatcacgaggtcaggggttcgagaccagcctggctaacatggtgaaaccccatctctactaaaaatacaaagattagctgggcgtggtggcaggcacctgtaatcccagctactcgggaggctgaggcaggagaatcgcttgaacccaggaggtggaggttgcagtgagccgaaatcgcgccattgcactccaacctgggcgacaaaagcaagactccatcttaaaaaaaaaaaaaatcagaaacacaaagaaatgaagcacttactggggtatgctccaatgggtaaaatgaataaaaacctttctgagtttgaagtttatgccagcaaaataataactgtggtttagttactggtcttaatcattacctaggcaaccacactttcatccatcaacatctacagtgaatttcacagtagccaagcagttaatccaccaatgtcaagatacctgtacaacattatacatgccaaatcacacagcacattactactgcaaccatttgagagaaagtatttgtgcattttggaaaggcaccatgcacaacatccaatttcaagtaccttccaactcctcctgtgtttaggggaaactcatctatttatactaatgaattaagctgtttcttgaattgctactaattttttttttccaggatactaccatttctggaagggtgggagggaggaaccaaaggaacaaaggtacttatcttaaaaatagaaatccattcacattttaaaaattggtcagcatcttgtcttatattagagatgcacttatttaaaaagttgaccaataatgggataatctatgtaaagtctctgttttagcacttagtgcctcatatgtagtcatcacttaatagatgttaagacatacatatacacacacacaggttaaattgtgctctcatatcatctaacagcattcacctaacagtttataaagcttctgatcagaatgatatgaagtttaaaaactatgtattgtattatatggcactttggatatcagcatatgtgtactaccccaagaaggtaatttaaaatatctgtctggacataagtgtatgtgctgactacaacgcagtataacactgctctttgtgatgctgctcttccaaacagtagtgctgacctgatggtgtagtacatgatttctcacctttgacaccttcatattagtaaatattagctgtgtgttccactatcaaaaaaacaggtaataattcaaagaaatttcagcattaaaatcttcagtttcccagtttaaaacacaagtgaaacaaggttggcatataaaagtgcactgataacaagctcattttcaatttttctacttgatgttattaaaggatagaatgttagtgtatccttgctttgtttcaaacccaggattaagtcttcttggcctcctatatagactgcacttcaactgagccaaatactaagtaagggctgtaccaaagaggcagcttgacgcctggtaacaactttacaatggaagtttcctatgagctagggaggcagaaatcggagataacattttcctgaatgagtctttactatagtcactcaggaacatatcttacatgtacgatagtaagactcaagagggtttttttctgattgtcaatgtcctgagacttcagtaaaagaaaatctccagtgtgacaattccaaatgccagtctgaagcctgagtcaatttgcctaataaaactgatttcaccattaaaatagcaataattgttgccttggtggaacagttctataatagctaaagacaagaagaagcagataattagtaaactcaagttgagccaagttttctaacaagaaacactgaaaagagccatttgcagaaggtcaaaaataattaccattaatgtaaaaatgcaaaaggcacagaatattggtatgtgatgtttgtggctactaatatgcaattaaagttttaaactatacgtaggaataaaaaggaataatacgcacctacctgaagaaagaagttacttctagaggcagggtgggacgagatggaaacgggctttagtggtatctgtgacattttattcccccccaaaaaaagcatgcacagtctgatgaaaatggggcaaaatgttaacatctgtttaatctcatagtgtgtgactttcttgtatttctaaaatacttcctaatttaaaataaaattttaaagagattacaagtgaccaaataaaccaagaaccacatacttgtatggtgttcaaaacaaaatcactaaaatctagagaactaatctcagttaacaacaaaagccatccgaaggctcagttatttcccactgactcacatacagattagagtaagatttacttcacaacaagagcaggctcatttatgtggcaaagttcggagaagcttcacagataatttactactcaagaccacatttacccaggttgtatcagagtatcagttgtatctagaaccaggaagctaaaaagaaagaaaaaaaaaaaaggcctggatgaaaagccaaaataggtgatacaaagtccgtacaataaaacacataccctttactcagaagagaatccaacaaactctcacacagcaattgattttttagcccaaacaagcttgtttatctggctactaaggcttcttcagatgaagttcagtaaaatacaagagggaagaaattgcacaacaggcagcaacaaggcacaataagcagcaagaagaatctgagagtaaggaaaacaaaacaattttaaagaacagacacaggctagccgggtgcggtggctcaggcctgtaatcccagcactttgggaggccgaggcgggtggatcacaaggtcacgagttcgagaccagcctggccaatatggtgaaaccccttctctactaaaaattcaaaaattagcctggcatgatggcaggtgcctgtagtcccagctacttggatgaggcaggagaatcgcttaaacccgggaggcggaggttgcagtgagctgagatcacgccactgcactccggccttggcgacagagcaagactctgtctcaaaaaaaaaaaaaaaaaaaaaaagaacagatatggactaggcgcggtgggtcatgcctgtaatcccagcactttgggaggcagaggcgggcggatcacctgaggtcgggtgtttgagaccagcctagctaacatggtgaaacctggtctctacagaaatacaaaaattagccaggtgtggtggcatgcacctgtaatcccagctactagggaggctgaggcaggagaatcccttgaactagggaagtggaggttgcagtgagccgagatcgcaccactgcacactccagcctggcctaggcaacagagtgagactctgtctcaaaaaaaaaaaaaaaaaaaaaagaacagatatggcttggcgcggtggctcacacttgtaatcccagcactttggcaggcggaggcaggcagatcacctgatgtcaggagttcaagaccagcctggccaacatggtgaaaccctgtctctactaaaaatacaaaattagccaggcgtggtggtgcatgcctgtaatcccagctactagggaggctgaggcaggagaactgcctgaacccgggaggcagaggttgcagtgagccgagattgtgccactgcacaatctccctcctgccatcttgtgaagaaggtgcctgcttccccttccccttctgccatgattgtaagtttccggaactgcaagtcaattaagcctgtttcctttataaattacccaatctcaggtatttctttacatcagtgtgaaaacaaatgaatacagtccccttccctgaggtgccttctccttaggcaaccagctgcccccatgctcctcttctgcccccctggtatttcctttcccctcatgaggcccaagtgatccacatggccagccacagccccatcctactgcaggcctgtgtggctgctagagaggccaggctcctttccgcaccccgaggctgcccgatatgctttctgcatcctgtagaaaactgacccactattctcatactggtgcaacttcttccattacctcaaaactggacaacgtgaacttgtttcttgtctcttcttgctagggctgtcactgggacagtccgagatgggggggtggggggagacaatggatgaatggatggatgaatggacagtagtccagggagatgtccctgtgtgtcctgaactgggaccttcctccaatgagaagccttcctgagtgagtttatacagtcatcccttggtatccatggattagttctagggtccccggggatgccaaaatccatggatcctcaagtctctgacataacatggcctagtatttacatatcagctatgcacatcctcccgtagacattagaccatctctggattattcatgatgtgtaatacaatgcagatgctacataaatggtcgtgatactggattctttagggaataatgacaagaacaaactctgcacatgttcaatagaaacataaccgtccaatttattttctgaatattttccatctgctgttgctgaatctacagatgcagagctcctggatacgagagccaagtgtgctttgagagtagggtgggtgaggttgctaatgagtacaggggagcaggtgttgatcaggaggaccctgcactggggcatctggacgtcctgcctcaggacttgagactccagttggatggcacaggcagactcagcccaggtcaaagccatccccttgaagtttctttttatcccaagctctttctggcccctggaatttggcatcccctaggccctgtgtggaaggacagatgaaccaggttttagataacatgtctagaagagtgagcccctactgtgtgcccggcactttccccacaggatcctctagctagaatatccaagggtcatggagagaaatacccagttaaaatatcagaaatgaaaaagcgataccattagagacactaaaaagaccattaggtaatagtactagcttttgtattctgagatccaacagcagcagtcacttccctccaccgctatgtgtatcccaggaccaccctgggcggggagggctgaggttagggagcagccatggatgctctgatgctggccctgggcctcgggggtgacagtgatgaggaactgggtgcacacatgagtggggcagccgggcctggccagagaagcagcacacacgtgcacagatgtgtttacccacatacacatgtgcacgcacgtgcacaaacacattgcaggcaggcatgttgacgcctcaggcagcggaggaccctgactctgggcgctgctgacccgggcaaggccccactgtgattcgtgccatgacctcagaatgtcactggtgcttagcacctatctgctctctggtctgcctcagtggtctacagcagttacacacaggcactggtatctgtgagcagctctgtggactcaaaggttttctccctgagaggcatgacccaggccagctgattcatcagaatcaggtgagcgtgacctgctctcttccctccaggcggacttgggggcagtggctacggtgcgggcggtgttggcctctgtggggcagctaccgaggagggtcatccctgagcactcaccaggcgcccgttctacactgcccgtgtagacgattggctctttcgtctccatggtggcttcgtagagtgggtgctgttcccaaatgtccccattcgacagatgagacgtctggggtcagagaggcagtaaccggcctgggaatccggacatgacactgagttttgctctcagccctgccgtgtgctgtgctggaattcaggcctgaaccctgtgacctccctgccctagatcccaaatctgcccaggtttcccatcccgatggggcagagcctggtcctggcagagccactggtatagagccactggtacagatccactgacggtcctcagaacacctctgtgccctaagctgggtcctgatggtcgctgtgggccccactgaacacacatggtcccttgtccgggggagcctgctgcccttgggcagctgtggaaaatgaaggagccctggagggctggctgaggggagactatcttcccttgtgttcaaaggggtccgggcactagggttctccccaggtatttcttgctctgcgtggtcctcttgaggcctcgccctccttttgcctcgagtattcccaggagggacggtccatccagctgttctccaggaccaaggacccactgttcttcctcagtgacccaggaaaatgaagcctcctcctgttgggacggctcagaatggtggactccacagtccctccgcgagagacgtggtttccatgcgtacaatagatctttctcatcccccaaacccaacaccctcctgctcaacaggcgttattcctaaagtggcttcactgttcagactgaagagccacggtagccaaagtgatgagcggagtagaaccgagcagtcgggagagatcttgttccctgtaggaaactgggcatcgctgaggccctgagcatcccaggaggccgattgcacagagacctctggtcgctgaccccagtctgcctccacatccctggaatagcccatcatgggcccttcacccttggcaggtggaaaccattcaacctgctggggccggtgtgtccccatttcatggcattgggggacaacaggattctctgtctaggtcccactgtactcaagtccttgggaagatgcccacccctgcttgggacttgagactccagagactggagcagctgtgggccactgggtctggcccctttttccctgggggcggcggtggaatgggggttacgcagccagccagcatctgggagcccggcgagagcggttcaggtgttctccgaagccgccgcgtacagtgtgacctttagacaattctgtctcacaggatggacgtggtagaggtcgcgggcagttggtgggcacaagagcgagaggacatcattatgaaatacgaaaaggtacaagtcggtctgcttcttggagggaggcctcttccagtgtgccctggtcaaagggtcctgggctccctaggagcacagggcagggacgggtggccaatgcccccaggcccttgcaccctttaccttggacccctcaccaaggctccctctgggctacagggacaccgagctgggctgccagaggacaaggggcctaagccttttcgaagctacaacaacaacgtcgatcatttggggattgtacagtgagtcctctgcactcccctcacccctaaagcacctgtctcagctcagggatgggtttgcttttagaaaggcctttctgacgcaggacatgtctcaccaggtcgggtcaacctcctttccagggatagaactcctccctgactcccctgcaggtccagcccgaggttgttaggccagaggtgtggggcccatctagggagccggtgggaatggagactgggctaggtcaggcccctgggcgctcagcagttctgtcggcaagtgagcacaagaggagcggggcagcctgagggtctggccctgtctacttggagacaaccccggtgagatgcaagggttatggccacagggtgaggggacgcctggcccagcctcagggctgttgtccagcaggtctctgagggcccacctgcccctgttctcccccattcccctagagctacagccctcactgtcccgtgaggggaaaaggcatggtgacaatgggggctgtagccctaggagaacgggggagaagatgggcagggccccgttctgggcatctcacggtgaggccagggaggcagcagggctcgcggctaaagacctgggtctggtgctgggaagggatctggggccgggtaagaggagcccagccaggagcccatccctcagggatcacaggatggagagacagaggatccctggggaggtagggcgggagggagctgacgagccgtgccacttctgaaacgcagggtgtgtggctcgggtgcagggagaggcaggtggatgctgggaggtcagaacctgcaagggccttggggctgtcaagtggggtgggcccctggtgcagccagagtacaccgggcaggtctcagggcaggctcccttgaccctggcggggggatgtggtcactccctgagggactcctgtcagggcccggtcgcccaccctgggcggcccccatcccatctcagggctaacctttctcagctccagcagaaagcaccacctcgagtccaggacgggcagccccattgggcagcctgaccgccccccacgccaggggccccagtaaccccggccaggctgtccctacactccttcttctcccaggtcctgcccctcctgggagtcagccccacaggaaggcccttgtcctcccttccctgtgccttctcctgggctgagccctgagctggaaagggacagagccagtcctttctgggggtcggcacccaggctggggccgctccaggccccgtgcagttcctcagctctgcctgggttgccttacagtgagacggagctgcctcctctgactgcgcgggaggcgaaggtaagagcctgatgcgtggaggggctggtccagggacgtagggactgggcgggtggtcagtgaggcagaggaagcagctggcctgagcggtggcgggtgagggcaacacgctgtcactgggaggggcagcagtccctgctggacctgaccccaggttgctgttcactttggcagtttgataaaattccaaaaggagaaccacagtcctggcttgggggtggctgcgcgcttgtgtcaggaccccacctagaggctgggacctaagactggtgtgtctgtggcctgaggatggtacatcccggggtcccaaagccagcccactggtgctcatttgctcaaaggctctcagcccttgaggtctgcccttccctggctccttccagctggctcccaccagggctccagagcccaagacccagcatccgcgggcggctctgggaagcctggcagctccgctaactccaacatgcctcatttgacagcaaattcggcgggagatcagccgaaagagcaagtgggtggatatgctgggagactgggagaaatacaaaagcagcagaaaggtaacgtgtggagggaggaagcactctctgcagagacaggggacaggcacccatggctgtggcctggcaccatcagcctctcagagggtgggcggcacactgtcctcgcccagaggactgcaggcctggtcgccagatttcctgcctattcgtgcaagcgtcaccttgcagggagggaatctgaatctagggctgggactacccggagctcaaggctagggatgccctggtgacctgaaggaaggaaaaggttcagatcagagtttcgactctgagtgtccatccactctttcagtcctgggaagggagaccctgtcccagcttgatctcacctctactgaggaatcatggggccaaaaccgacaatttccagaatccccgggctctggtcctcactggggtcaccccgtggcctgtgacaccagatcattttctgcccacagctcatagatcgagcgtacaagggaatgcccatgaacatccggggcccgatgtggtcagtcctcctgaacattgaggaaatgaagttgaaaaaccccggaagataccaggtacgctcagccagagcacaacaaacaggacaggccgtgtcggggcccaggtctccagctggagggaacgtcaagaccaccctggggagctgggggtgaaggtcagatgaacaccctgggcacagatggtgacacagtcaccacagacaaactcagctctggtgaccctccctggcttcagtaacaagccaaaatgcagctttctgcagaaggaaaccttccttctgtccttccttcccgaagtgctgactgtgggctgactgccactgggggcagggagtcttccatctgttctgagactgcttcctcctcttggccctgccctacagatcatgaaggagaagggcaagaggtcatctgagcacatccagcgcatcgaccgggacgtaagcgggacactaaggaagcatatattcttcagggatcgatacggaaccaagtaagcctacgggagccacagggtcccagcagagatggggtgaatgagagggatgggggcttccccggagcagaagccagggtcacccaggagggatgacacagctgccaagagctctcccggcccagggagcagccggcaccatgaaccgagcacctccctggttccaagccctgggccagactggaacatgtggggccagaacccaggaggatcctgaggagatggaaggcagcaaacaaaatcatgcacaatggtgaagggtgctctccctgacccatggggacccatggtaggacccacgggagggtggcaggatagagggcccatgagccccccccaggcaacagtgacagcaccaaatgctgggagaattaggggtcctggaaactctcatccaggtccgctgggaacatgacatggcacagccacgttggcagcccgttgggcagtggctcacaaagctcgatggacttgaaccacacatccccaaagtgtcacagatattgaacccactgatttgcaaactgacatccacatgaaaccagcatgccaggttcactgcttgactcctcgtcactcacacacggagccttcggggacggccttcaacacggggatggggagagcaaggctggtcctcccttcaaacggaagacccagtgagaaaagggaacgagccggtgatgcccgcacgaacgtgggtggatcctagatgcattttgctgagggacagaagccagacccaataagctaccacagtaggattcccattcctaggccattctggaaaaggccaaaccacagggactgagaagcagtctgggtggccaggggctgacggatcggggagaggctgggtgcataggggccaccctggagacttggaggatgaaggagtcgccccaggaggggctggagcggtggccgggagactctgcacattggtttggaaccgtggaggaactgtacacccacagactgaactggcgtgtgtgcaaactgaaaaaaaaaaaaaaaaatcattcagagtgaaaaggatcaggcaagtcactgtacaactgggctatttgcatgtcacagatgtggattttactgaaacatttcttcaagagtctcaggccctgaagagctcactgcttatctggtgaaacatctgaacctgaaatgggatttgctgttaggctttgtagacaaagtgaaattaacaacatctgcacaaaacaaaccaaagccccctttctctgtttcctaggcagcgggaactactccacatcctcctggcatatgaggagtacaacccggtgagtattcccggcagtgaggttcccgggccatatttccatattgacaggagtgggtgtctggtgggggtgtcgttgcttcttttaaagttagtatttgtgacccaccaggatataggaggtaggatgtcagctcaccgctggcataaacctccaaggaagggggtggtctcaaggggtcaagctgagacacagaggagtcagggcctggactcctggtgtcacctgggcctgaccaccacttctcagaacaagaaatgacgccctcctcctggggctgccccaaagcccaggagcttggcagcatcgcacacaggatggtgctatcagcagacattttggacaaggtgctgaagtgcctgatggacttggctcttgtcatgaaatgaatgtgcatcctgaggaagcctctttttcagaggaagcctctccttcagaggaagcctctccagtcacctctgccctctccaatgacatgagtcctcccaggtgacctcagccctcccaggtgatgtccttccatggtgactctggctcttgcaggaggtgggctactgcagggacctgagccacatcgccgccttgttcctcctctatcttcctgaggaggatgcattctgggcactggtgcagctgctggccagtgagaggcactccctgcagggtaagtgaacagctgccccggggacctcctgcagccagacctggggatggccaccctggccaggtgatcacagctttcagccaaggcaccctccttgtgtcgccagcttgttgggagactttaggatgtctctgctgagggtcccacaggagtccacggctgacccccaaagcccaaatcagacgcctctcatccccatcagcagagggcatctcatcctccccgtggccaccctctgtgtcctggagccacgccctccggctctgattctgtgcagctgactctcccctccctgagagtcctcctgccctccagctgcccgggctcctgctgccatcggtgcccacgaatgggccgaccaagcccaggtggcagcatctccccatcccctgttccctggcccgaccccactaccaggagatgaccgggaagcccagcgcccacccagttccggccaccctgtcgtggcctgaaagtcaggcttgccctttttgcaccctggcccaggaggcctccaggggaacctccagccaggctccagggaatgttcccgccccacctccccagggtaaaggccgcatgttggggtcaccagatgggagggtgggaggccttggggtttgggggcctctccagctgcccagctcttgcagctgatggctccacatcttgggggaaggctctgatttcatgatgggctgggggcttctcaggatttcacagcccaaatggcgggaccgtccaggggctccaagaccaacaggagcatgtggtagccacgtcacaacccaagaccatggggcatcaggtgagtttatggtcccctcagctcttcccagaggccctgcctcccgtggggctgtaggagcaggggggctggagcccctcgtggggctggtgactggctgagtcccagccagggcctgacctgggacgtcgggttctccatgggctgggagttggtttcctttcctgccctggaggagacagaggcacagggatgggggcccagctcccgcagagcagggcaaagggcagtgtgtccaccgggagtgtgggaaggtgacagtgttgtggggagctctggacaccgcccagtgttctgcactaggggaagggtcttcagaggccctggaagagggaggtttttagggcagcccagtggcctgagcacctctgttgcttccatcaggacaagaaagatctatgtgggcagtgttccccgttaggctgcctcatccggatattgattgacggggtaaggaggcatagggagaccctggctcagggaccttccttgccctgcagtgccctgcttccccagcccgggggtctggctcactcccagcccacaggaggctcaggcgggtccccaaaggacacacaagcaaaaccctctgcccaaggggggtcatcccagggccatggctggggctcaggcccagcctcatgggcagactgggccaggacccgacttgagagggctcagggaagcctcaagccctgggcaagcccctctctccaggagccacatccccactcaaatgagtgccccccatgaggagcttcaagaccttgtctgacccagcgtcctggagggctcaggcgaccctcatggggaaggtcactgactctggagactgaagccccagtgtgcgcagctcgagccaccagccccagcctggaaggaccaggttctttcacacctgctgtccccacagatctctctcgggctcaccctgcgcctgtgggacgtgtatctggtagaaggcgaacaggcgttgatgccgataacaagaatcgcctttaaggttcagcagagtaagtctacgtgtgcccagcggggcctggggagccctggggtcagaccccgactggcccgagggcagcttcctcacactgtcctcatgatcctctgttctggcccagagggaggtctggccaggtgggctgggcaggacactgtgacaccgagcccatcccccacatgacccagatgaaagtcgagagtgtggtgagcacttccctgtccggatcgccccccagccacagtctcctgtgtatatctggacacctggggtggccacaaaaggatccggcaccgcccagtaggagactgaagtggccacggggtatgagctgtgaccattcccaggtaactcccctggcctgatatccaccctgtccctagagcgcctcacgaagacgtccaggtgtggcccgtgggcacgtttttgcaaccggttcgttgatacctgggccagggatgaggacactgtgctcaagcatcttagggcctctatgaagaaactaacaagaaagaagggggacctgccacccccaggtgggctccagtgccatgtcccctcccatgtcaccctctggggtagtcagtagtaggggagtgcccgggacccgcaaccctactacctgggccttcctcttcaccttttcttcctcctcttcctcctggactctaagaaagtacaggaggcccaccggtcctcagggcaggcgctcagtgcgtgtatactggacatgctgtgcacgcaggagggggatgtgggcaagaccctccaacaagccccctcccactttccacggtgtctccctctccccctcgcagggccctccaagttactagacgagcccagacccatttgtgggagaccccgcccctccctgcaagcacccacagcctcagagagcagcagaggcccctcactcctgcacgctcctccaaggttgccaggacaagaagcctggagccagggagacaagggaatccgtgtccctgacccacagagcattcagggagagggcacaggcgggaccccgggcccagagccagagccaagagttcagccagaagtgggaacggtcagtcctggcatggactgggcagcccaggagggcagagggtgacccacgtccgggcccaatcacccactgcggagacgggtccccacgtgaggtgacaaggggctgggtgacatccaaggcccctcccacctgagttctgactgggggccgtatcccaggcccaacagccctgggacgaaggtgtgtggcaggaagcccccagccagtctgaaccctgggggcagtcccaggagccacccgccatgccacgacagcttccccacgccaggcagcacgcacccctccctctgggatcagcagactacaggcgtgtcctcggtgtcaggccacgggggccacacagagaccccgaggactccagagacgcaggcaggtggggcccagcccggaaaggcctgcgtgggctcactggagatgctgaccgcgtctgttttcctttcagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccggcccctcccagcacccccagccccacgaccatcgttctgaattctgacgacaccgtgagcctgcctttgtacttcaaactcatggaaggataaccaccttcatgttttgaaataaatgtttcctgttgaaatg

SEQ ID NO: 37225 - DNA, 190317 bp, Homo sapiens; identical to SEQ ID NO: 37224
  misc_feature (73167)..(173166): n is a, c, g, or t

SEQ ID NO: 37226 - DNA, 190317 bp, Homo sapiens; identical to SEQ ID NO: 37224
  misc_feature (73167)..(173166): n is a, c, g, or t

SEQ ID NO: 37227 - DNA, 10874 bp, Homo sapiens
ctgtgagcagctctgtggactcaaaggttttctccctgagaggcatgacccaggccagctgattcatcagaatcaggtgagcgtgacctgctctcttccctccaggcggacttggggacagtggctacggtgcgggcggtgttggcctctgtggggcagctaccgaggagggtcatccctgagcactcaccaggcgcccgttctacactgcccgtgtagacgattggctctttcgtctccatggtggcttcgtagagtgggtgctgttcccaaatgtccccattcgacagatgagacgtctggggtcagagaggcagtaaccggcctgggaatccggacatgaccctgagttttgctctcagccctgccgtgtgctgtgctggaattcaggcctgaaccctgtgacctccctgccctagatcccaaatctgcccaggtttcccatcccgatggggcagagcctggtcctggcagagccactggtatagagccactggtacagatccactgacggtcctcagaacacctctgtgccctaagctgggtcctgatggtcgctgtgggccccactgaacacacatggtcccttgtccgggggagcctgctgcccttgggcagctgtggaaaatgaaggagccctggagggctggctgaggggagactatcttcccttgtgttcaaaggggtccgggcactagggttctccccaggtatttcttgctctgcgtggtcctcttgaggcctcgccctccttttgcctcgagtattcccaggagggacggtccatccagctgttctccaggaccaaggacccactgttcttcctcagtgacccaggaaaatgaagcctcctcctgttgggacggctcagaatggtggactccacagtccctccgcgagagacgtggtttccatgcgtacaatagatcttcctcatcccccaaacccaacaccctcctgctcaacaggcgttattcctaaagtggcttcactgttcagactgaagagccacggtagccaaagtgatgagcggagtagaaccgagcagtcgggagagatcttgttccctgtaggaaactgggcatctctgaggccctgagcatcccaggaggccgattgcacagagacctctggtcgctgaccccagtctgcctccacatccctggaatagcccatcatgggcccttcacccttggcaggtggaaaccattcaacctgctggggccggtgtgtccccatttcatggcattgggggacaacaggattctctgtctaggtcccactgtactcaagtccttgggaagatgcccacccctgcttgggacttgagactccagagactggagcagctgtgggccactgggtctggcccctttttccctgggggcggcggtggaatgggggttacgcagccagccagcatctgggagcccggcgagagcggttcaggtgttctccgaagccgccgcgtacagtgtgacctttagacaattttgtctcacaggatggacgtggtagaggtcgcgggtagttggtgggcacaagagcgagaggacatcattatgaaatacgaaaaggtacaagtcggtctgcttcttggagggaggcctcttccagtgtgccctggtcaaagggtcctgggctccctaggagcacagggcagggacgggtggccaatgcccccaggcccttgcaccctttaccttggacccctcaccaaggctccctctgggctacagggacaccgagctgggctgccagaggacaaggggcctaagccttttcgaagctacaacaacaacgtcgatcatttggggattgtacagtgagtcctctgcactcccctcacccctaaagcacctgtctcagctcagggatgggtttgcttttagaaaggcctttctgacgcaggacatgtctcaccaggtcgggtcaacctcctttccagggacagaactcctccctgactcccctgcaggtccagcccgaggttgttaggccagaggtgtggggcccatctagggagccggtgggaatggagactgggctaggtcaggcccctgggcgctcagcagttctgtcggcaagtgagcacaagaggagcggggcagcctgagggtctggccctgtctacctggagacaaccccggtgagatgcaagggttatggccacagggtgaggggacgcctggcccagcctcagggctgttgtccagcaggtctctgagggcccacctgcccctgttctcccccattcccctagagctacagccctcactgtcccgtgaggggaaaaggcatggtgacaatgggggctgtagccctaggagaacgggggagaagatgggcagggccccgttctgggcatctcacggtgaggccagggaggcagcagggctcgcggctaaagacctgggtctggtgctgggaagggatctggggccgggtaagaggagcccagccaggagcccatccctcagggatcacaggatggagagacagaggatccctggggaggtagggcgggagggagctgacgagccgtgccacttctgaaacgcagggtgtgtggctcgggtgcagggagaggcaggtggatgctgggaggtcagaacctgcaagggccttggggctgtcaagtggggtgggcccctggtgcagccagagtacaccgggcaggtctcagggcaggctcccttgaccctggcggggggatgtggtcactccctgagggactcctgtcagggcccggtcgcccaccctgggcggcccccatcccatctcagggctaacctttctcagctccagcagaaagcaccacctcgagtccaggacgggcagccccactgggcagcctgaccgccccccacgccaggggccccagtaaccccggccaggctgtccctacactccttcttctcccaggtcctgcccctcctgggagtcagccccacaggaaggcccttgtcctcccttccctgtgccttctcctgggctgagccctgagctggaaagggacagagccagtcctttctgggggtcggcacccaggctggggccgctccaggccccgtgcagttcctcagctctgcctgggttgccttacagtgagacggagctgcctcctctgactgcgcgggaggcgaaggtaagagcctgatgcgtggaggggctggtccagggacgtagggactgggcgggtggtcagtgaggcagaggaagcagctggcctgagcggtggcgggtgagggcaacacgctgtcactgggaggggcagcagtccctgctggacctgaccccaggttgctgttcactttggcagtttgataaaattccaaaaggagaaccacagtcctggcttgggggtggctgcgcgcttgtgtcaggaccccacctagaggctgggacctaagactggtgtgtctgtggcctgaggatggtacatcccggggtcccaaagccagcccactggtgctcatttgctcaaaggctctcagcccttgaggtctgcccttccctggctccttccagctggctcccaccagggctccagagcccaagacccagcatccgcgggcggctctgggaagcctggcagctccgctaactccaacatgcctcatttgacagcaaattcggcgggagatcagccgaaagagcaagtgggtggatatgctgggagactgggagaaatacaaaagcagcagaaaggtaacgtgtggagggaggaagcactctctgcagagacaggggacaggcacccatggcttgtggcctggcaccatcagcctctcagagggtgggcggcacactgtcctcgcccagaggactgcaggcctggtcgccagatttcctgcctattcgtgcaagcgtcaccttgcagggagggaatctgaatctagggctgggactacccggagctcaaggctagggatgccctggtgacctgaaggaaggaaaaggttcagatcagagttttgactctgagtgtccatccactctttcagtcctgggaagggagaccctgtcccagcttgatctcacctctactgaggaatcatggggccaaaaccaacaatttccagaatccccgggctctggtcctcactggggtcaccccgtggcctgtgacaccagattgttttctgcccacagctcatagatcgagcgtacaagggaatgcccatgaacatccggggcccgatgtggtcagtcctcctgaacattgaggaaatgaagttgaaaaaccccggaagataccaggtacgctcagccagagcacaacaaacaggacaggccgtgtcggggcccaggtctccagctggagggaacgtcaagaccaccctggggagctgggggtgaaggtcagatgaacaccctgggcacagatggtgacacagtcaccacagacaaactcagctctggtgaccctccctggcttcagtaacaagccaaaatgcagctttctgcagaaggaaaccttccttctgtccttccttcccgaagtgctgactgtgggctgactgccactgggggcagggagtcttccatctgttctgagactgcttcctccgcttggccctgccctacagatcatgaaggagaagggcaagaggtcatctgagcacatccagcgcatcgaccgggacataagcgggacattaaggaagcatatgttcttcagggatcgatacggaaccaagtaagcctaagggagccacagggtcccagcagagatggggtgaatgagagggatgggggcttccccggagcagaagccagggtcacccaggagggatgacacagctgccaagagctctcccggcccagggagcagccggcaccatgaaccgagcacctccctggttccaagccctgggccagactggaacatgtggggccagaacccaggaggatcctgaggagatggaaggcagcaaacaaaatcatgcacaatggtgaagggtgctctccctgacccatggggacccatggtaggacccacgggagggtggcaggatagagggcccatgagcccccccaggcaacagtgacagcaccaaatgctgggagaattaggggtcctggaaactctcatccaggtccgctgggaacatgacatggcacagccacgttggcagccagttgggcagtggctcacaaagctcgatggacttgaaccacacatccccaaagtgtcacagatattgaacccactgatttggaaactgacatccacatgaaaccagcatgccaggttcactgcttgactcctcgtcactcacacacggagccttcggggacggccttcaacacgggaatggggagagcaaggctggtcctcccttcaaacggaagacccagtgagaaaagggaacgagccggtgatgcccgcacgaacgtgggtggatcctagatgcattttgctgagggacagaagccagacccaataagctaccacagtaggattcccattcctaggccattctggaaaaggccaaaccacagggactgagaagcagtctgggtggccaggggctgacggatcggggagaggctgggtgcataggggccaccctggagacttggaggatgaaggagtcgccccaggaggggctggagcggtggccgggagactctgcacattggtttggaaccgtggaggaactgtacacacacagactgaactggcgtgtgtgcaaactgaaaaaaaaaaaaaaatcattcagagtgaaaaggatcaggcaagtcactgtacaactgggctatttgcatgtcacagatgtggattttactgaaacatttcttcaagagtctcaggccctgaagagctcactgcttatctggtgaaacatctgaacctgaaatgggatttgctgttaggctttgtagacaaagtgaaattaacaacatctgcacaaaacaaaccaaagccccctttctctgtttcctaggcagcgggaactactccacatcctcctggcatatgaggagtataacccggtgagtattcccggcagtgaggttcccgggccatatttccatattgacaggagtgggtgtctggtgggggtgtcgttgcttcttttaaagttagtatttgtgacccaccaggatataggaggtaggatgtcagctcaccgctggcataaacctccaaggaagggggtggtctcaaggggtcaagctgagacacaaaggagtcagggcccggactcctggtgtcacctgggcctgaccaccacttctcagaacaagaaatgacgccctcctcctggggctgccccaaagcccaggagcttggcagcatcgcacacaggatggtgctatcagcagacattttggacaaggtgctgaagtgcctgatggacttggctcttgtcatgaaatgaatgtgcatcctgaggaagcctctttttcagaggaagcctctccttcagaggaagcctctccagtcacctctgccctctccaatgacatgagtcctcccaggtgacctcagccctcccaggtgatgtccttccatggtgactctggctcttgcaggaggtgggctactgcagggacctgagccacatcgccgccttgttcctcctctatcttcctgaggaggatgcattctgggcactggtgcagctgctggccagtgagaggcactccctgcagggtaagtgaacagctgccccggggacctcctgcagccagacctggggatggccaccctggccgggtgatcacagctttcagccaaggcaccctccttgtgtcgccagcttgttgggagactttaggatgtctctgctgagggtcccacaggagtccacggctgacccccaaagcccaaatcagacgcctgtcatccccatcagcagagggcatctcatcctccccgtggccaccctctgtgtcctggagccacgccctccggctctgattctgtgcagctgactctcccctccctgagagtcctcctgccctccagctgcccgggctcctgctgccatcggtgcccacgaatgggccgaccaagcccaggtggcagcatctccccatcccctgttcccctggcccgaccccactaccaggagatgaccgggaagcccagcgcccacccagttccggccaccctgtcgtggcctgaaagtcaggcttgccctttttgcaccctggcccaggaggcctccaggggaacctccagccaggctccagggaatgttcccgccccacctccccagggtaaaggccgcatgttggggtcaccagatgggagggtgggagtagccttggggtttgggggcctctccagctgcccagctcttgcagctgatggctccacatcttgggggaaggctctgatttcatgatgggctgggggcttctcaggatttcacagcccaaatggcgggaccgtccaggggctccaagaccaacaggagcatgtggtagccacgtcacaatccaagaccatggggcatcaggtgagtttatggtcccctcagctcttcccagaggccctgcctcccgtggggctgtaggagcaggggggctggggcccctcgtggggctggtgactggctgagtcccagccagggcctgacctgggacgtcgggttctccatgggctgggagttggtttcctttcctgccctggaggagacagaggcacagggatgggggcccagctcccgcagagcagggcaaagggcagtgtgtccaccgggagtgtgggaaggtgacagtgttgtggggagctctggacaccgcccagtgttctgcactaggggaagggtcttcagaggccctggaagagggaggtttttagggcagcccagtggcctgagcacctctgttgcttccatcaggacaagaaagatctatgtgggcagtgttccccgttaggctgcctcatccggatattgattgacggggtaaggaggcatagggagaccctggctcagggaccttccttgccctgcagtgccctgcttccccagcccgggggtctggctcactcccagcccacagaaggctcaggcgggtccccaaaggacacacaagcaaaaccctctgcccaagaggggtcatcccagggcaatggctggggctcaggcccagcctcatgggcagactgggccaggacccgacttgagagggctcagggaagcctcaagccctgggcaagcccctctctccaggagccacatccccactcaaatgagtgccccccatgaggagcttcaagaccttgtctgacccagcgtcctggagggctcaggcgaccctcatggggaaggtcactgactctggagactgaagccccagtgtgcgcagctcgagccaccagccccagcctggaaggaccaggttctttcacacctgctgtccccacagatctctctcgggctcaccctgcgcctgtgggacgtgtatctggtagaaggcgaacaggcgttgatgccgataacaagaatcgcctttaaggttcagcagagtaagtctacgtgtgcccagcggggcctggggagccctggggtcagaccccgactggcccgagggcagcttcctcacactgtcctcatgatccgctgttctggcccagagggaggtccggccaggtgggctgggcaggacactgtgacaccgagcccatccctcacatgatccggacagggaagtgctcaccacactctcgactttcatctgggtccccagccacagtctcctgtgtatatctggacacctggggtggccacaaaaggatccggcaccgaccagtaggagactgaagtggccacggggtatgagctgtgaccattcccaggtaactcccctggcctgatatccaccctgtccctagagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccaggtgggctccagtgccatgtcccctcccatgtcaccctctggggtagtcagtagtaggggagtgcccgggacccgcaaccctactacctgggccttcctcttcaccttttcttcctcctcttcctcctggactctaagaaagtacaggaggcccaccggtcctcagggcaggcgctcagtgcgtgtatactggacatgctgtgcacgcaggagggggatgtgggcaagaccctccaacaagccccctcccactttccacggtgtctccctctccccctcgcagggccctccaagttactagacgagcccagacccatttgtgggagaccccgcccctccctgcaagcacccacagcctcagagagcagcagaggcccctcactcctgcacgctcctccaaggttgccaggacaagaagcctggagccagggagacaagggaatccgtgtccctgacccacagagcattcagggagagggcacaggcgggaccccgggcccagagccagagccaagagttcagccagaagtgggaacggtcagtcctggcatggactgggcagcccaggagggcagagggtgacccacgtccgggcccaatcacccactgcggagacgggtccccacgtgaggtgacaaggggctgggtgacatccaaggcccctcccacctgagttctgactgggggccgtatcccaggcccaacagccctgggacgaaggtgtgtggcaggaagcccccagccagtctgaaccctgggggcagtcccaggagccacccgccatgccacgacagcttccccacgccaggcagcatgcacccctccctctgggatcagcagactacaggcgtgtcctcggtgtcaggccacgggggccacacagagaccccgaggactccagagacgcaggcaggtggggcccagcccggaaaggcctgcgtgggctcactggagatgctgaccgcgtctgttttcctttcagccaaacccgagcaagggtcgtcggcatccaggcctgtgccggcttcacgtggcgggaagaccctctgcaagggggacaggcaggcccctccaggcccaccagcctggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttgaaatg

SEQ ID NO: 37228 - DNA, 47375 bp, Homo sapiens
ccgaccctctcaggccttttccgcttctcttttacctccccaggtccgcccgtctgcgcccctcacaggaagccggagggtcgctctgatcccgaatctcccacaggcgtgaacctgctctgctgtgtatctttgcggggtggcctgcgctgaggcctgccgcgcgcggtgagtccgcgcagacctgaccctgcgtctcgcagctcggttgaggccgccgccgccttctcgggatgccgcggccggggtccgcgcagcgctgggcggccgtcgcgggccgttgggggtgcaggctgctcgcactgctgctactggtgcctggacccggcggcgcctctgagatcaccttcgagcttcctgacaacgccaagcagtgcttctacgaggacatcgctcagggcaccaagtgcaccctggagttccaggtatcaggggcctagcagtccctgggccccaactcgcggctccaggattgggggtgtaacttgagggatggcactttcctgtccgtgtttccccgttcttaggctaattcaaaaatcgcttctaggtagctgatgcccagcatttgactttcctctaataaaccttgggtgagagatgttaagaccgggtgttaaaatatatgaattccagaaatgctccctttagcatttctttccatctcatttttaaggcctattgaactttcttccttaaaagattcccttaaagaaaatcatttatactctgtagtacccagtgtcaaccctctactctctaatccacacctccaatttaattggatttggagtgctgccaatgtctaacttcattgcttttcagttttaccaatattaggactgttggttaatacggtccttgtcattggaagagctccattacaggttgaacggccatttgccaagggagttgtagaaagaattgctgtgataaatgagaggccccttctgatatttgggattatataaaaaagaaactttaacagaatgtggtttattcggttggttagaacagtctttactgagcttcaattttggttggtaggcgcatttaacatttgagtagctattgaatactaggtgccagtggtacagaagtggtcgaaacagatagggtcactgccatcattcatgattcccctctcaccctgcttttcttaactggtatctgctcattcatcagaactgtgccttaagagcagtaagtaggatccatgaaggaagacttcctttggaaaattattttaagctgaactttaaaggatgagctataaacaccttggtaagggaggagggggaatagcctgtggtagtagtgaacactgagaatttcagggccatagagagaggtccaatatggttgggaataaggagccagagcaagggggtcagcaggggcaggccagatagtgtcttgctgaccatgttaaggatttgtttttcctgaaagtgtaggaagccatcagagggttataagcagttcagtgatatgacgagaatattcttggtagctgcattaataataacttgtgcaggtagagaagtgatggtaagatgttgcagagcggatgtggaaggctgattaggaggttattatggtggtctagacaagaaatgatagtggcttagagtagagtgatagcagtggggtaaatgaaaagtgaaaggattggagagaaggtagtaggtagaatcaacaggacttggtaatgatttggctatagtgggtcagggaggggaggccaaggatgacccttaggcttacttaccttcatggattagcaccaggggacagaaaagaagatagcaggaattgtgataaaaagtataagccgacattttctttgtttgaatttaataaacatttcctggatttttgtgtatgcagactcagtgattagtgctaaggatactactacaatggctaacaaattagcatctgttatgtgtagacagtatgttaagcatttcaggtatgttctcaggaaagcccgatatgaaattgttatagctcttactccttttttactgatgaaactgaggtttagataggctaagaaccaagggcataaaacgtagaagtagctaaatcagtaacgcagtcccaagttaaattcttaaccactttattatactacctcccagagactgactttgatctcagagagcttacacagacatatatagtcataaaatgttaaatgtgacaataaaggtacacactaggtatagtgctggcaggagacagaaggatcatcaggggacatttagctgaggagctgatgttagaggtgagtctgcaagataagtagccgttgctctacaaggcggcagaggagagaagaaggggccccaggcagatatgttcatgacagttccagcaggcctgaaattagcctgagctatattgctaacatttgtgcatggcattgaaaatacactgaataataatagttttgtgactatagttatatttattaatagtcacaaaactattattattagctttaatatgaagctattataatagctttgtgactgtgagtccaagggctttgggggcagtttgtaccagtttgtcaacattatttattggtaacaatgagattgatgatttgctcctggtcttcatgagaccacacccccaacccagagctctgttgttgagactagctgcgtagcaggaatatgcctatgtgaccagcaaaatatttaaaaatgcaatcaggactctattttgggttgcttggttccagggtgttttctttgcacacttgggtggttccagatctgagagagtatatgtctggccacacacctaacaaagggaagccgaaggagcccacacctgaccttttcagatctcttgctgtgaggcagcctttggctgtaatgttttatattcttttccttttggggctcttttcagtcccaagttaaattcttagccactttattatactacctcccagagactgactctgacctcagagagcttacatagacatatatagtcgtataatgttataaactgtagatttataacataacctacagtaataaactgtagatttgcaaacactgtcattttgatccgtgtgattctttagcaaaccctgttgaactgcactgtcagtgcagatgtaaagcaaagacttgttcagagaatttctggtagtctggtattttaggaacatagaacgagtaagggtgtgaataaaagaggttctgaagctacctgggaggaagaacatgtgaatagtataccattgttaagaggtttagatttgtctgcaggccacaggtaattatcaaaaagtttttaagtgattgctcaatggggaatgaggaaagatggggagatgggcaccccttcttcccaggagacattcggcatcattttaggagaagggcagctacctgcatctagtagttagagaccaggtatgctgtttaacgtgtcacagtgcacaggaccatacagcctcctacaacacagaattattcagttcaaaatgggaataatgcgaggttgagaaaccctgagttcgagggagaagatattgggtagtgggaagaccttttaggaagttgtggcaatagtcctgtctggattgtggtttcggaatgcgatgaatttgagaggggcaaaaagattgagagatttgtgtgatcatatggatagatagggacagttagtttgggatgatcctcagtttcaatagtaggtgattggacaggtttaaagggatactgttaagtgagattacttgttttaagtttgatggaagagaagtggggtgatgataagttctggtgctattcggtttgtatgtatgtgtttgattattcagaatacaatggtcaaatacgtataattcagtatagcaaaatgaagttattttcacctggagaaaaagttactgactttttggtgaggatggggattggtaaatccccaattgataagacacttttatatcaaaacattttatctgtatattaacatttacatatttttacagtttcataagtgcataattattttcattagattatcaaaatgatatgtaacatagttcattagtcatcttctctcaagtgagaaaaggtcacacagatccttcttttaaatccaaagtttgacctagaatgtcaggatgctaaccaagagagttcaaggttgaaaataacaatcttgtgctccccaatcacatggtggtttgggaacccttcattcaacccaatgtgtatacgttcactctgttcacctctctgcactccctctttcttcctactcagttctttctcatgtaaggaagcctttctctttaatcctttcccccttttgtctcttacaatacttatccagttaccgcaggaaaaatctctccctcctctgtacaacccaaatggctggaattgtaactgattaagcataagccgtggaaagtagttccacagttctgttcagactcatatcacctacctccaggcttccattcagtatgtttgccattaagtactggctttctagataaacagacttgttgtccttcatgttattttgtttttgctttaatcacaagagtttcaacaatattttatttaatcagttacgtgtctctcctcaaaacaaggttgtaaatgattatatacttttagaatagcccactccgttactcaacttatagtgtagttcaaaacaaaatgtatatcaaattccatataactgactataaaagaacttaataaatgtaatctatttgtaatttggcagtaaaatgagcttaagttctatgatagaagtatgaatggggtgtaatcctaaggattggcctaccttgttacttcactgtgtgtgtgcttggatgatgctaataggaaagtgggttagaaaattttcagaaggaaaatattgcaggcagtaagcttagaggttaagaatatgactttggagttcaagttctgcctttcccacttaatttagatgaacagtcttgaatagttcgcttatttaacatcagtttttcagtctgtcaaatggaaggaaaaaagtatattgtagggttgctgggagaattaagtgatctaatagatctccattaattagcacagttgtctggctagttcaaagtgaataaaagttggagaatacttgttcagtttctgtaaagtttagttgaagtaaaatctcccaagttccatccactggtgaaaatttaaaaagatagtaaaagtcctttgcccatcaccttattgccattttaataggaaatctgattaaatctgattaatttttcacacttttcacagtgatttttcttttttaatctcttacaggtgattactggtggtcactatgatgtagattgtcgattagaagatcctgatggtaaagtgttatacaaagagatgaagaaacagtatgatagttttaccttcacagcctccaaaaatgggacatacaaattttgcttcagcaatgaattttctactttcacacataaaactgtatattttgattttcaagttggagaagacccacctttgtttcctagtgagaaccgagtcagtgctcttacccaggtaaataaaaaaatcagcaatataatgttggtatatttaaaaggaggaaaaaagcataatttaatatcatgcactaactgatgagcatggaattttgagactgacagtctttaaaatctatcttaattcttacatgtaggcatttcacagagaacttcagacttttgtagtgaaaaataatgttgaaagattttatgaacttttaattgtaaagagaaagaagcattaaaataaggaggaagatcactaaggtagaaacatcagtggtaaaagaaggttgggaaggctgagcagtgttccaatcttctgaagcattttctttaatccctgaaggaatgttgctgtcatactcaggaggctggtgtaactggaagcaaaatgatgcctaaattagtagataaataataccatatcatagcctttataccattacttagtgttactcaagctgctgtaacagtaacttgtgctgtaactttaggtgaaatattgaagattaatggtaagtcatctcacaaaaatagttacaaaagctaaattcagatttattttggagacatagagaaagcgtaaaaaatttaaacccagtgaacaactattgcttaggtgatgaggactgttttatttctagttcaaatacagcaaaatccaaaatgcttcaaaatccaaaacttttttttagctccaacctgatgacacaagtggaagattgttacatctgatctcatgacacatcattgaaaatatcatatacagttgccttaaggctgcatgtataaggcatatatgaaacataaatgaatttcatgtctagacctgggttccatcacaaagatatctcattatgtatatgtagacattccaaaatcagaaaaaatctgaaattcaaagcacttctggtcccaaacattttggataagggatactcaacctgtatgggcttagatcgtatctaaaagttactcaattaggcatgaaaaagaattatttaccacttattcgttaacatcttaaactggtattttagtgttcccaggttctatttagtctcttggccaaagtcatggtgaaagaaacagctttaagaatgtgtaaaagccttaattcataaacctgttgttagaattagcaagatatattcaaatactcttaattttagaaatgttctctttattttaaggtcttgtgtgaaggacaccttgctttgtaaaatgatatttctttggggccattaccttaacctgtatccattccttcatgaattttaacttgtataaggtggcttgttctaaaaacctaagtgggtaaatataagaaatgaatggtaataaagcagttagtatcatacccgtctttatccatgctacattttttatttttctcagtcttatttttctactttcaaaaagataatgtatcatataatagggatcattataaagcaacttttcatactttaaaattgaaaattaccagctagtaagttcagaacaaaattaccagctagtaagttcagaacaaaattaccagctagtaatgcagaataaatgataaaagttttactctcaccattttttacctgttgataaaatgatggatttagagtaggcaatgatcagcagtcactactaaaaccattaagtaaaaggctgatggggaactttatactgagtggatcagactgaatgatcattcacaaatggagagataactagacattatgtgccttatcataatatgcagtaagaagtacacaacattgactactagacgttcccacccagaacattgcacctgaattccatcaagtctctagctccaaatgccagtttacaagaaatacagaggataaaggaataacatgggaatgcaatcaacaaaatccaggacgtgggaaatgccacaggataggggttgatggcaaggaaaaaaggaaaaacaaggaagaaagcctaaagattaatgaacacttacatcagccaaatgattgtgttaaccttacttggattcttacttgaaaaccaactttgaaacaataggggaaatttgaacactatttcctgactttaaggaactgttttagattatttcatgtgttataatactattggggttatgtttttaaaaagtgttatcttttagaaataaagtataaaagtatttgtagctgaagtgataaaatatctgagatttgctttaaaaataatcggggaatgtagatgaagcaagattagccatgtgttaatctttgttgacatggtgggggttcattgtacttttctcaatacttttgaatatatatggaagttttcactgtaaaagttttttaaaaatcacatctcaggccaggcgtggtggcttacgcctgtaatcccagcactttgggaggccgaggcgggcggatcatgaggtcagtagttagagaccagcctgaccaacatggtaaaaccctgtttctactaaaaatacaaaaattagctggatgtggtggagtgcacctgtaatcccagctactcaggaggctgaggcaggagaatcacttgaacctaggaggtggaagttgcagtgagccaagattgcgccattgcactccagcctgggtgacagagcgagactccatctcaaaaaaagtcacatctcaaaagttgtagaatgcatgtaatttaatttctgtgattttctctaatccagtagttcttaacccataccccatggacaggcttgaaggagttcctaaatattctgcatttgggtcaactccttgcctttatgtgtactttccaggtgaagaatccttgggcaatatgccattttgagaatatagagaaagcaaatcctagaagcacatctctctctagctcctcatcacaaattaggaatcattttagcacagttttgcaaatttttcattcctaggggcctgaacaaagcaaggacaacaaaaatatttgactcttctaataggttaatgcagtttgttggcctcataatttcttacattttttaaaagcacttttaatagaatattttaataattattcctttcatacttactttggcagaacttcattaaacattattttctaatttctatattccttaactaaaattaaaacaaacttagatttgtttttaaaactcttaatacaggcttgttgcataaaataataataaaacatatattttaccactaggattaagtttgcagcagtagaaaaatattaaaccatggtatacaaaaaaactagtcatttaacctttctcaaaacagatggtataataaatgtataaaaaggcaagctgttatcagctaaaggctcacaaattgattacacagtgaaactgaaacttgcatcctgttgggaacatacatattggtttagttgactggcatgagggaaaaggctgatttaacaaatagataaatgtaaaaaaacaaagtcattcctattctgatagatccctttcagatttaaaagttactaacgattttgatgttgtggctgttttaaacatagttcaaagaactttgactaattcagcttttttttgtactgtgctttgtttatttttatagatatttgggctttgacttatattctcattggtgagctcactgccattttcttcctaattcttctttaaagaacttgggctggaaattctgtagtcaccaaccttagctgataagtatttctgctattgttagcttagtgttccatctgcccccttactgatgccatggctgtgacatctcagttggggaaaacagctgcttcatgagatctctagccttaacagttgtcccagtgaaaatgagcaggggggtttcattgcaaagacaactggcataaatgtatgaatgaatgccagattagtagcatgttagtcaaaagaggaattgagatcaaattgaaagaaaagctgaatatgatagatgaagtctacagaaagtatcacacatactgactgaaaatatttctctgcagatggaatctgcctgtgtttcaattcacgaagctctgaagtctgtcatcgattatcagactcatttccgtttaagagaagctcaaggccgaagccgagcagaggatctaaatacaagagtggcctattggtcagtaggagaagccctcattcttctggtggttagcatagggcaggtatttcttttgaaaagctttttctcagataaaagaaccaccacaactcgtgttggatcataactacgttttgagaattgatgcaccattgccactgtaatattgctgtcctctaattaattttaggtactgaagaacttaatattggcaacatttttaaatccttactcatacacttgttgggagggatgtacaatgcatattcccaaactgtggaaaggacacctttttttatttgtaaaggtggaaaaactttggaactcattttgggctattcatgttaaatattcaacaccaatgatctactctgttcgcagttgtttatatctactcttcgcacactaaactttggtattttgattccttttaaccatttaagactacttttcttataggtagttgatattttaaaaactttagatttaatgtctacatgtgttagggaggaagaaaattgccttttaattgttaataagaaaaccaaatgtgatgaactgtagcccaagccctattctgcactgttcagttttatggaggaaaaataaatctaccataggaatgttagttaatattgatatatcatggtaaaattgatttctcactagcttagaaaatgtcagacttttgtttttggggtttataatttaaaccagctatgctattttttcataaaggcatttgtagtacacagaaaacagtagtttcagtagtgtaaaagagtttatacaggccttaaatatcagactttgtaacaggtagaaatattacagaataatttaagacactacaatgggggcaaatgaaataggaaaatttttagtgagttacacgtactcattacattttcagtgcttttacaaggaaaaaaggtgatatgtttaattttaaaattttaattggctagctcttgcccttatatgactttaatgtctgtgagtcattcccagcttaaattaacaattgttagtattagtctcacacataagtgccatacattttatcctcatggatgtgatgcactgaaaagttagttgctctccttttttcttttttttgtcgtgcatattttatttctgtagtttctggttagctaccctaaagtgatttaaaaatttagaatgctttgtgtttcctatttggtaatcttcattgacttttctttagttaatgagtattaaatagtgcatattctgtagactatagggtttacattgtgttgcatcttataacttgtatagattgagctgattgaaataagattttgttccaagtattatctgatagaatacaagatgattcaaaattatatagatatttaaagcttttctgctgttttttttttttttaattgcaactgcttttctgccgtgcctctcttccctacccaaaagtgatgagttctgaacaagacaagactgtcatattgtagagactttggtatgtgataccatagaatactgattggatagccatcctagtcacttaccaatactgactagaagttaactcttaattctaagctatcttaaaatgcatatatatacttcttgcatggaagagcaaaacaaattcaagttgtcatgcctgataatttcagatgccaccgtatagcaaagggtgaacatgttttcaaccctttaactttttacggtgtttgaagaccagctactccttaatatttatcaatggattaagaagtttaagattttgcagatttatcaatttgggtttttgtactgaagttgtcttgcggctttgcaagtgtccctttatatttaaatttgaaagttgtaagcactgatgttaatgtgattgatcagcatgggcatatgtaaaatgtccttttctggttgcctctctatgctattgtgttcagatacttacaccataattaaacagtaagttatagacttgctgagtttggcatagatagtgcactcatttaatctgtgcctctcaaaacttcagaatattagcatattaccacaaataatttttggtgaaactattgagatattaaaatttttgaaatcactactgttacctgttatagaaaatagtgttggcttagtctagtctctgtgtaactggttacattttgatggttgtctatactcaactggatatgtgtatgtaaattagaaaatacatacctatccagacataaatgctaagtaacatttttttcttcctccaactacataatttgtagctcatcatttttccttaatcctttcctaacttgttgcagcagtttgaatttcccagatatttatgtttgaacataatggctcagaatacatatttgaacatcatagttgtatatatttttaaagtagaataaataatggaaagcaacttgatatacaagtttatactaaaatttcaactgtgtgaagatacattttaaggcattactttgctaataatctacacattcttttttctattaaataaacaaatggtttgtggttcacagctttcatccaagcttggtgataatcaattttgaaaatacagtggactgaaaagcaaatttattctttcgaagatttcatttaaatctctgtactatgcatttttgtttcagtttgtaaatgtgtaacatttatagttaaataggacaaagcaggccctatgactattgttttcaaaaaattaatatataaataattcagaggggtttttcatttacttttgaaaagaaatttctttaacaggattgcacctatcaatttcttgtagaataaaaaaaaatctttcaacaaactgactttacttgtttctgtcaggatttaaatctttctaaagctccttataaacttaaagcctagagtacagttctgtaatgagagtgattatttatttggtattttattaaaatatctgagggactgtccaagaaagaaggtgaaagagaaataccacgtctgtactgcctaatttgtaaccttctctttgcattccttactgaaagtttgtgtaggtgaaaagcagttaaatcatcagttgctctaaagaggtcttaatttttaagtaaattacctttagtttgtatattacccagttgtatcagtgtttttcttaataatgtagtcagaggggacagtctggttcctgggcataattctccaaaaacaacagggaaataactataaatataggttaacatttattgaatgcctaccttgtgctaggtgctgtgctgagtatttgtattgacacatttaatctttgcaatgattctatgaaataaaggtattatttccattttacagatgaggaaactgaggaatagaggggttaagaaatctcatatcacacagtatattagcagagtttgaatatgaaccatagcagtctggctccagagccctctttctcaagcactatgcaatattgccttacaaaaaaccaattaaggatagatctctgaaggcttagctatcttgatttcactacagctcagtagcagttcagtgctttggctttggagtcacagccaagttcaagtcatggttgtgtgactttggattttattaactatatatttctgttttccatctgctgctaaggtgatgccatctggtataatgagaatgaaatgagatgtttattaaacactgaggatcagtgcctagcatatacaagcacttagtaattatatttttatcattagtctaattctggtctcttgatctttctttagttcctaaagtccttactatggtttctattcatgtggctcttacatgaacaatacatgacacaaatatgatagtgtttgaatgtctgtcatgcacataatagtctgctagaaatttcgaaaatgaataagactggctgggcacggtggctcatgcctgtaatcccagcactgttagaggtcaaggcgggcagatcacctgaggtccggcattcaagaccagcctggccaacatggtgaaaccctgtctctactaaaaatacaaaaaatagtggggcatggtggcgcattcctgtaatctcagctactcgggaggctgagacaggagaatcacttgaacccgggaggcagaggttgcagtgagccgagactgcaccactgcagtccagcctgggcaacagagcgggactcggtctcaaaaaaaaaaaaaaatgaataagacagtagtctcacctccaggaacataacctagatggtgtagataggatagctgtatgagcaactaatgttacacaggtaatgaagcagagtggactctaagggtctaagatatttacagggtgctagaggaagaagagaatatataggtccaaagacttatttcttagggagttttacatcatctccccacagcagaagccctggttatgtgactatgccagtaattgagtggtttaatctccagtttagggatatgggtattaaccagtccctgttgctacagattgaaagacatattctttaattttgctaacaataaaggtgatgtttgatctcctgagtaacttctccatctcaggagtttccaaattctggaggaaaatacaaggatgttatcctatttttatcattaggaatcagcttccttgctgaaatttagatacaaaagtgacactggtctggcatactctgtttttagtgctggatgattcctaatgatcactactattttgaaaaggcaacagcataagaatttgattaataatgaatggttcaaagaacaaagtctacccagaatttcatcattcgttttggtgtatttcagttatttttatagatatttgtgtattgtttaaagaaattggtattgtactgtctataacaaatttttacacttttacatttgtgaaatctatcatatagaagagagcattcagcatgtacaatttaatgagaaataaagttataaaacagatactcatatacccaatgctcaggttaagaaatgtacattgccaataccttagtaagctcctatgtatcctttcctggtcagtttcctgaatcaccccaagagagagaaccaatattctgcttgtaatgcaaataatcttttctttgtatttttaccaattaagtatactggttgtcacactttttaaaacataatttctaaaccatcataaaatgatacttttgtaaatacaaaatcatgtacttgaatgcattggcactgtcagtttactatcagcatttctaaatgtttatgcatgtttgctcactttatgtgcttatctctccatcagccaatgacagttgatcaatatgggatcaatatgggaccacacttcgagtagtactgatgtctacattccttaaaaatagtctaaacaggtagaagtaaacattaataaaatttaataaagtattaaattctatttaataaatagaaatgtcactttttttgtgacttgctgaacatttagtgccatccctgatgatgcatatggctatagtttttgttactgtgtttattattaacataccaccactatgtatttcttccatgaaggcatttggatcattctaccttttttgctattttgaacaaagccattatgaacattcttgtgtatatatgtcaggttgtacatgtgtatgatctcttgagaatacatccagcaatggaattggtgggtcataggatatgtatatcttcaaattaactaggtaatacctaacttttccaaagtaattagtgctttcaccagcagcattaaaaggttccacatttggtattgttagactaaaactttggaaaatctaggcttgtaatggtacctcgttgcttaatttgcatttccatgaggttaattattttttctacaaatttatttaccatttggatttcccctttttgcaaagttgctgtttaaatcatttgcccatttttaaaaattttattgactttttggttaataaaattccttcatatactgagactacttaatcatttggtaataactatttcaaatatcttctcacagttatttatcgttctgctcctagtgaaatgtatccatctttttctctattttttggtgtttttgtgtcttatttaaaaaatacttccctctccttaggtcatgaatatcttctgtactgtgttctaaaatatgtgtagttttgtcttccactcaaattgaattttgttttgtgggtgaggtaggtatccaggttctttttttttcccttgtttcttgaaaagtcatctttctcatttggttgaacatgccatttctgtcatctgtgaaatgctcatatttacatgagtctatttctgggctctcttttattccattgatcaatttgcccatatatcagtaacacactgtcttaactactaaagcttttaaaagtcttgatatttggtaaaataagtctttttataccttgttcttcaagattttggctgtgatcagttctttgcacttttatacaaattttagaatttcaacaaaacaaaattgttaggattttgattgggattgtattgtatctgtgaacaaattctttatagtagtgcattttttggtgagttaatgttgtctttccattgtatctttgaataaagtcttaaaattttcttcatagaaatactgcatacatatattttgttaatcttatatctttttgtttttgatgctatcataaatgatatcttttaagtttttaattttttgttcgtatgtggggatactttttaaattgatttttctattcaaccttgcaaaaatcttttttaaagtttagtaatttatctgtagattcttttggactttctataagtaatgacaaatttgtctttctattgtccttttctttttcttgcctaattaaatttgcagggacctccagtataatgttgaataggtcatgtgtaggcattcttgttttgttcctgttctctgggaatgctttcaaagtattctctaagcattttatgatacttttattaaatttagaaatttcccacctattcttatttgctaagagttttttataatcataaatgatataaaattttgaattttcaaaaagctctattgagaaaaatcatgatttttctgcctttattctctgaatgtagtcagttacatgaactggattcctattattaagccaaccttctcttcctagggtaaaaaaaacctggccacgatgtggtttgactgcttttaatagctggatttgttttaagatttttgcttaatatcaaggctgttttagccttataaagtgatttggaaactggctttcttttcttgttttctgggagagcttgtatataacatttacattacttcttccttgaatgtttattagaaatcataggtgaagtgtgtttggggcctggtgtcttctttatgggatgctgattcaatttctttttattaataaggttcagcttttctgttgtgtaatattggtagattgcatattcctatgtatctttccattacgtctacactttcaaatttgttagcactgtgtttttcctgtacacttaacatgtgccagatctgtaaggatggtaccctttgtattgcttatattgcatctgagattgtttgtatcttttttccttgactagtcttgctagaggtttatcatatttattgtttttgctttacaaagaagccaatatttttgtttttcttctttgttatattttctctattttgttgatttcagctttttcttttctatgttaatatgtcatattattgtagtggatggttagctcttcaaattttcaactttctattctgatttacatatttaaagctatagatttccatgataatgctactttatctcttgcgttagttttctatgctgggtaacaaattaccacaggtttactggtttataacagcataattttattatctcacaatttcttggggttaagagtttcagcatggcttaactgggtcctctgtttagggtctcacaaggctgcagtgaagtcagctgaactgcattgtcatctggagctcacagttctcttctaaattaatcagattgttgataaaacttagttccttgaagctgtagaactgaggtcctcagctacttagggctgctcttttatataagcagtgtaacgtgacatgcctttttaaggtcagcagaacttctgactagaatctgtttcagagaaggccagaaagagttcacttggttaggtcagagtcacctgggatagtctcccttttgattaagtcagagtcaactaaataggcaccttaattgcatctgcaaaatcctttcacttttgccatattctcttactaaatgtaacaggcgttgtccacacaaaggtatggatatggggcttggaaaggatttcaggaaccatcttagaattctgcctactactaactccattctacaagtctcaatatctagcattttagttattcactaactgcaaagttttttatttcattatcattactactttgatccatagatactatttggaactataatttccaaacatgaatatttaagttttcctttattgttgatttttaacataattgaattgtgatcagatgatatattctctatatgatttaaattctttgaaatgtgttaacagttgctttatgacataataagtggctggtttttataaattttaggatgcttgaaaagagttctacagttatttatgttcattaatcattttagtcatgttcattaattttcaagtcttcagtatccttagtgatgatttttttgtttttggtatatatctcttgattactaagagaattgtgttaaaatgtagctagcatgattttagatgtgtttgtgtgattctttcaatttctctctttttctattttgtattgggatacaaatgtataattgttatattttccaggttaattgaaagaagctttatcattacaaaattatctttatttccactaataaattttgccttaaaattaattttatttgatattaatgtagctataccagctttcgtttggctagcacttgtgtcgtatatcattttccacagttttactttcagtctttgtgtatatttagtttttagaggtgtctcgtttatatcatattgttgttactattagtatgtgtcctatctgttctatgttcctttttttctactttttttttgatagttttgtttttgttactcctttttttcttctacctatcagatgggatgttgtatatatttctgttcatggttgttctagaaatttcattatgcatctctgacttatcaacgcctaaactcgcccagacttctgcgcagtgcagtagccttagaacactttaatcccatttactttcctcccagcttatatatgtggttgtcacatatgttgtatctctttaaatgtaagttattactgttgttttatatagttaatattgacttagatttacccacaaatttgccacctttcttactctccattccttgctgtgtctttgagcttccatctggagtaatttttcttttgcctgagtatatgtttagaatttactttagtgcaggtcacctggtggcacatttactttgctcttgttttttgaaatgtcgttattttgccttctttttgaaggactttttttttctcccttgaaatggatggttatctggaaaggtaaagataactttcccttgtattctgacttccactgttactgggaagaagtcacctgtcagtcttttgctccatttagactaatccatttttttttcctctggctgctttcacgattttctctttgtaattataattttttttttttgagtttcattgtgttgtatatacgtgaggattttattgtattttcccacttaggctttgtttggcatcttagatctgtgggttgatacatcagttctggaaaattctcaaccatcattgatttgttcaaattttgtttagaatcttacatctatatccatgagcgatgttggtctttagttttctgtttttgtaatgtcttttgtctgattagtatgatactaatgctggcttaatagaatgatttcagaagtattccctccttttgaatttttttgaagagtatgtgtaggattggtatcatttcttccttaaatgttttggtagagttcaccattgaagtcacctggacatgaagttttctttttcggaacatttttcactacaccttaatttctttgatagatttagggcttttaaaataatctgtttcatcttgactgtttggcttttaaggattttttccatttcatataaattgttgaatttgctggcataaagttgttcataatctttccttagtaaccttttaataactggaatgtcatgtccctctctcatttctaatattggtaatttgcatctgctctcttttttcttgacttatctggctagaagtttattgattttgaacgtcctagtaaaccatcttttggttttatttctgggggaataaagtaccataatcaagcttagtaatccttcttcttaccttcctccaggattttgactagatgggattctttgtctaatgaagtgacctaaaccttcatttctacagaattgagccgttgataggcctgtctttactgggttgctgcagttttccactgactaggactgttagcactaagaggcattccagtgaatttcctcgtttccatatatagcctatatagccttcttgtttccattgtaaaacagaaacacagttttcctctgataactggaattagctaccctggccagtccattgagctgcttttctgttactttaatggcatgaggaacctcaaaaggccagggccagtctcggctcctaaatcatcaaaacatgattatttttcctgaaggaagtgttctactcttggactctagaatttctaaacccaccaagcccaacattttgggaatgggaagcaaaaattattcacgtagattcttaggtatactattgaacagaaacactccttctaccctttggctctgagacctgtgcatcctgatagtggggagacagctccatatattgactgcttattaaattaatgtaccacattctataggacaccaccctaccttttcatgatgttgcctcccagatatctctgtaaccgagctctcattttgccactcagctgttctatcaagctagttactttaggagataagcatgtgttaaaaccattgaattcacttccattgccataaactgtgtacctggttggaagaaatgtttttgggattcctatgcaatggataaaaccttcagaaatgtcaagaatattagtgccagtggaaacactgcaggcagagaatgcagatttataccttgaatgtgaattatctttgtgaagacaaagtgctacctatttcttatggaaattgcccaatgtaaccatcatgttaccgggttgccagcaagtctcattgacagtaatgccatattaggaacccagccttggaaatgtagtcacactccacgttgttgccaggttgggcattcggcaatgatagtagccaaataatgtaggtaaggagaagaccatactattgaacctctgtcactgctttgatagccacttggtacatgggcccattaaccaagccctgggttggctggagaaaaagactgacatctaccagacaattcatcttgttccgcttattattgaaaatcttctccacctgatgcatcctgttaggcacttatgggggatatgaatatcttcacatgccctcaccactccaagagggttatctgtaagtctcacggacagatcttttacaaattttccattttgttctttccaagaacctaaaagctggacaatccattagacactgcctgtaagtcagtatatttatcagtttgtcatgtcgtcccctcctttcttgaatgtgaataaccaggtatgtagctagaaattgcccactaggaagattcgctgtccccattagcaatgcacggatctgaaattgtctcacttctttacatatctgtctgtctcccagattagactataaaatctccatgagaactaggactgtgtctcctgttcgcacaatatccctaatgtctagcacatagaatatattctaaacatatgtggcgtaagtgattgatgcattttcttgaacatttggagagaaaatgttaagcaattaaacttgtaaccaatttaagattttttttagtacatgtgactgtattatgaagaacaatgcaaaatttggagcaatttacaagaagatggaacagttcaagtaaatttgcccatgacactagtgacttcaggctcttttatgtatgcaacctaagtgatgaatagggaagtacgtgtttatggaatctgtcattggtggtatttcagtgggaaaatgtgaaaagctctgattttgaagggttgccagagaaagaggaacaggcagaggaaactgaaagaagaattttttttttttttttttttttttgagacggagtctcactctgtggcccaggctggagtgcagtggcgcgatctcggctcactgcaagctccgcctcccgggttcaagccattctcctgcctcaccctcccaagtagctgggactacaggcagctgccaccactcccggctaattttttgtattttttagtagagacggggtttcaccgtgttagccaggatggtctcgatctcctgacctcgtgattcacccgcctcggcctcccaacaggcctgaaagaattttaacaagcaggatgagcataaaggcaaagtggggttgtcaacatcaaggaaacagagtgttgggaaacaatggtcgactttgtcaatcgccaaagagactcccaggaaaaatgagggcaacaaaagtatcagttggatttaggaggccactgcttacccaaagagttcaggtagaattgttgggaggtgcagtggttggagaatcaactccgtgaataatgaattgtgttgacacggtacataatacggtatttctgactacattggcggcatttcactaagtaattactacctgaagtgcctaccttcagtaaggcatcctgttgttggatggggaaagagaaggaggaaataactcttagctttacctgtactgtgcttctgagacccaggtatggaccttcactcccaatttactatccatggtctcatccgatgttcagtaactgggttctcctttggcagggagtagggattgcctgagaattaaaaggggaggggagatttctgaactggacctcttaggttatgactagattgggtgcctgaggcagcaatggggctttataaggcttctttacgcttcatttaactaattgcttttttgttctctcttattcagtggagttccaatctgttcggttgtggagaacgaacctgagaaaaaggatctttcgcagggtagtttttgggggcagaggctgatgtgctgcaccccctaatcaggggtatggttggctgcagtagtcaagtgagagggccgcaaagggaaaggaaaagtcgagactatcttagggaaccaggagagtcgctgtacctctgaaagatctacggtttgtctggtctgtaaggagcaaacacggtggaattcctttccagatttttctgggcctcgacctctggcttttggggtacatgccaaaaaaaaaaaaaaaaaaaaaagcgcagggagagtccactagcctcggtgacagttccccattgcggtttcccctcctccacccttctttgcgagctccttccctctgcagagagttatcccgccacattaacccctgactcacagctggaccgccccggcccgcagcgccacgtcccgggtggggcctgccacggcaaagcagcagtccggcctcgagcggcccctcgggggcggcggggtgggcgccaacagcagtcaggcctgacaagcggcgacctccaagggtgaggcctctgcgggcccccgactcacgcgcgtccgggctctgcaagcgcggtggggagcaggctgctgtggtcgcggggactgggttgcggcgcgccgcgtacgggacggccccaaactctcgacgcccggggcaagacgcccaccccctgggcgctctcgctgggccagaaaggaagacagaaaagccgcgggctgactgtggtggcgctcgcctgcaggcaagtaccgggcgctagggcgggggccgccgccgggggcgcggggtgggctggggccaggccgccaggggcgcggggtggtctgggggccaggccgcctgcgctacctccccagcctacccgacccgacggcgcgggtgctggcgctgttgtccccagcggggcgggcaggcctttccgtcacttggcttactctgaagggaaaatccacacagctgtctgcctttttgtttcattttgactagaaaacccattttcgaaaagacacctcagaaccataagcaaatagcccagagtcttaaatgctctaaaggctctgcatgagcccctgccaggcacacagagccagtgctggaggttttggcatgggttttcctacttggctttttgtgcaaagctaatttggataaaaataatttgactggcagctgtgagctagttttcagtgtattaggacctctccagctttccacggtagtaaacttcttaaagaaagtattttaaaatattctcatatttattattattttttaatttatccttttaattttgaaaagcaagggtgggaaaggctatatgatctggaggtaaaaatacaccattatatagagttgaagtgtcatcccctgaacccacattgcacgtctacacaggagaagaacttgtccttctccaagtgtttagtattccttagattagtgtttttcaaacaagcctgatggtaagacgcatttgggacttttgtttaaaatgcatccccccacctctgaaggtttaatttggtaagcttgatttccagaatctgtatttctatttttttattgtttaatttaattttatgttctgggatacatgtgcaggacttgcaggtttgttacatagataaacgtgtgccatggtggtttgctgcacctatcagcccatcaatccttacattttaatattttgaagtagtaggatggttataaatggagttaagcaactccactttatatctcattcaaatcagaaaatagataagcaggtatagaatattgacacctacatttgaagcaaagtaaatgtgacatgtacgccttaccgtatggaacttgaagtataaaccatgtttacactgttgaatcatgggcatctgtgttgagtcatttgttccttatgctattcttaaaatgtattcatttaacaaatatctgctgttaaatcttctgtctttaatcccccctagaccacacatcccattctaggtcccgctcccctactttgcttctttttataacaaacaaaaatcctctttgaaagatttaatctaagtctccattttcattttccctgtttcttcctaccccctctcatctgaggctttttgtccccattaccccctgcatggtcctgatgttgccaatgactgtcttgtgaaatccagtgtctgtgcacagttctcatctttcctgacccctcagtaacatttgatcactccctcctcaatattcttttttcttcactaatgttcttcactaatattctttcttcttcacttggcttccaggtcaccatattctgcatttcattctgcttcattgtgtctccaggcttccccaccactaaatcttagtatgccacagagttcatttcttggccatatttttctagccatactttcccccaggacaatttgtatcccaagccatattccttggctataaataatatctatcagctgatgacttccaaaattttattcctagctttagttcgcttctgagctccagatgtatgtgtatgtccagctgtttactcagcatctccacttggaagtctgataggcatttaaatttagtatggacagatagaactactgatgccagattcaccaagttctccctctgtttcccctcagctccctcccttatctcaataaacagcctcagttactgccattcaagtaggccggaattctaggaatttactcttgacttctctttttaggtcagactccgcatccaagcatccaacaaaatctgttgactctacccagatctgcccacctctctctccctctctaagctaagccacagtcctctcctacctacatgattgagaagtctctgcctctgcccttgctcctctacagtcttttccaaatagcagtgatttttgtcatacatactcagaactttcatttcccttcaaaaccttctggtggcttcttatcagaatcacaaaaaaaaagaaagaaaaaaaaaagaaaagaaaaacaggcttacaatggctttaaagccctgtgtgatctagtccctgactagttctctgaactcatctcctgacttccctctcatccactccactgtagtaacactgattgtgctgctgttgcctttgcctgcagctggtgtctgctagaccattgcacactgtactccctcacttctctgttagcatgctgcctcaggggttactgtgctattgcagcaagatctcttttgctgctgggcctgtgcggtaggttgctattaaatactgaatgctactctctagtattccatgaagcttatggaacctttaaaacattgttggttgcttgagttccctaatattaaaaatgcacaaccatttttcttttgagcctaattttgataagatggacagtttgcctttaagttctatgtttttataaaatctcttcctgatttggagatttgccctttaccatcagttttcatttttagatacagaaaatggaagaaaaatatccagttcactaaaaagaatatgtaataatatttggtggggggcagttactttgcccccctccccccaccaataggggcaataggaaataggaagcaataatctaacatttggagactctttgaatggtaccagcagcaggtagtttatgggaagaagaaaaataaagacacttgttcagagaataatatacaagtttctaagttctgcagtgactaagccaatgtcagagttgtgaagattttataagatattatataaattgaacttttttttttttttttttgagacaaggtcttgctatgttgcccaggctggtcttaaactcacaggctcaagcaattttcccacctcaacctcccaaatagctgggcctagaggcacataccactgcatctggctccagttctcttttgaggactatgtagaaatgaaaaacaatattttcatctttatgaagaggtgtagcaactaaaagattgtttaatttataatccttatttctcattttaatctcaaggaactggttctgttatcagtagcgtatgtactatcaccccttcttgtaaaagaaaagaagaaaattccttcttatttcagaattaggatttaagatactttaataaatatttccaatataagattaaattaaattaaataataagtagatttggaatatcgaacagagagaagagtaggggggttaagcagaaactaggagtgaagttattaatagtatcaaaacacttgccataagcttctgtctgttggccagagcactcattaacgtggagcttcctagcaactgagtgaagagatagggtccacaagatgaaaaagcagtgcccaggtgaagatcggatagaagcatttttttaaacatttacttgctcaaggacctgttttaggtacgatgaagatgaatgttctgtcctttggtacttaagaagagtgttggagaagccctgtttggtttagagttagcaaacccatgctcttggaatatttgcatataaataaaaaacagatgaaatagagctaaacctggagataggctaaactcatttggaacgtagagatagagcatgtaaggaagacacttaccaaaggtgttggaaaagatatatataaggaagatactatttagatggaaatcaaatcaacataattgacataattgttgacaattattgacctaattgatatttataaaaatataaagcctagaaaatgaatttttatttactaaaaaactattttttcagactgtgtgatcattgttcaaaaggtgaacatgtatgtgtatatatgtgtacatgtgaagaacacgtgagttcttcacatatatatgaaggaatacatatatatacacatttatatattcttatgcatataccattcacagaggatcaatgttacctttttggtattcacttggcccatgaacaacatgggtttgtattatgtgggtcccctcatatgtggattttctccaacaaaacatggatcaaaaatgcggtattccaggatgcaaaacccacacatacggagggctgactttttgtatacgcaggctctgcaggctgactgtgggacttgagtattcttggattttggtatatgcaggggtcctggaacccctggaatcagtcttccctacccttaagtataccaagagacgacagtacttctttctaatctattttctctgcattttgtttaacaaagctgagatcatattctgtatactattttacagtcagttccttttctttaattacatttcattttcgtgtcatgagaagcgtttttctcatgtcattaaaattgttcataacattcataaacatttttaatggtttaataggattcgatcatatgaataatgtgacatagttaatattatcattccccagtttttggatatttttatttttacctccaatggaattttgactagcttatgattgtacaagatctcttatgataataaaatatagtcatataactcatacttcaaatatgccagaaaatatctccatagattgcatgacaagagaaagctaagccagtttgagaaactgacaaaaaggtctgtcaacctaaataacagagggagatagaggctctctaaaagaaagtaatatttattcagaaatgggcgttgcagtgggaatatgtgtgccatagtaaattgtgtgtactcagggaagtaaaggcagacaaagattttcaaagtaaaaatgaggaggtttacataattgttttgagataattatttttggcttgtgggtaaataacaagggtggcaccagtctgaaattggacaggaagttgctgggcagttgttcttgcagaagtactttttatataggactgtgatggcatttgtgcaaggttctgtttttgtttgtttgtttgtttgtttttgagacggagtctcactgtctcccaggctggagtgtgcagtggcgtgatctcggctcactgcaagctccacctcctaggttcacgccattctcctgcctcagcctcccgagtagctgggactacaggcacccgccaccacgccaggctaattttttgcatttttagtagagacggggtttcaccatgttagtcaggatggtcttgatctcctgacctcatgatccacccaccttggcctcccaaagtgctgggattacaggcgtgagccaccgcgcccagccaaggttctggtttttggggagacttttatgatagttctggttactaggcatttatatttaagaacctttccttcatggcctttcctggctctgattgtccggttttttaacactagtaactccactttgattctgacaactcttacagacccataaagacccatgtgcagggagctggaggaacaaagtggagaaaagcatgagatgaggttgaagctgaaggagccaggctatgcagggtattatttgtcatatcaagaaatttttatatcaagcacagtaggaagccaatgcagggttataaatgggagtaactcaaatcagatgttttgaaagatcatcctggctgttgagtggagaatggattagactgattgagagtaggggaccaattaggaggcagtgcagaagaccaggatagagacattgatctagaatgaaaatgtggtagagaggaaacttgaaacaatttgagattatctgttagagttagatacacaggacttggtgatcacttggaagtgcaggaataggagagtaagaggaaggtatcaaggataccccaggttttgggtaataacaggacaaatgataatgccttttaccatgatggagaagtctgggaaaatgaggtgcaagctaccttccaggtcagcaagtaagacaaattaagagtgctgggcaatacatattataagagatgtgaaccagatattatggatatacagaggatgagtacttaattcaacttggagataaaaggaaatgcaatccttgagtagtgtcttgaatcataaagaggagctattcatgtagatggttgggcaagggtacattctaagatggagcatggaggcaacaacatgacatttgggaaaaccgtaaataggtggatattagaactctcaagagtaacatggtaggagcaaattttatggataaaaggagagattggatcataaagggcctagaatgttattctaataagatagagtttttcttgaaggcattagggtattatcaaagggatctttaagcaagagaaaaacaggatcagttttccattgcagaaagatctatctagaaatgatgtaaagggaaagagactggaggcaatgaaactagttggatattatgggaatttgtaatcctctaaggaggaataatataggtcttgaactaaagcataggcagggaatggagagaatgggaaaagagacagatatgtttaggaggcagactaaacatatctattagcaggacttaaagtttagtgggtggagttgtggggagggtttgtttgaatgggtgaaagaatatgagaataatttgtaggtttccgtcgtaatcggtagagaggatattagtatcattgaccaaggcagagaagattgaggaggaaagattgattgactgattgattgattgattgatccatctgtctgtccatctgtccatttaccctgtgcttattgagtacctattatggcccaggtactattcgcttgacccagtaagcaaactttggtcaacagagggaatgactgtaccaagcccagtttgatatctatcactcatattagttcttgtggcccagcctctattggaatcatgtcagaatagtgtgcagagtcaggggtgctacaaacctagagaagggagtgctgtttggaaacaactcacagactgaattgagtctgtatccatcatctcagatggggatgagcttgtctcctaaaaaaaaatctcctaaagtcatgatacgcctttagccagcatttatttcagttcatccaattgtaagtcagtcctcctcccaggctgcaagggtatttatggtgccttcttaatgccaaaggattttcaccaattcctaattgcctgctatttgtatcctctttttctgtggtcatttcttgaaagtacttttagccaaaacatctatcatatattttttttctaacaggtctagccactgtcacttttatgtctttgttatgcatgaaaactgtttgctagaaaacaacattttggcaaacagtataaacaccttgtcaagctgccattcagactgaggaaaacttagtaagttgaataattttgtatttcttggctgagagccaatgacagaacttagtctcctaagctgactgatctactagcaaaaaatgtataactctgctatttggcgtttaaacacacatacttacatacatttatttatttaaaagtataaaaagacatctaagacaaacagtgctctcatgaattgtattgcataggaaagcacacaaccatatgtgtgtttgggtgtatgtgaatatgtatgtatacatacacacagtttaaagcaagcatatgcaaagatgcacagattcagtataatttgaacacagaattgggatcatactgtaagtattgtaatatattttaatttgatcatttttaaaaattaagtaagtagataatgttacaaaggtcattttagtcagaggaatcacatttcaggcatggatgaagttacagagctggaaaggctggacatcctggcagaagagaaaaggaccaagcatgatactcatatttttgaaaattgtttttatatagtaataacatagaacacaaaagcgcatagagcaaagtatatagttgaataaataaaaaaacaatcaaccatgtaatcattttctggtctacaatcatttttcctaaagattttcttttcctcactactctgcagtacctcttttgttgtacatcgtgtccatatatgtttggatctgtttcagagctccttatcccatccctttagcaatttgtctaacattttgctgtattaccttgtcttcactgttgtaactttatagtaagtgttgatgcccaatagaacaagtcctcccatcttattcttccaagtgtattgactattcttactctttatatttccatagaaattctggaattgaaccggtaaaacccaaccaaaaaaagtcttgttgagattttgattgttattgcattgaatctatatatcaatttagagagaattgacatctttactatattgaatatttcaagtaataaacatgatatatatgtgcatttatttagtactttccttttatattttatctcactaatatttctgtgtggaaatcttgccccttttttggttagatatatgcccaactatttgatattttttgatctattggaaaatgacattttttttgtaattttatcttttatctttgttattggtattcaaaaatacagttgaattgtttatgttgatcttattatatccattttcttgctaaacttgcttatcttttagtagttttggtaatttttaaaatttttggatgatagaagactcttttatttccagtttgctaagagtttttataatgaatggatgttgaattttatcaaaatatttttatttttaattgtcaatgtgattacttacattgatttttgttttaaatttttgagatagaatctcattctctcgcccaggctagagtgcagtgacaggatctcggctcactgcaacctccgcctcctgggttcaagcaattctcttgcctcacccacctgagtagctgggattacaggcatgcggcaccacacctagctaatttttgtattttagtagaggtggggttttgccatgttggccaggctggtcgtgaactcctggcctcaaaatgagccacccaccttggcctcccaaagtgttgggattacaggcgtgagccaccacacccagccacatcaatcaatttttacttgtcagatcaaccttgcattcctaaaataaacccaacttggttgtgatggattatcctttttttaaaaaggatccatttttctaacattttgtttgtgatttttgaagtaataatcatgagttagactgatctataattttcctttttgtaatattcgcatcagttcttggtgtcatggttatgctggcctcataaacatgagttggggaatgtttcctcttttttaatcttctagttttattatttttttctttacatatttggctactatttgaacctggatttttctttttggggagatttccaattatgaatttatatctttaataataattgagagagagggttaggaagaatagctagtgggtgctggccttaatacctaggtgatgggatgatctgtgcagcaaaccatcatggcacacatttacctatgtagtaatcctgcacatcctgtaaatgtacctctgaagttaaaagttgaagaaaaaaataattgaattcaggttatttcttctgtgtctgttttgagaaattgtctatttcttggaatgtgtttatttcgtctcagctttcacttgcgtttatatatgattggtcataatctttttattacattttacggtctgcaagatcatcactgagatcccattttcatttctgacattggttatttgtgctttcttttactttgtatatgactctagattagcagctattttctttcatcacgttaaagctatcattatttctcttgagaaacattcttattgttgcatcttttaaggtaatctattttctcttgctgtttttaagacttttttctttgctattggctcttagcagttttactgtgttgaagctagatgtggttttctttttatttattttccttgaagttcataggacttttaaaaatgtgtgatctgatgtttttcttcaatattgcaaagtctttacattatctcttaaattactgctttgctttaattctctctcttttcatttgggactccaatttacacatttgttacaccttctaattgtatagttgttctgtgtagcttttacctgctttcttgtattttactttctttttttgtttctctcccttattctgaagggttttttttctagcttgttttctagttcatgagttccttctgctgctgatctaatctaatgataaatccatccattcaattcttaatttcaactattatatttttcaattttagatttttttcttacctgccatgcctttttttaaagtttgcagttatctgacaaaattctcaatctttcctcctcttgtgcaatcacagttattaataaaagtttgaaatccacatagatttatttctattgtcagctgcgtttgctggctttcttgtcttcttccagagaggatttaatttttgcttgtgccgggttcctggcagcactaacaatctgtgatcactttaatctgatttcagagatggcagttattaaaaagaatgcttccattcctgggaggatcagtctgtttttagatcactcgtacacctaggtgtagccttcagggtcccaacccaaagcacacaactggagtcacacttttgtctcattaaccatgaggggcaaaaagcacagcactagctttcctcttctgaaattgaaaaatactctagggggagagtcgtctctgggtttctgtcttctggatttgggttctataattcttcactatgtcattagttctctgatgcttcaagcctattttttttttctattttgtctagcttttctagttatcctcagcagtagcattgatccaaattacctagtccaccagtactagaagtggaagctgcaaatagccccattttgatatttgagaaacaggccaagaaagagcatttagtaaaggagactgagaaggaggagatgagagagagagactgacacatgatggtatagttaaatggatcttgggaaatgcctttagtgactttaaagccataatagagagttaaataacttttcataggagttatttcctctttcctttgtagcctatatctttggaatagaaagaaaggtaagatgatagttctaaagggaaagatattaaataagtacgacatgcaagtaaaagcaggagagcaaaagtacaaacagaagaacctgaaaaatcttaaagaaaattgattgtcagcagctcagacatctgtatacatctgtagctaatagataggatatggatgggtaataaagaaagtgaacttgagtttttaatacaatgtatcccctgaaaggatttcccttcaatttagaaaatgtacattaatattgctttctatcaataagacaaccaacttgtacagaaatttctgaatccaggtatgggaagcactgtggaaaggtttcatatttcatttcttcatagttagataatggtccttttgtctactttgtaatcttttctgttttccatattatgtataatgcatatgtcatatttatattcacgtaactttttcttttttgagacagtgccttgctctgttgcctaaactagagtgcagtggtgcaatcatggctcactgaagccccaaactcctgcgctcaagtgatcctcattctttttaaatttatttattaaatgttttttgtagtcatggggtcttgctttgttgcccaggctggtctcaaactcctggccataagtgatcctcccacctcggcttctcaaagtattgggattacagacatggacaactgcaccagaccctatattcacataattatttaaaaaatgtagtataagtgatcatttttaaaatctaacaaaatatatttggattggttactctctattctggttgagtcaatgatttatataatagggatgatcaaaagctatctgtttggctttctctctaaagctacagaattctgtcatatctttggagctaattaatttattcattcacaaagcatttcttgaatgctaactatatgctaggctctggggatatagtgatgaataagacaagttgatcgttgttctgatcgagtttgcagtctagcgagaatgatgagaaactaagcagataaccattcacataaataattaattgtgattagtgccatgaaggaaagatacagagtgctaggctttgatagatcccataactctaacctttctaatgcaagctctaatagctaagaatgaaaagtataggtactggcttactctaactgtaaataaatgccaataggtaatatttgatatttgataatccttttatttaggctgggcctttgccatccttattgattctctgcaatcccccaaagaaagaaaacaaatgacagccaattctcaagaatgttatttcaatctaagatgaagatggattcaaattcaactcattctgttcctgaaaatacttattaccctagttgggattttttaatatttccagtgtctaagaagtctaagaatagtctatgtgtttcttatctggctggcgtggatctgttctactgtgtcctgacagctcggcagagcttggcacactcccgtgctgtagttgagggatcagcacactttttctgtgaagggccaaggagtaaatattgtaggctttatgggccatatggtttctgttgcaatactcaactctgcctttgtagtatgaaataagccacagacaaatacatcaatgaagggacatgtctgccttccaataaaaatgtatttacagaagcaggtggtagagtttgttttggatgttgtatcaatcacagtttagttgtggacaacagaatctactctagttagtttaagtagaaaggtgtgtcttatgagatattacaagatgtacagtatcgttgggaaagttgaagaactgcactctaggttgggtttctagaaacacctctcaaagccatataacagacttgtctactggcctggggcttttggcatactcagaagcctcctgccaaatcaggaagcagccagctccttaattatgcccactctaccagaatcttagccagcaaaacaggtgcttcatgttctgcctcgttgcatatttaactcagacgtgtaagtacatctgatgctgaacttaaattacgtttaggaaacctagcattgagggagtctgggagatgaaagtttttagtacttgtggtacagaaagtacaggaagatacagtaaaaagagacaggaataagttttcgatgaacaattctttagcagatactgcagcagatctacagaacaccactttggctaattaacatcatggacactcttcttttcaaacctaaacttctagataacagcaatagctgtaatggcatgctatctcccaatataatgcagctctccttcatataaacaaaagtggactcaccttctctctaaaaggtacaacgtgaagtcccataggtcactttatcatctgtaatattcatcacagacattatcctgtgacccagcacactcaagagttaagtggcctattcctcttcagaaaaggagtggtggtggagagacagagcttacccagtgcccaagaggataagaccttaattctaagacgcttccacacgtatatttcaccctctttactagcaaattcccttcagttcgtaagcattccaagtatcttctcttaatgaaagcctctcctgaccctgcatttagttatgagtattggcctctcctttccctctcagccaaccttttcctctgaatgtcaaggtgctaaatgcagtggatgctgatttcttggcagccgtgggtgctgaccactgctgaagccctctcctcccttggctttcagatgccattctgtgtctgattttcatgctgttcctgggccactcctgttccgttatgggcccctcaccctgcatatgctcttcagtcattggttctgtctttagctctctctctcctctcttttcaatacctattctcagttactcacatgatttaagcaagcaactaacttgtatccccaatctaagatgctcttttatgccccagacctacatgtgcaagtgcctactggatcactcttggaagccatgggcacccaagctccataggtcccagactggatttcttggtcacccccaacccactccatcctgattatattgcttttctcagtgaatgacaccaccacccaccaagttacaaaaagcataagcttgggaggcatccctgactcttccctctatgccatccccattacctccactatcacttcatctgtttggggctctgctttctcaccgacactattgtagcagcctcttaactaattgttctcccagtctagcatcttccagtcctgtagcctagtttctttacaaacctaaacttccagacaacagtaatagttataatggtatgccatcttccaatagaatacaactctccttcatataaacaaaagtgcactcaccttctctctaaaaggtacaactcaaagtcccataggtcaccatatcatctgtaatattcatcatcaacaattttaggactattttaacctgtgtcaagtcagatcagatcactcgcatttaacacctaccaggggctatctgtctgccagcatgatgaaagccaaagtcctgagcaaaataccttaggttccttataaggaacctcttttaatctactttacctttcccctgctcttacttctttcccttcctcttctgcctcctccttcatggacttgagccataaatgtccggtgcaaaatgattctaacatacagtctttgccctctggtacctcagtgttttttcaagtgctgcttccactgcctagaaaatgtccacctgtctttgtcttgcaagggtgaagcgtcccgtgctgcagatggccctcctgagtgctttcatggcacctgatattctgaataaagcacctgtgcagtgagtcctaattgtcttgtttaattatcctggcttcacatctctaaaacctagcatgttttgctgcagaatgagtttccaccaaaatatttattaataacaaacatttattaacaacaaaacttattgaacacaggaatcttgattttacatatatttgccacaagatggtgctgttcagatatgaacgaaaaaggctctccaaggctgaaggattcagtactaggtgaaatttctttaaatatgttaaaattttaatattgctacattcatcggtcaccctacttgaccagtcatataagcatttgaagtcggttaagcactgtctttctcttgaactgttttctttccttagcagctggggtaccactctcttctggttttccatcaacccatcaaccttactgactagtccttttctgcctcctttgctagttctttctgttctgtttttttttttttttttccaacactctaccttaattaatggtttcattaatgatttatgaattgcatgttgtcatagcagtaatgggtagaagtgactaacaaattgccataaatctagcctaaagacagatcatcaactatccaaaaatcatttgtaacacaacacaaataaaaaatcactgtaggaatagttaatcttaataataatgacaacaataactccaccttcataatgttggagtgccatagggctcagcctttctttttctatctatactcacctccttaaaatcctgtatagtctttaatgatctcatattgtctttctcaaatacaatctatacaaagataaaggccaaatatgcatctccctgctggaacctttctcctacactccagactctatattcaatgcctagtcaacatcatcagcaaatcttctcagttctactttcaaaatatgccccaaatttagccacttctcaccacttttactactaccatcctggttcaagccatcatcattttactattgggtttctgcaacagactcctaactagtgttcctgcttccacccttcccttcctgccttctattcctgccttctattctcagtgcagcaaccaaagtgatcctgtgaaaactagtcagatcatgtcactcctctgctcaaaatcctcccctggcttctgctctcgcttatctccttctaggctacccttggctccctccagccccacggcactcctttgcggtttctatattttccttatagtgtttggatccttgatttgtctatagcctccctttttatctaattctgttaatttatctcatctttgctatttttgtttcattgattgcatattctttttagtacctcctagagcaaggttattcaaactgcttgtccatgataatctaagaagcatgcaccagaatgtaaaccatgctgcttcctgctttgagagtgtcttgctaggaaaaaaatgtcagctggctaaacagcatacctactgatgtagttgatttacatcctggcacaatctgcttatctcctcattgactggtaagaaacagttcagagactggcatcttgttcatggactacgctttgactagcaccaccctaaaatataaacatttgttgtataaatgttttagcttctttgttatgtatttaatagcaataatagctgctaatgtttattgagtacttactatgtgcccagcaccatcctaagccattttgatcttcataaaacccctaaggatagggactataattattttacagataatgaaataaaagcacaaatatattgattaagttgtacaaaatcacagttattttatagcaggaaggagatttacactcaggcagtctgattccagagtgcatagtcttcatgaaatggaattttaaatctgtttttgtacgctatgattctcctttatattcttttatatttcctgtaatattttacatattcaccatagcatatttgccatgttgtttttttcattcctcttctgtttaatatagagaattctactggggtcctcttttgcatagatatgaagtggataaattctggactctccttccttcttatctcaggcctattgatcttcccttcagaactttagtttaagggtaccatttggattgattatgtttcttcacatttctgttgcctgaggggatggatatgattcactctgttgggctttggtcaacagtaattggtagtttttctcttatgtcttttctggggcaagggatagagttggggtgtcattctatcaagttataagtttttttaaaaaaggctcagccctacggagagcaatttgaccaaatgaatcactgttacaaatggaaatcccattgggggaattgttctatagataaacttgcacacatatgaaatgctttttgtacagaattatccattgcagcatagtttgtcctagtagtagactggaaacaactcacatatccaagaacagggaatgattatgggatagccacatgctgcatgattatgtagttgtaaataagaagaagttctctatgcgctgttacggaaagctctgaagatataaagggaaaaagcaatgtatactaatgtttatccactgctgtttgggatttatatgtcatgtatacatatgaataatgatactttttttgaaaaggaaagaataacaagaatattctttcaaaatatccttgtttgaattttgggacatttttgaaaaaaggaaagaaaaataagaatatatattcatagagaaacagtggaaagatgcaggagaaactgataaaagtggtcaccagcaggagaccatgggaataagtaacaggatggatggagacacaccaccacctttttttaaaaaaagtaaatgaaaatgtatatacatacacattttaatttttatgaacagtggtctcacatgcgtctcccaagtggcaccctcactctccttccatttagctgaagcaaggaggtgaaacctaaattttttaagcctggtgttcattgttctgatggaggaggagaactttaaaggaggctttccaggattcctttggccaaccttccccagatttccttcaccacgccatgcctttcctttgttccagtagagccctttttactgatggagttaactggccaacagtgaagcacagtcgtgtcctctcacttcctcccagccctgggaaccacagtgcactaaggaatcctgaccatctctccatgtctgagtcacagtggtggtgggaacagcacaactttccacagcttgttcccttggcagtctccttactccctccctccagattagaagatgatggtaaagttttatagacattgccactagtttttttctctcggtctgattaggtgggtgacactgcttggaagttggaacacatcatagatttctgaagtcttttgctcttttttgctaactggtatttaagaaaaataagtcgaagttgtaattctttgtttttattttaaaagattttgtgatctgccttgacacactatcttaccctagaagtttttcatattctttataaatagctgttatattccttcaaagcacttgtcttaccggctagtgactaagataatggtgttgaattcagtgataagtgtagatcattttaattgacagtaaatagatgcctctggatggtttaactattgttttctcattcaggggaaacttctttctgcaactttgcatagcaaaaccctttttttttacgatgcagtaacaaaagtcagcagtgaatcctaatcaatgaagagagtccaaattaatttggttttattattttggatggatatatgtcacattttagagttattatgccttagaatacctcttggtaactagcacaatataccgtggagcgagaacctaaagtacagacagagtgaatgacggagtggtcagcagtttcctcactagtcagaggcagctgcaaacatttttactcacatacattgaatgaaattctctgtttttttccttggtttttgttcccatgacagttttcaccacttttgttgaacagtttcttctaaacctgaattatgtaggcatatgtagccatgttacttatgttgttatgaatgttataatttcttcttgaggtatggcctttgcccataaagaacaagtagaaatgctctggaatatagtctgtggctcacatttgaaagtatgaaacctgtatttatatattctaaatgttctgtcttttaataaaagaattccccttgaaactgcctgtctgggggattttattaggaatattgccaatgttttctgaagacttatttaaattagattcacatggtatacttttctttcacagttgatctagttcttccactctgaatttagaatttttttaaataaaagaatgagtctaggccagacgtggtagctcatacctgtaatcccagagctttgagaggctgaggcgggaggattgcttgagcccaggagttcgagaccagcctgggcaacatatgaaaccccatctctaccaaaaaaaaaaaaaaaccaaaaaaaaaaaaaattagccaggtgtgtggcatgtacctgtagtcccagctactccagaagctgaggtgggagtatggcttgagcctgagaggcagagattgcagtgagttgagatcacaccactgcactccatcctgggcaacagagccagaccttgtctcaaaaaataaataaataaataaatgaataaataaataacaacaaaaacaagaatgaatctagactataatcattctttgttgatttcactggagaaagtctcaagtctttgtttctagagttcatttccaaactgagatgttaatttttccttaggtgaataaatatattttcttcagtagttacaggattcgttggaaaaagatatttcttacttttcacacactcttattataatttattctccattagattcaccatcaccacaatgcctgactccagacaaacaaaaaaaagctccgaaccagtaaatcctggacatcatttcacttgacatttcagatcttctgtttatgctgtcagtagagatgctgccagtcattgttaggatatttgtgttctattttgtttgtgcttgatacagaaatatatttatgcttaattgaatattcagtttctttatattttcctgtttctagtctacatggtaatttgataatggagaaattagatttaaactgcatgaaaagataaagcggtatggtacctatcacaaaaataccaacgtaatttatttcaatctggaggtttgtagtgctaatataacaccatttacattttccgaatgtctcctattatattaaactggaccctttatttaatgttcccttcgctgcctgtgatagcccttgtaaagctcacaaaagattagtagtttagcttcccaattatctgtttgtcgtttatgtatttggatctgtctattataatctttttgagcttttcagtttgaatgaaagtttccatttttaatgttttgattaaatttataatattcttctgttttgttacttcttttagattgaaaagaaatgctgagaaatacataaagttttcctcttctgccttggatatttataatgggtatcgggaagtctaaaataaattcctgccctctttctctctcttggggtaaaaggcacagtgtggatacaagtccaggatatcatgagtcagattccaagaagtctgaagatctatccttgtgtaatgttgctgagcacagcaatacaacagaggggccaacaggaaagcaggagggagctcagagcgtggaagagatgtttgaagaagaagctgaagaagaggtgttcctcaaatttgtgatattgcatgcagaagatgacacagatgaagccctcagagtccagaatctgctacaagatgactttggtatcaaacccggaataatctttgctgagatgccatgtggcagacagcatttacagaatttagatgatgctgtaaatgggtctgcatggacaatcttattactgactgaaaactttttaagagatacttggtgtaatttccagttctatacgtccctaatgaactccgttaacaggcagcataaatacaactctgttatacccatgcggcccctgaacaatccccttccccgagaaaggactccctttgccctccaaaccatcaatgccttagaggaagaaagtcgtggatttcctacacaagtagaaagaatttttcaggagtctgtgtataagacacaacaaactatatggaaagagacaagaaatatggtacaaagacaatttattgcctgagatgaaacatataacatgtggctggctcttgttttgtaaaccaaatgattaatcttcacttgagaaagcagtttctaggaaatgtttaaataaaagagagtcttcaccttaaagaaacctatggagcacaagaaagataaatttctgcaggacagcctataaaattgtggtactttttgatgtttcagtaaacttgacattgtcagagtttcaaggacttttctttcacaattttcctagttcatggatatgaaaaaggaattctcaatccatattccttgtattgaaccttgaacaaaaacttgtatgacagacatttttaaaaatgtgacaacacttttattctctgaattttgatctcaaaggacacagaaaaaaaatggccccaggagatctgatcacacttcctcctgaggcacctctcatggatgttgcaataagcattcgggtactatcacccagaaatatgaattgccagaatagaacatttagcatgttaagcgttgatgcatataaaatcagaaatagatgtgagaatggtggaactttttaaaagaacccagtcaaatgtattttctgctgaaatctgcatatttggaggcatttcccaccaccgattcacagcccatttgatagtgtggtagttagggacttcgtggagtggtgttcagacgtcccctggggcttaaatctcttcatattagtcatcatttgtaactatggctttatttgcagagcttctaaaaggcgtataactgtgtgagtggccagatattcactttttaaatcaaaaacctctcttatggaagctttaaaagtttccgtcacacacaattctcttctcaggaagtatttctcatttaggtcttcaaagtagcctgactgtgtgcatgtgtgtgtgtgataggttatttataaagactttggatagaaggagatgtattttattacctcctattctagagccccatgctcctaacaagccagagaggccccaaacaggattgtttctttcctccacagcccttctgcccatctgagattgagggagcatcgtccacttgagatcagggatggggtggagaatgggtcatgtcatgtaatgagaaaagccctcttcgggatcatgagacttggttctagtccaatttctgccactgaggatgaatgtaactgtgggcaaactatttaccctcctttatctgtgaaatgaaagggttgaattgatggatctctaaaggcttttgtcctctatgaggatgtgaaaaactagggaccacaaaagggaacaagcaaaaaagtttggattcgataaagtgatatgtaatagttgcagaaggctttatatatgcttataatgaaaagatattttttgtatattgacagcataatttatttttaatgctgtcattacacttaaagtcacaggaaaaaaatatacatgcttactcaggctttcttaaaaataaatttttatagagatccttgagtaaagacattttgcttaatttcttttttcttattccccacttgtatatcccctaccagtaccgggatctgcacacatctttttgcagttacctcttcatagccatgaaccaaaacgttctatgaggagcatgcaagtaagtcaagcctcctattctgttagtacttattagaggaggagatggttttcattgcatagtgacattttcttagccttaacgttctgatagtagcttactactcacttctctttttcagttttcataataagtattcatttttttgccataatgcttcctgtaaagccaattttatatactaataaaacatgaactgcccactcttcatgcctgccaaacttggggcaattgatgctaaatggtatttttaaaataaatgtttttattctt

SEQ ID NO: 37229 - DNA, 10027 bp, Homo sapiens
cgcagcggccttgcgtcctctccgggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacaggtcgtagcaccgatcgcgcccgcccccagcaggggtcccgcacaggcttgcccctgacccccacccaaacctgtccttccgctttgcccccaaacagtgcacttgccggcggtcccaacccagcaggagaagtggacatgaggttggcaggtgggtggcttccacagcgaacgggagggagttgaaaagggcacctggctggaggcccagcgtcgcgacatctgtgtctggagaggcccgggtgaaccactgggtttggttttggaaatggaggactctgcacaaacactcgttccttgaccttaaccaaatcctttcacctctgaggacgtcagctccccgagctatgacatgaggattagtatagtcagtatctcccaacgcaggtagcagaccagctgctttttggaaaatgagtggtgagagagaggaggtgggcagtccaggtggagaggcgtggtcttagaggggaagtgacaaaagtggctgtgggcttcgacatgaacccgatgacagccctactgtcacctggacaagtaagatgaagatccttggggagggataggttggggctgggtggagagtagaaacaactcgggaattggacttcagacttgctaaggtggtaactttgtggacatatccaggtggagctggccactgaggaaccagctggcagggagtggtttcaagagaggccacggctggaactagaaaatagaaagtcattgacacatggtgcttaattaaagagctaggagtagatgacatcatctaaaaacacactacaggccgggcgcggtggctcacgcctgtaatcctagcactttgggaggccgaggtgggaggatcacttgaagtcaggagttcgagaccagcctggccaacatggtgaatcctcatctctactaaaaaaatacaaaaaaatgagcctggcgtggtggcgggtgcctgtaatcccagctacccgggaggctgaggttgcagtgagccgagattgcgccaccgcataactccagcctgggcgacagagcgagactccgtctcaaaaaagtaaagacagctgggcgcagtggctcacgcctgtaatctcaacactttgggaggccaaggcgggtggatcacctgaggtcaagagttcgagaccagtctggccaagatggtgaaaccccgtctctactaaaaatacaaaaattagccaggcatggccgggtgcggtggctcacacctgtaatcccagcactttgggaggccgaggcgggcggatcacgaggtctggagatcaagaccatcctggctaacatggtgaaaccccgtctttactaaaaatacaaaaaaattagccgggcgtggtggcgggcgcctgtagtcccagctaccagggaggctgaggcaggagaatggcgtgtaaccgggaggcggagcttgcagtgagccaagatcacgccactgcacttcagtctgggcaacagagcaagactctgtctcaaaaaaaaaaattagccaggcacggtggtgcgcgcctgtaatcccagctacttgggaggctgaggcaggagaatcgcttgaacccaggaggcggaggttgcagtgagccgacatcgcgccattgcactccagcctggggggcaagagcaagactccgtctcaaaaataaaaaaaataaaaagacactacaggtagggaccagaaggcagcctgagatgggagcctgggaaagtccagcttttaaggggagggtagaggagacgatctaactaaggagaatgaggagtgtccagagagattgggtcaggagagtgtgctgtccggaaagccagcagagaagttagtgcttctgtcaggtggacatgggcagcccactgagaggtcaaggaagatcaaggctgacaggtcaccaggggtggtgacaccacaaaggtcatcagtggccttggcaacaagctgatttggtgaggtggtggaagccaggccagactggagtagggtgggagggagtaggaggtgagatgatggaatgagtatagatgacttttgagggggttgacagggaaaagaaaggttaggggaaagaggatggggatgtggttttgaagaagagtgttttctttgcttccttaacattggagatgttgaaaatacaggagaaagagcgaactagagagagtgatcactattacaagaaatcagagaaggctggggagcttgcaatccaggtcccagcagatgacgggactgttgttgttttggttttgttttgttttgtttttgtttttgttttgaggcagagtctcactctgtcgccaggctggagtgcagtggcatggtctcagctaactgcaacctccgccacccaggttcaactgattctcctgcttcagcctcctgagtagctgggattacaggtgcgcgccaccatgcccggctaatttttgtattttctgtagaggcagggtttcaccatctttgtcaggctggtctcgaacacctgacctcatgatctacccgcctcggcctcctaaagttctgggattacaggcgtgagccactgcgcccggccgggactggtcttaaaagggagtagggacccttctccctcagaacaggaggaaagcaggggcaggtggatgcccaaatatattggtggtttcagaggcaggaagttgagggggttcttggaaagagggctggagcccttctcgagcagagagttctggaaggccccctcccagacccgccagggaaaaccaaacccagcagccttgggatttgaactcaatttcctccttccacctgccagggagctcaagtctccctttcagccctggtagaaggcaacaggtctccacctccttgtcctccagccacttcttcccaagtggcaggggagatccagtcatgcaaggctatggggtcattctggggttcgctggtatctgaggtgaccccaccctgtgtctatcctgcctccaggccctctccgcattgtggtcctagtcgtcagtgtgggtgtcacatggatcgtggtcagcatcctcctgggtgggcctggcagtggctttcctcgcatccagcaactcttcaccagtgagtgtgggaccccgccttatccttctctggaggccaccaaggtggccacctgggcctgtggttgaggctctgggttgggagttgacttgggttttctatctcctccctggcaggctacctttggctgtccccagtctgtctcctggcatcaggcgcagcctcccccaacacccagttgcttcatctaggaaagccaatacctgatcactagaattatatgcccaactggagtcagtagggccagagtaaggggtagggagcttccactgaacatggggagtgatgccccggttgctccctgcaggctctgagatggagaggggactctccaccttgttgactggtaataggtcacctgagtacttttttgtttgtttgtttgagacagtgtctcactttgtctcccaggctggagtgcagtggtgcaatctcggttcactgcaacctctacctcctgggttcaagcgattctagtgccccagcctcccgagtagctgagactacaggtgcgcaccaccaaacccggcttcttcttcttcttcttcttcttcttcttcttcttcttcttattattattattattgtatttttagtagagatggggtttcaccatgttgcccaggctggtctcaaactcctgggctcaagcaatctacccgcctcagcctcccaaagtgctacaggcatgagccactatgcccggccaggtcatctaagtagtttttctaattccatttccccctgttcctagagtagggagtttttcatctgaacatgacttacacttgagcaggaagcatgccaaggtcggcctggcttagcccccggcccctgagcctgactgcctgtgtctacacttcgcggtgtaaggagggccaggctgccctgccgcaggccccgggaggctccacactaacagaaaccactctgtatccacaggtccagagagctcggtgactgcaggtaaggcccctgtcacctccctgctcctcccctttgtgacatccctgcctgcccccggtcccgtagggcttcggttttccatttattcctccccaaaccagctgtggtggtccacgggggctgcttgccactgtcaacctacaaaacaagttacttcctgccaagttacttcctgccagaatatgacggtggggcaggcctaggatagatactcccactgcaaaagggcaacttggaaggaaaaaagaggtcacccgtcccaagcaagtccaaagcccagcagggcaaaattcatttggtttcaaggcctgaggggaatcctctgtggcctgagattctttcttctgggcctgctggaatgacccatgctctgaaacgagacagccccaccttcggggccacccttccttccctttatctcatctctgcccccttcactccaggccggcagtgtttctgctggtgtcagattctcaagagccttgttggtctcttttgcaagttatagaggcccaagctataaaatcagagagttttcccacagacgcttcctagataaccccatcttcattgtagatttctgctgaaagggttgagtggacccacgagtcacatacctcagctctggggcaaacgcttgaacagccttgctgttctgtccaggggacacttttgcagtttttgtaatatgattaggccaagaattttccacatcttcgctttctggctcctttgtgctcaacagtttcttccttatgtctctcacattttactataagcagcaaggagaagtcaggctacgctctcaacactgcttggaaatctcctcagctgaatatccaagttcagcacccagcacttacacattctcctttcgacaaaacactagaacacaattcaaccaagtttttttttttttttgagacggagtcttgctctgtcacccaggctggagtgcagtggagccatcttggctcactgcaacctccgcctcccgggttcaagcgattctcccacctcagcctcctgattagctgggattacaggcacctgccaccatacccaactaattttcatatttagtagagatggggtttcaccgtgttggtcaggctggtctcgaattcctgacctcaagtgatcctcccgccttggccccgcaaagtgctgggattataggcgtgagccaccacacctgggccaagttcctttataacaaggatcagctttcctccagcgcccaataactcaataacatgtccctcattttcctctgaggcttaaccaaaagcaccttttttttttttttttttttttttggtagagacagaggtcttactctgttgctcaggctggagttcagtggtatcatccccgtgcactgtaagctcaaactcctgggctcaagcgatcctctcacctcagtctcccaagtagctgcgactacaggcatgtgccaccacacccagctaatgttttattttttattatttattttttgaatgtattgagacagggtcttgctctctcacccaggctggagggcagtggcgcaatcatagctcaagtgattctcctgcctcagcctcctgagtagctgggattacaggcatgtaccaccacacccagcttattttgtattttttgtagagacggggtctcactatgttgcccaggctggtcttgatcacctggcctcaagtgatgctcctgccttggcctcccaaggtgctgggatcacatgcgtgaatcaccacacccaacccaaaagcacctttaacattcatgtttctagcaacgttctgttcttgatgatatttgtattctctaagaccacagaggctgtctctattgctctcccctcctctcaccagaattacctttaacatccatactcctaccaacagtctcttaaaggcaatccagaccttttctaacatgtacctcaaacttctatagccttgatatggtttaaatgtcatctctaaaactcatgttgaaatttgtcaatgtattggtattgagaggagggcctttttgaggtagttacgtcatgagggctctgccctcatgaatggatgaatgccattattatgggtgagttagttaccttgaagttcagcccccttttttcctgcgtctcatatgcttgcttccaccttccacctttctgccacgggatgaccctcaccagatgccggcgccatgcttttggacttcccagcctccagaaccatgagccaaatgaatctgttgtctttataaattacccagtctgtggtattctgttatggcagcagcaaatggactaagacaagcctctactgactacccagttccaaagccatttccacatttttaggtatttgttacctaagcaccacacttcctggtgccaaaacctgtatccatttcctggaactgccatttcaactgggtggcttaaacaacagaaatggattctctccccattctgaaagccagaagtctgaaatcaaagtgtcagcagggcgttactcaccctgaaagttctacaggagggtccttcctgacctccccaggttccagtggccccaggcataccttggcctctggctgtgtcactcctgtctcttcctccactgtaccatggctgtcttccctctgtgtgtctttgtcacttctgttcttataaggacatcagtcatgttgcattaaggacccaacctactccagtatgaccccatctgaactgcaaaggccctatttgcaaacatcacattctgaagtaccacagattagaacttcagcataccttgaggggacagaattcaacccataatagaagccatcctgctccagtcctcccaaccaacccccatcaaaatcgggagacaggctgcaccccctgccacactaccccctgccacactgcctttgctcaggttggcctcatccatgcagctagacccccagcctgacttacttcacccctgctttgttcctggctgtgcagtggcccaggccagccctcagcatcctttcttttctcccaccagtaacagaaaatccttctgtcttgggtccctgtggcctcaccagtaggacacagagtatggaagtgtccccagcctcggcctgagccacatccccctacttgtgtcctgctctgcggtcacttgttctaccatgtgtgctggtcctgacctccccttcagatctcaggtgacctcagggccaggcccatggataacacctgctatccctgcccagcgccacgggccaggaagtacaagtgtggcctgccccagccgtgtcctgaggagcacctggccttccgcgtggtcagcggggccgccaacgtcattgggcccaagatctgcctcgaggacaagatgtgagctccctggggtgactggggatcagggagggagtgggggatccagggccgggtctgcaagggagagtggagcagacgtgcccatgtgggatctccccgtcccccccacccccccccaactaggctgatgagcagcgtcaaggacaacgtgggccgcgggctgaacatcgccctggtgaacggtgaggcccctggctgagcgtggcctgccgccctccttccctgctccctccccaggaggcctctgggtgtttgccctcccttcccctcccattcaagatctcccagggaggcctgggaaggagtctgtgcaagcgcaaggctccacagaggagtgacccaatgaacaaaaaagcatgatggcaataaagaactagggaaggttctgggaggttgagggtgcttcatggagagcccccggagggcctcaaatgccagacagaggcaccacggcttggggtgggatgcagctgcctgaacaaatggatgaatattgggggactgtttgaaagcttccagaagggctgccccccacccccggtgctacccgcctgccgtgccctgaggctggcctggcttacccagcagggcccctccctcctgacacaggggtcagcggcgagctcatcgaggcccgggcctttgacatgtgggccggaggtgagttgcagcgcagcgtcttgcattttgactgcagcaaaatgacctgggcagcttcccctgagacactgctctctctgtctgtacttggagcttctcagtcacctccgtgggttcagaaaggacaggggcatcgccagcttggtctggaggctgtgggaggtcacggggatgcctcagcttcctacaccagcctgtcccttggcggggcatgtcccaggcccaatccctacttctgtttccttgtttggagaacgggcttgtgggagggtgctcagtggtgcctgatgacccctgttccgtggcacctgcccccccagatgtcaacgacctgttgaagtttattcggccactgcacgaaggcaccctggtgttcgtggcatcctacgacgacccagccaccaagtaggtgcttggggaggccagcctcagccttgcccttctgcagcaacagctgacaccccttcctcccatgctgcaggatgaatgaagagaccagaaagctcttcagtgagctgggcagcaggaacgccaaggagctggccttccgggacagctgggtgtttgtcggggccaagggtgtgcagaacaagagcccctttgagcaggtatggggggtgcctggcatcacccccaccggggcagcctgtcgccccttctgcctgcatgcgacgagcctccccagctgctcacgccccagcaggggaccgtccccagtccagctatgaggggtgggccagtgcagctgatgccatgtttccctgggatgggtggaggggccaagtgccctgagagtacaccgttggccaacacagcacagttgactgacagcctgggtcctggtccactcctgtcccctgtccctgagggccaaagtcatgactttctgctcccctccccacagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcaactctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacag

SEQ ID NO: 37230 - DNA, 12610 bp, Homo sapiens
agacgatccgctagccacattaggcgctcggtctctgcgtccgcccctcccgtgcctcagagacttgcgctccccaggcccgagcccctgtcggcccatcctcgagcccgtgtggctcgcgaacctctaactccagccgctgcagccccctcccaggcccggcgtccccgagccccgcgggcgccgcgcctgcccttctttggctacgctgcagccgcggtgtcggcgagtcctcccgggttgcccccgcgggcgtcagagggagggcgggcgcccgcgtggtgacggcgacgcctgcagcccaaggagcgctccactcgctgccgccggaggggccggtgacctcttggctaccccgcgtcggaggcttagatggctcaggcgaagatcaacgctaaagccaacgaggggcgcttctgccgctcctcctccatggctgaccgctccagccgcctgctggagagcctggaccagctggagctcaggtgagctccgggcgggcggtctcgggcgttctgctcgccgcgcgggcggttcgcgggcggttagcggacggaggccgcgtgtggcgggccggggcctggggcacagtgaggctgcggcaaccgaagttgcttgttgagatttgttgtggatggacgtggtgtagttttgtttgtttcttggattatctcccctagtccgagagaaaacgcattcgatttaagctaaacctgtgagggcgttatcggtggccacactttgattaatttacctaggtgttagggagcggaaaaaaatcagaggagataaaagttacagtgagattccatgcgattaaggactgtggcagcttgggtctgcagaacttctagaaccttctgtgtggccccaaacgttttaacttactcttctcgttatgcattttttaagggaggcagcagtttacagtggccctccacgtgaagttaagtttccttgcttcagaacaaaaatgaataaaacaaaaccaacccagcaatccattgagagcaaagattagacaggagtgaggggtaggcagtaagttaccgggtgcttcgtgcagcagagacgttgccgcttctgtttctcccctaacctcgcggacgggattcagcggttccgttcgtctctcggtatttattgggcacctccctacatagaagactaagtgctagttactggcctgaaagcatgaaaagatagttttccccttttcttgcttaagaatttatttggtaatacagtagtagacttgtatagaatttctaaacaatttaatgttaatagatttttggaaagactttaacggtgtattgaaaagttttatctacttcctgtgaacgtttgtctcaagttactgtgtaaattttgtgagcaggtgtagttaaaagaaaatcttgttaggcacctgcaattccgtgaaactgtacacaggagttggttacatagttttgtctaggttgtgcatgagcaaagaagcatgtgagccaaaaagtttaggaaacactgcatgtgtgtctttatcttcctacattaatacacccaaacatgaagtatctgtttgctgagaaaatacttcaataaccacggtatctcttaacaagtgaggcattattattgttactattgggagaaaagagccagagagtgagagattctccactcaaaataatttcttggattattaagccctacaccaggttctggggttccactcagaatgaggcaagtggaagagagaagtaatgcttcctcatggattttcacaatactggcaaacctgaccgttccactcccagaaaaagtagagcgaaagtagaaattggtggcctcagttacttgaagtccctctaactggtaatgtttctttttagggagccacataacaagtaacacacatctctccatgtcttcagaacgttgagggcatgttctcaaccacttcattctcctctcccttagccagaaagaaaagttttcctaaaggaatggggaggttgttactccactccgccttccttcaagctgagtcattgtcctccaacttgaattaatgcctcacatgtggtaggtacaaaagcactctgaagtgctcctctttaaaagaaagcctcaggttttgaatattattatattctactgtttgattaatgtaaaatgaattctgattgcacatcagtgattaaattacaacttgcttaattaacatttgagctgaggagaaaagtgattaatatgtggctgttcatttcaaggacttttttttagtaattctggacttttgtaggccttttttcttctttttaaaaaagtaatactagctgaaaaggaaggatttccgaaggtaagcaaaaatagagaaaaatgctaatgtagatcctattaaagttttttttgaaaccacatgggcaatggcactgaacactattaaaaactagaatcatgcgtagaagatcgatttttaaaagaaaacatgaaactcatatgtaattttgctctaatagtttgattttgttgactaataaagtagtgtaactgtgtagaataaaaccttatagtttgtacttagaagtgtgcacttaatgttccctaaccacactgatcctgtcaattgtggaagaaatttcatactttatgacctggagtatgaactgatctacatgatgtttaaaatgtttggcagcagttttacaaactgttaaaggatttccatttatctctaatggaatttatcaatacagtagcccttttttttggactgcattttgtcttctgtatttcttccttctacagaggtgattcccttttctccgttttgacgatcagttctaaatggactctgagttttgcattcttcagtggctcaaaccatcttgcttactattgttactttttaacaattattgtaatttgtaaaaaatactatgatattacgattctctctctctgtatatatacaacgttttcctggctcataactcccataacccttgttacagtcttatgttatagttcctggctcataactcccataacccttattacagtcttacgttataatgttggggtgctttaggcctcaggaaaaagaatctctctctctgaccttctttcacctgccttacctctagtctgattgtgggtcaaaagactctcgttccagagagggtcctgccctatgccctggaggagggcatttagcacccagaggccaagaagaatctgaatagactggccttgctgggtttccccattcagtctgttagagtgagggcatactctttttgtccaatcacttttctacatggttgtcattcatgcttatataaaagaagcaagcctccataagaacccaaaaaggacagggtttggagagcttctggatagctggacatgtggaggctcctggaaggtggtgtgccccttccccctgtacctcaccctacacatctctttatccatgtcctttgtaataccctttataataaatccgtaaatataagtaagtgtttccctgaattttgtgagctgctgcagcaagttaaacccaaagagggggacatgggaaccccaatttgaagccagttggtcagaagttctggaggcctagacttgcaacggtggagggtggggtcttggggactgagctttcaacttgtgggatctgataccgtctccaggtgtagggagtgttggaactgagttgggggatacttagctgcaaatcccccacatatttggtcacagccttctgtgttgttacagtgtgagagcagaggaaaaacacagtgtgagagttttttctaaaacacaggctaatgtttattcatttaatgtacacggactatgtgccaggccccatgtcgttgttactattatcaccattctacagatagggaaattgaggcttagaagcttaaatgacttgtccaaagtcacacaactagagagtagtaaactccaaatttgaacccaggaagactggctctccaggctctaatactttatgcctgaattttcttaaatatatcacatttcaaaatatagaaatgatatatggatgaatagatgagcttcctctaagagataaaaattcaatctaaattggcctttaattcagtggatattgaacacccactatgtgttaggtattgggtagctcctagaaagctcaagatggtaatgaagatgtttgggggatgggttttggagactggcagaggggaaaatgataggactgggagattggcttttcatatgtttcccaaaacttataacacagtggctccttctgccttcctgtcagcctttcactgtggcttaacctgcacccaggtagtgaagggatggggttgggggtgatagggatcattcgtctggcttaaagtttcatgttagggtgtgccagtgttctaggagtcacaaaacaagatggcatcatagttaatactgtgtgacagcctgtaatttaaaagaacacttcatatatgttatttgaaactttaagaacccttcgagttaggtggagggcacatactctctctcctagaaatgagggaagtgaggtccaattaggatgaagtggcttgcctgaggacatgctactgaaaagtggctcttcacactaaaaacactagtcccttcttttacaccaaaatgtcttgacagtaaatgtaatttaacattttggtgattaggaaaacacttcagaattttacattgcctaaaagtgatcattatagcattcttttgatataggagtatggaataagagacagaactatgagttttaagaacctgttttaggccaggcgtggtggctcactcctgtaatcccagcactttgggaggctgaggtgggcagatcacctgaggtcaggagtttgagaccagcctgtccaacatggtgaaaaccatctctaataaaaaattcaaaagttagccagacgtggtggcgcatgtctgtagtcctagccactcgggaggctgaggcaggagaatcacttgaaccctggaggtggaggttgcagtgagctgagatcacaccactgcactccggcctggacgacagagtgagactccatctcaaaaaaaacaaacctgttttagaaattatttctttcaaatcatggtatgagcatttgccattttccctcctttttatgaaagcacaaattttcatcattaataaataagcccacattcataatggtaagaatataatagctattaatactataaatatatgccagtgccaattctagacacattatacatattaacttgtgtgtgtgtgtaatttttttagtcagtgctatcagtcactgttaaactctacctgctttacttcatttagtcacaagcactgttcccttatcatccctgtttcataggcgactgacccatttgcacagctagtagtggcagtgctggcgcagttttcactgcatactctattagctgacatattaatagtagccacagtttgcgcaaaattgctgttgtactcctcctaagtctcccagcagtttgccgtttcgatactgagactgcagaggtttgtgaggtgcccaagacctgggtactagctgaggatgcatgcgctccggttttgtcttcctactgagtactctgactaaaatttctttttgtcaaagcctacttagttgtgatttcatgcagggagttttccaggagcacagcccaggccagccttgatgtgaggaaaagttctttcccaatttggacgtgtagctgcttccgggatctgttagtaaaaacagaactgcccttctccgccagaagtgttgccagatgagatattaagaaacatgaaggataaagtgagatggtccaacatttctctaaccagagttccagacgaaaataacagaaggggagacagggaatattcaaagatacaacagccaagaattttctagaactaatggaaaaattgtagacaaaagacgtgtatatgagtttaaggatagcaatagctgacaaacagtacaaacgttacttaaactaagtagagatctaggttcagctttttaaaagaaaaaatgtaaaatatgaggtagacatattttagactgtagagtaaatggatgtaccagggccaaaaggagcatgaattgccttaagggagaggaagggggaagctaaggaaacaattcctgctgaagcaattgggttttgaaaaaggtgatcccagtagacaagggtcagggagaaagaatgctacctgaagagggaataggacatgaaaagcccatgttgccaaataaaccctgagatctttacattttgaagaatgacattttacccttgcatgaaatgaaaaaggtatacataaaaatgtatataagaagttctataaatgatgaaatctggttttcacagggataatgccctggtaatttctattatgtattaaaaaaagccttgtgggatgggggtgggggagggtccctaaaacacaaactttagcagttccacctaactatttggtctcatttaatgataaaatattttcgtcatatgacaggcttattatattttttctagaatgtcttttttatctattttgttaagaacatgaacttactgctgtaactcataaatgaaaccttccttttcagaatagcattgttctctcttatcatcttacaattgaatacaaaccgaaaaggtgttgaaaaattaatctcttctttcagcatcttctcatttatcaatcacatgattcacctgtgtcatttgtctaaatattggagtcatggtttgtgcttttagcataaatatttagtgccaactccgtctctttcctatgttctgggccctagtttatctttctgagagattgctaatgtaaaatgtttaagtaaatactgaatggtcctggaatagggcctgatacttgcattactattagttagtagaatatttgtattttgattgtgttctctagccaaatttgtcacatgcgattcttcccagttctttgcttttactggctcttataaacacactttgacatatatttaatatcttgaagaataaagatatcctgtgattttacagcctgtcagtactattttggggtataacaggtgggtaaccgaaggggaaaaggcatgtgtgtgcttagggcagggagaggatccttttatggaattgaacgtgctaaaacattggtgaagttgttctttctgtgcacacttaagacagcagttaggattagatctttcatgaacttgtatttctaagaccatccaaatactgggaataggtctgtcactttcattttgcaaaagttggcatcttagttactgtaattcataataacaacgttccctggaagtatagaacatgttaaatatacaatatatatttctttattttgcccttattccacagcttagttttttagtgactgggtatattcatgtgtgtgtatagtgtgagtgcatgtgtgtgcaattgagtgaagtgggaaagtagtgcttctatagtttgatcagggctttacacaaaaaagccacagagattttcccttaaatttgggaaaagacaaagatacccccatgattgccactgtttaatacagtactgaaggaccttttcttaaaaaaaaaaaagtaataggattgggaaggaagaaataaaaactgcagatgatatggatatgattattaacctagaagaaccaacagaatcaacagactgaacactaaaatgaatacatgtaaatcaaggttgccagtgacaagataaacctacaaaaacagcacttctcaaaccagtaaaaatcaagtagaaaatacaaattcacaatagcagcaatatccacgaagactactatgaagaatacatgggaactctatagatctgaataaatgaagagacatatatcatgcctttaaacagagagatgttataaagatgtctaatttctcttgttttttgagaaacacaataaacttaccctagaatttatatggaaaagttggagaagtaaaagtccataaatagctaagttatctttaaagaagattgagggacctgctctatcaaatattaaagtgtagtacaaggctagtgctattaaaaaaaaaaacccaaaacttggcactggtataagaacagttaaatacactaatgcatggcatagagattttagagataaatagcgaatatacattcgctaggggaaagatggattgcttggtaaataatgttggggaaaatggctatttggaagaaaaaaacaaaacattcttacctaactgcatgcaggggttgatgctaggtggattaaagacataaatataaggaaggtagaactataaagttaataagagaaaatataggaaaataggaccaaagggtgggggaagaccttaggtcaaaacttcaaaagcatacgccataaggcaaaaaaaaaaaaaaaattgatcgcatcaaaataagagtctctctttagtgcaagacatcccagacgtggttcatatatgagaggatgagagatggttgcaatgtctgtaaccaacaagaatctcttgagtatacaaatcaacaagggaacagtaactcctgtttaaaaatagaaaagcaaaataggaaaagtctatgaataggctaacaaggatacaaagagatgtctgaaattattaggaaaacacaagttaacactgacatatcagtgtatttctgtcacactggcagcaaatagaaagttggaaaatgcagaatgttggtagggatatggggacccctgtgctttgctgtggagagtggataggtacaggtgttctgcagaatagtcataatactaagtcaaaagcagagtacacataccctttgtcttagcagttctgtcctggtatatgtcctaaggaaatcctcaccaaggtccaaaggggagatgtattcatagaagtgttatttgtagtaatgagaagctggtagacaacctaagtgtccatctctgggagagtggagagggaaaatcaggtaggtatacacatggagtattatacagcaattagcagcaactgattagaagtacacatagggggctgggtgtggtggctcacacctgtaatcccagcactttgggaggctgcggtgggcagatcacttgaggccagcagtttgagaccagcctggccaacatggtgaaaccccaggagtttgagaccagcctggccaacatggtgaaaccccgtctctactaaaactacagaaattagccgggcctggaggctgaggcacgagaatcacttgaaagcgggaggtggaggctgcggtgagattgtgccactgtgctccaacctgggtgacaaagcaagactgtctcaaaaacaaaaaacaaacaaaaatctagcaacctggatgctaagtgaaaaaataaaaacagaatgagatataaattcaaaatatacaaataatacagatcttgtaaaaaacaaatagtattaattagataaacacgaaagaatgattgccttatgagctgggaggaaaatgggagaaaggcaagtgtatagaaaaatgaaagaattttaaagcagaaatgaagaatttttgaaaagtttggtgatctttaaacttgatttgggttgaatgagagataaagaaaattaataggaagaacatcctgcatacaataaccgttttgttttcccaatttctatagggttgaagctttgagagaagcagcaactgctgttgagcaagagaaagaaatccttctggaaatgatccacagtatccaaaatagccaggacatgaggcagatcagtgacggtgagagccatctccacagaaggggctcatcttttacactcctttaaagagtttatgataagtgtgggtcaatttttgcttgacttttggtatgcgtacaccaggccacagcatttaatgtgagccacagagagcagctgcagctgtcagttcattacagcagccacttactcagagatttcttccagcatgctctctaccccaagcccctggctaggagagataggaaaaagcctgcaagctcagaaaagctggccccaagcagtaaggccatgtgttttatcccaggttcacagtcctaacttcagttcctcacaagttactggactgcaagagattaaaaaagcagaggaagagggtgagagagtggaagcagagaagtagagaccaaaaaaaaaaaaaaaaaaaagatgaattgaggtacaacataaagagaagggacaaaatgcagagaaaatgaggaaacttgtaggaccaataaaaggcatgaatgtaaaaatgtgctgtcattttcttttttctttttttgagatggagttttactcgtcacccaggctggagtgcaatggcgcgatcttggctcactgcaacctctgcctcctgggttgaagcgattctcctgcctcagcctcccgagtagctgggattacaggcacgtgccaccacgcctggctaatttttatatttttagtaaagacagggtttcaccatgttggccaagctggtctcaaactcctgacctcaggtgatccgcctgcctcagcctcccaaagtgctgggattacaggcatgtgacatctgcctaacctgtgctgtcattttcatgtgaagaacatgaaataggaataggtcacttctgattttcttttattggcactggacttcctacttgggctcctttggtgccacacaggccacatggtactgggccaagtggctggtgaggtaagtaagcaacctaaatccagatcaaaactgttacacatctataggtaggccatgatctagtctctacgctatcctgcccaaagatcaatgaattaggaagttacagaagcaggagcttgctgactttctcatataaataatgaaatgttgatagagctcctcgtgctggccaagactttagaccactgtcctgcttctatctggagaaggatgaagtcagtgcctagtattgacgacagaagacagcttatcttctatcgtggctacattttctcaaccaaaatttggggcattgtattctgataaatgcacatgtcgttctggagagatctgggacatctgatctctggagctctacccagcataaaccctatatgtgcttactgctcacagtgttaagacttgatctccatcccagttacaaatgcatacctacccaaacttttgcagacatgccaatttgagaagtcatctggtatcccatatatgcagattgtcaggaagtggtattctacaacctctttctgtaatctaatacatttcatcagttaatcttacatgctatagtttcagcttttatctctaaaaaaatttcatggcagaggtaaagaaaataataaatttagtcacaaacaaatgccttaatgtttttgacacagataagtttacatctcatattgatttttaggagaaagagaagaattaaatctgactgcaaaccgtttgatgggaagaactctcaccgttgaagtgtcagtagaaacaattagaaacccccagcagcaagaatccctaaagcatgccacaaggattattgatgaggtggtcaataagtttctggatgatttgggaaatgccaagagtcatttaatgtcgctctacagtgcatgttcatctgaggtgccacatgggccagttgatcagaagtttcaatccatagtaattggctgtgctcttgaagatcagaagaaaattaagagaagattagagactctgcttagaaatattgaaaactctgacaaggccatcaagctattagagcattctaaaggagctggttccaaaactctgcaacaaaatgctgaaagcagattcaattagtcttcaaacctaagagcatttacacaatacacaaggtgtaaaaatgataaaatactattttaattgataactagttctttgttaggtataaccacttagttgacactgatagttgtttcagatgaggaaaatattccatcaagtatcttcagttttgtgaataacaaaactagcaatattttaattatctatctagagattttttagattgaattcttgtcttgtactaggatctagcatatttcactattctgtggatgaatacatagtttgtggggaaaacaaacgttcagctaggggcaaaaagcatgactgctttttcctgtctggcatggaatcacgcagtcaccttgggcatttagtttactagaaattctttaccttaagcagcacacacatttactacacacacagtgttaacaaagcactgtgcttagagggtaaaaaggaatcacaaaacaagaatctttccaaagttgtctcattcagcaatgttaaggcatctgtatcaaattattttggatgtaaagattcctgtgtctcataatatgaatgtattttttgatatacaagaaactgacataaaatgtgagaaaaccacctataatttaccactgtgaacaattatatatctatctgcttcatcttttctcaaatgcatcaattctctaaaattcctatattgtaacttgcctttttttaaaaaagttagatgctgatataaagtctgcttaattgtcaactt

SEQ ID NO: 37231 - DNA, 51516 bp, Homo sapiens
tgacgaaggggcccgaccgcgccgcgtttcgggagcggacgtccgagccacggccgaggcccgattagtccgtccggcaccgctcgggcactttcggaagggaagaggtggagaaccgacgttcgggagcattcggcctcggggacattcggctcgtctcggctcggcctcgggctgactcggcttccgccggcggcgggaacgggcgaaacccgcggcactaagctctctctgagaggcagaattgcgccggccgccggcgagaatctgcctagagccgtccagccctgtcggccggggacgacagccgcctcagcctgtcaggacagtgaggagagcaggggccgagtctctcggaagccctcgtgaggactcggacctattcggactgattcggcttcccacttcggggaacttcgaccctcctcggttcaggactcggtctcggctcggcggcttcgtgcaggttcggctcctactcgggcagcctctgttcgcctcggctccgctccgcgggcggactcggctcggctctgctcggcggctggctgccttttcggtccctattcgggcggcggcttcgggcggcctcggcccagctcgggcgtcctcttcgggccccgcttcgggctccgcgaccggcgcttcgggcggtcccggacggcgccttcgggaaggctcggcggagtccggatggaggactcggactcggcggcaaagcagctgggcctggctgaggcggcggcggtggcggccgcggccgctgtggcggcggcggccgcggccgcggcaggaggcgaggcggaggagccggtgctgagcagggacgaggactcggaggaggacgcagactcggaggcggagcgggagacgccgcgggtcacggcagtggcggtgatggcggcggagcccgggcacatggacatgggcgccgaggccctgcccggccccgacgaggccgccgctgccgcagccttcgcaggcaagtgcgcccgccggcctctcgcctcgtccggttcccgcgcgcctaccccgcgcgcctgccccgcacaactgtcccaggtgaccagcccgccacacctgtccctcacacctgctccacgtgaccagcccgctccacccgccctgcacacctgcccctcacacctgctccacgtgacccgcccgccccacccgccctgcacacctgccccacgtgactagctcacccctcacatctgcctctcacacctgccccacccgcccctcacactttccccacgtacctgctccaggtgaccagcctgccccacctgccacaaatacctgcctcgcacacctgctcgacgtttccagccttccccacctgccccacgtgatcggcctgccctacctgccccgcacacctgccccacatacctgccccaggtgaccagcctgccccacctaccccaaacacctgccccgcacacctgcccctggtgacctgcctagcctcacctgacctggccctgccctgcacacacctgccccctgccccccttttctttgtggcagccccgcctcctactggtcccccctgtgcagctctgcccctgccctgccttcgtccatcctggctccccccacctgtcctggagaagccctggggtgggtgggcacctgtggtcaccaggaaccccccacttcctgagggccagttcaggcatgacctgagcgctggggagccaggggtgggcagcctgctggaggccatgatgccagaggtcagcgtggctgtgtggtggcccaggggggctgcggagccacctgtgcaggctcccctcccagtcctccctcttcctcttgcctttttccctaaggacctgctcctcctgccccgcttcctgtcgggcttcctttggggaggctgctgtggctttccagtccacatttttatataagctgcttatagtttcttgccacacaggtcagtctccttctcaggctccaaaacactgggagcccgtggcagagctcacagatgccctacggggctggtgccgtccacccacctcctgtgtcccgcccttgtgtccgtggggcatagacttccccacccactggcttcctaacgcactgtattcttccccattggagttcccgagtgtcccccagggactcacagctcagtgttgagacccttgggaggagcttcttgttgcgttgtgaggcacttttcccctacggagctttgcgggttgaggaactggatcccagtcctggtgtgctgggtatgtcagggcattgcgtgtgctctgggtgcttgttcggcctgggggctgggtgggggccagcagcgtctgggctgcccttggtcagctgagtggccctcgaaggcaaaggggtcactgctgcttgtttggttggttaagaaaaaaaagtgagggaaggctttgtgactctcaggggttggcgtccgtcgctaaactctggtttgacgttgggatttggagccatgaggttgatttcaggtttttgtcatttttgcacgtatttttctgaatgcataaaagaaaaatgatgctgttcatcatgatgtcagagaaatgtgctgacgtgtgttttcttctgaaaaatatggtagttgtgttttgatgtggtaaaagcactttaatactttttaaaaattacgaacagctgacgtcaagtggtttccaggtttaagtaactcagcaggacacgctgccgcctgaggaggctttgggcggctgctcccagggctgccatgggcctggcgttgagcactcactgtggccgcgcgccgcatgccggggcttgtggtgctgagaggcgaggatgagggaaccgtgcacctggtgtggtctggtcgtggagacagacagcaaacatgcctttttttttttttgagacggagtttcgctcttgttgcccaggctggagtgcaatggtgtgatctcagctcaccgcaacctcccgcctcccgggttcaagtgattctcctgcctcagcctcccgagtagctgggattacaggcatgtgccaccacgcccggctaattttgtatttttagtagagatggggtttctctatgttggtcaggctggtctcgaactcctgacctcaggtgatccgcccgccttggcatcccacagtgctgggattacaggcgtgagccaccgcgcccggctgcaaacaggcatttttagggcagtttggtgagtgctgggttaatggtatggtcaggactcattcaaccagtatcttttaagcatctgctgtgtgccagagattgccctggacacaggacattctagaactctgggtgacagaagagccacttgcttggcctaggagcatcacaggaagactttgcagaggcagagaggagggtgtgggggtgttggcggcagaaagtgtttctctagaaacactccagcatgtagaggctggagctgcaggacctatctgggatgacaggggcaggaggtggggtgcagctgacctctgtggtaactgccctgtgtgcagatgctgctgaagggcctgtctgcatgccagggggctgagttccatgttgtagggggtgcggtggggtggcaccaagggacataggcaggttagatgtactttttaggaggaaggggtcagagaccaagggcaatggctgtgagcatggggccgaggtcacctgacgatggtggcctgacccctgcggtggaggagaggcaggaatggagctacaagagtgggtccaggaggtgtcctcacctgcggggaggccgagagctcctcgtaggcatagggcacacctgaccagcagaacccacagctgtgccgcagaaggagatagaagccccgtggtggtttgatagagctggggctggctggggtggcgggtttgttgtatgcattttttactgcacgtaaaaggctttactggggaagaatagatttcctctctttttcctggaagagccgaatgacttagacaatggaatagaaatgtaggtcgagcgtgttcatggaagtgttaagatcttcctggttacaagggcacacacctgagggggagtcactttgtttgaagcacctgagcgaggctgttcgctttgtccattctggcttttgttgcttgttaaatgaggctccttctgttgcagaggtgaccacagtgacagtggccaacgtgggggctgctgcagacaatgtcttcaccacgtctgtggcgaacgcggcatccatctcaggacatgttctggtaagctgctccgaggggcacagcccagggcgggtggtgccacgctgggggcctccggcttccccgaggctctcccggggttcagcccgctgtgtgaacgtctgctctgtgagctggggagggacgcactggctcgctctgctctcagaggccttcgggctgtgctggaggtgggagaaattacagctgaggtagaagctgcctcggaaggccaggtgaagagccacacctgtcagatgggcttgtggcctgcgttgggcagggactcccagcaggctgctgtccggccacagttcagcctctgcccgaggcccggccctgcctgtgctccttatcctatagctgcagggccagctgaaagaagcaaggcgtttccctcccccatatcctgttctcgtagcatttatggtgcagtctcccacgcctgactgctgtctacttagaaaactgctgaaagccagttgcatttcaaatagtgtctgtgccaccttcagagcccttttgtgatcatgttttatcagcttattttatgttttatgtgtggggccttcggcgatctggggacatctggtcaaccagggcaggcaaccttgtttccaagtggcagatgccagggtgggtccagtctccagaaagggattttccctgggaccattggcacctgttacttgtagtcttttcagccttggtcacatacctgggacatcatctccatatacctgaaagcagagtggttatttgtttgttttgtttttgagacggggtcttgctctgtcacctagactggagtgcagtggtgcaatctcggctcattgcaacctccgcctcctgggttcaagccattcttgtgcctcagcctcctgagtagctgggattacaggcgtgtgccaccatgccaggctaatttttgtatttttagtagagacaggtcaccatgttgtccaggctggcctcaaactcctgacctcaggtgcccgccttgacctcccaaagtgctgggattataaggattataggtgtgagccaccacacccggcctgaaagcacagttattgttagaatggcagcaaacagaaaacttgtgaaggacttcagtaaaaacataagaaacttggaaaccccctcccctgccctcccctcccctgccctcccctcccctgccctcccctcccctgccctcccctgccctctcctcccctcccctcccctgccctcccctgccctcccctgccctgccctcccctcccctcctctcccctcccctccccttcctttttgacagagtctttctctgttgcccaaactggagtgcagtggagtgatctcaactcactgcaacctccacctcctgggttccccatgttgtccaggtagtctcaaactcctgacctcaggtagctaccatctcggcctcccaatgtgctgggattacaggcatgagccaccgcacccagcccagaaacttggcttatttctggtgggtgtgagaacacacacaagctgacccatggccacgtggcgatctgtgttttcagtcaggctgctccttcctggcagtggggtctgggcacctcctcatttcctaggaggggctgaagcccaaggcacctgtgggtgcctggaacgtgctgacgtcatggagcgggggtgtcctgcaagtgcctgaggctggttttctcccctccaggccaggaagaccagagactggtgtgttcctgtttggaaactgacaacaaagcggggcacggtctgaaataactgtgtgttcccttcctaagaaaaatactctgtgactcttaaacaaacacaagacattccttttctccagtgaagagctgcaggtctttggtgactcaggcacagcagtaggaccccctgtgtgagcccaggcgtcaggcatgtgtgttgggggtccctccactccatgataaacttctactcaagtgctctgatttgacagtgacattttcagatgtaggaaacagttgtcagctgggcgcggtggctcctgcctgtaatcccagcactctgggaggccgagatgggcagatcatgaggtcagaagatggagaccatcctggctaacacggtgaaaccccatctctactaaaaaaaaaaatgcaaaaaattagcctggtgtggtggtgggcgtgtgtagtcccagctacttaggaggctgaggcaggacaatagcgtgaacccgggaggcggagcttgcagtgagccgagatggcgccactgcactccagcctgggtgacagaacgagtctccgtctcaaaaaaaaaaaaaaaaaaaaagaaaaagaaaaaaagaaacagttgttttctcactttgcctcggttggttttgtattcagaatgaaaaccttggggcacccaaaacacggggttcagagaggcccctggaagtctctggtctgccccaccgtggggtgaacagagcctgcaggccagagtttgccggatgacttggccaaggtagggttcaagttccagcagtggtgtgtgggcatggagactctggcttcctgtggcggggtctgtgccgcctgaaggctgattttggaagcaggcagcagttgcagcagcttcagccagtgtggaaatgtggttttgaggccctggtctccagttgccatctgtaaggaggtctggagggcggtcctgcacaaggccttgtctgtggcggccaactcggtctgttggaaactctgcatgaagacggtgaccttgtgggagcggctcaggtggaagggagggtgtttcttgtttgtggagcacctttcttccttccctttgacaaatgatggcaagcattttcctcagcaccacacagacttcggcattgtctgttcttgttcttggctctgttttcaagtctttgagaggtatctttggaaaagatatggggtgcctaggtgagcgtcccttcttggtgagaacagccagagagccctgctggaggacggcccagctgggctcagtgacacgcctggtgtcactctcggacgtgacctgacggagcggtttttccttctagtctggtaggacggcccttcagatcggggacagcctgaacaccgaaaaagcgacactgattgtcgtccacacagatgggagcatcgtggagaccaccgggctgaaaggcccggcagctcccctcaccccaggtacagcggtgcctgcaccccaggcctcgggcaaaacacgtttcagaatagctagaatttatttcagggatttatttacttgtttctttttgtggtaaatttggaatatcatctattaatagattttaagtaaaagcattggaattttcctgaccaagaagtttttccgccgttgaaggaggtggcgctgccggggaggtggtgtctgagatgagagtgtactatgcttcccggtgtccggcctctcaccttcaaacactttctctgcccaaggtcctcagtctcctccaacccctctggctcccggccaagaaaaaggtggaactaaatacaactgggacccttctgtgtacgacagtgagctgcccgtacggtgccggaacatcagcggcactctgtacaagaacaggctcggctcaggtgaggactgccacttcagactccaaagttgtattcccctttgtaacccccctagcataaattgggggctgagaaagatgaaaatcatggcacctagaactagttaagaagacagggctgggcgcggtggctgatgcctgtaataccagcactttgggaagccgaggcgggtggatcagaggtcaggagatcgagactatcctggctaacacgatgaaaacccgtctctactaaaaatacaaaaaattagtggagcgtggtggcaggcgcctgtagtcccatagtcccagctactcgggaggctgaggcaggagaatggcgtgaacccaggaggcagagcttgcagtgagctgagatcacgccactgcactccatcctgggcgacagagcgagactccgtctcaacaacaacgacaacaaaaaaacaagacaaaaggtgcaggtgacacccagttcctgtgaactgagctgaggcctgggagaggcacgggacagggctgcgcccaggaaccatctgggggtgaaaagccatcgtgacccacgggacaggagacaagcgagaagaagcaggagggaggcagggctgggacgtgttcctcaagttgccaggttagcttgggacttgtagatgaaggctctggaagtgggtaccagaggtgctcagtgtgggacctggttgagcttgcactgcctgtggacagcgggtggagagatcacgtagggggtcagaggcacaggctgcaaaggcagacccgtggtggacctgtcagggccaagtatgtgggtgggtgagatcacatgagccgctggggcgctggtgctggtggaggggttgaggaggcgccaggaggtaggcaatggcagaggtgacgttcccacctgccatcatcatgactgctgcccttccttgcaggcggccggggacggtgcatcaagcagggggagaactggtacagtcccaccgagtttgaggccatggcaggaagagccagcagtaaggactggaaaagaagcattcgctacgcgggccgacccttgcagtgcctcatccaggtatcgtccgtgacctcacctgtgctcagcacacagttcagacgtggggccctctgaggcggcccagccagagggagggcacagaccacggggtcagacaaatggggtttgcagcctccacctgctgtctgtgtggccttgggcgagtgatttaccctctcatgtttcagtttccgggtctttcacgtggggatgacgatgatcgtgaccctgtgaggattgttgggagaagtgcatgaggtcacagcgcctggcacagaatagctgcagaaagggggcgtgtcaaatacacaaaaaatgaaaacagtagaagttaagataatcgcttctgtttgaatgcgtgtgaccctttcaaagtcacctaacttctcgtcagtctactaagaaaagaggacttctaattcctattccagtttagctccttgggtgttgttaaggaagcaattcctgtagagacttttgcaaatcttgaaaggaaagaggtaggtcctgccaccaataatggcattgtgaaaaggagaaggctctggaaattactgtttttgtggttttttttttttttttttgagacagagtctcaccctgttgcccaggctggagtgcagtggcttgatcttggctcacagcaacctccacctcccaggctcagaggattgtcccacctcagcctcctgagtagctgggattacaggtgcccgccaccacacctggcttttttttttttttttttaattttcagtagagatggggtttcaccatgttggccaggctggtcttgaagtcctgacctcaggtgatctgcctgcctcggcctcccaaagtgctgggattacaggtgtgagccacaatacccggcctattttttttgtattttttaatagggacagggtttcaccacgctggccaggctagtctcgaactcccgacctcaagtgagccacctgcctcgcctctcaaagtgctgggattacaggcgtgagccacaatacccggcctaatttttgtattttaatggagaccaaccatgttggtcaggttggtcttgaacttctgaccttaagtgagccacccgcctcggcctcccaaagtgctgggattacatgtgtgagccaccacacctggcctgggcattacctgatttctcacaattttttttttttttgaggcaaaggcctccctctgttgcccaggctggagtgcagtggtgtgatctcagctcactgtaacctctgcctcccgggttcaagcgatcctcctgcctgagcctcccaggtagctgggactatgggcatgcgccaccatgcccagctaatttttgtatttttagcagacacgaggtttcaccatgttggccaggctggtctccagctcctgagctcaggtggtctgcctgcgtcggcctctcaaagtcctgggattacaggcatgagccaccatgcccggccctgattttgcagaatttttatctttatgaggttgggcacggtggcttacgcttgtaatcccagcacttcgggaggccgaggcgggcagattgcttgaggccaggagttcgagaccagcctggtcaacatggcaaaacctgtctctactaaaaatacaaaaattagctgggtgtggtggtgcaaacctataatcccagcttcttgggaggccgaggcatgagaattgcttgcgccggggaggcagaggttgcactgagccgagaacgtgccactgcactccagcctgggcaacccaacaagactctgtctcaaaaaaaaaaaaaaaaaaaagaatttttatatttatgaatggtaggtaagtggtaaaagtggttgaaatcttctattattgaatgattgacatttaggggctgacttgctaatgcatggtggttcttttcacatctcaggatgggatcttaaaccctcacgctgcctcttgcacctgtgctgcctgctgcgacgacatgaccttagtaagtggccagcgtgtctggaacaggatgacttggtggggctgggggcggctgagtgggtcccacagcccttggcctctcggctgtttccctcctgccctctgccttggagagagacactgtcctcacttctcctgggttgctctgttccctcctccctgatacgtcacagtgaatcctgatgtctcgatggggaacacgtggttggcccccaagatgttgctcaaagaacatttgtggaaaccttaaataatgaaaagcggttataatgtcaccgccttaactctaaaactaaacatacacgcttttccttgtatgcatgccattttatattcctcattttgtaacatgtcagaaaaatgctactgtaaacttattcatgtgtagagcttttaacgcctttttgacgtatttccttattctaaattcttaactgcttcacaaagacccaaaataatttttctttctttttttttttctgagacgaagtctcattctgtcgcccacactggggtgcagtggcgcggtctcggctcactgcaacctccgcctcctggattcaagcacttctcctgcctcagcttcccgcgtagctgggattacaggcatgtgccacaatgcccagctaatttttgtatttttagtagagatggggttttgccatgttggtcaggctggtctcaaactcctgaccacatgtgatccgcccgcctcagcctcccaaagtgttgagattacaggcgtgagccactgcacctcaaaaaaaaaaaaaaagagcatggagagacctaccgtgttcttggggtgaaacactaaacatcctagaattgtgtagttgatatatagatttcatgtgattctagtggaaaaaacaattttgtgaacgtaaaataattttgaagttgattgggaaaagccagtcggtgagactcttagagacgctgcaggagtaaaggagccgggaggagacgtcggtcccattggcagttgagcctgcaggtagatcatttgcaggggctccaacactgaagtacttagatgtcagtctaggaaatcatgtacagggtttgtacgtggaagatactaaagaaaatgctgaagagagagaccagggaagattgaaatacgtcaaaagacgtcctgcgcccgtggattagaagactcagtaaagatgcgactttttcccaagttgattcgtaggtttaacacaatgactatcaaaatcccagcaggattctttttagatgcagacaagctgattctaaaatttgcatagaaaggtaaaggaaataaaaaagccaaaacagttttgaaacaaaaaagccaaaacagttttgaaataaaagtttaaaatgggtggaatcacattgcggggtcttaagacttacgggctcgtgacagtaatcaagatagtgtggcactggcagagggagagaccccacgatctgggtcagactagagtgtcatagtagactccagcaaatggccttggagtgacaggacgttcatcagcagagacaaaggatgacctaaacttcacacttggtacaaaaatgaattcaaaatgggtcatcgatctaaagtgaaaggtgaaactataacatttttaggagaaaacacattggaaaatcttcctgacctggagttagaactaggatttcttggattggacttcatcaaattttagaacttttggcttccgcttggggagtggtggtgtgatgagctcagtggaccaactctccagagaaataactagtgaaaattgtgaaaaaataaccccttaaggtctccagaaattgtcctaggggagtacagcaaataaacatccaagaaaatgtagtaagtcttggaaagggcagtgaggattgtgacgtttgagctacgaccagctccttccctccctttctgcccccagctccctatggtggaggctccattgtgggtggttgtgaccaagaaaacggttcccactccttgcagttcccggtcaagggatatggtatctcactgggaggggcaggccaccagcatttctcaaccccttcagctctaagttgcagtaaattcctgggaagtgtgactgaaaatctcttcagtcatccccactcagagggcagaggctttacccaggcatgggaggccaagcatacggagccccaatttccatcaacccacattgcccatagggtggggtgtccatgcagtgagaggctgctgccccccacacagaacccggctaatgcaacagaattccctctgatagactcaggcactgttcctgcctctaggtctatagtaggggctcagacattcagcccaaaagagagagaggccgtaagaacagagagctccaaagcccctcccaaaggaactgacttgatttgaaacagtatggggatgttcaagcctaaaagtgccctggaaaagaatggacattttgatggtaagcagttaagaggaggccagcagttccattagagcaagaaactaaactgtaggtcagcaggtttaccagagaggcgaggaaagccacagcgaagaacccatctgggaaaccgaccttcaagatcgaacctctcagtaaagaagccctaatttaattggctcagacagtggagcagtgtgtgccccagggcattgttgaaagtaatggagcaggcagctggcagttagttgattctgacacttgactacaccaacagcttaacagagatcaggaagagcgacagccaaaactcccaccaccaaaggtgattgcaccccacccagggccgagccctcagaggagcagcagccgaggccgccccaggagaacaggctcagtaagatagtccagctccgtacctgagtaataaacaagctgacagcagcaaggatcccagagaaaggagaactgctttccactgttgctacaatgtatcacctgcggtgtctgattcttaacaaaagatgataagacatgcaaggagccttggaccatacacaggaagaaagcaggcaacagaaattgcctggagaggtccggatgttggggttaacaggaaaaagctttaaaatggctatcctcagtatgttcagaggactgaaggaaaccacagctagagattgcatggaaggtctgaagacactgtctcctcactggagaatgtcaatgaagagatataaattatttaaaaaaaaaagtcggccgggcgtggtggctcacgcctgtaatcctagcactttgggaggccgaggtgggcagatcacgaggtcaggagaacgagaccatcctggctaccatggtgaaaccccgtctctactaaaaatacaaaacactagccaggcttggtggcgggcgcctgtagtcccagctactcgggaggttgaggcaggagaatggcatgaacccgggaggcagagcttgcagtgagcccagattgtgccactgcactccagcctgggcaacagagcgagactctgtctcaaaaaaaaaaaaaaaaagaaagaaagaaaattagccgggtgtggtgacacatgcctgtaatcccagctactcaggagactaacgcagaatcacttgaacctgggaggcggaggttgcagtaagccaagatggcgccactgcactccagcgtgggcagctagagtgaaactccgtctcaaaaaagaaaaagaggtgggatctttaggggcgcttaccatcttaatgtggtctcaccatgtgactcacacaccccgcggtgcccccacttaaggaggagttgcaagcgcagcatagcttttgcacacatgaaggtggtggcctctctcctttctcccccagagtggcccagtcaggctttttgtgccttacaaaaggcgcaagaaggagaatgaactgcccacaactcccgtgaagaaggactcccccaagaacatcacattgcttccagccaccgcggctaccacctgtgagtttgagaaaacacagctctagtttactgaggggacctgagtgcattgccttctctcgtcaccactcccacggccactgcgggattctcacttctaaagcacattgcgtggccagagggattccaacgccatcacactcctttgcagtgcgtcccccgggtgggaaggggtgtcccagtgcccagctcggtcttgcttccctgggacccggacactgttggccttgtcctgggctgtttcctagtatgagtgagcatggctgagtgcccagcacacgctcaggggacgtttcctgacaagggcgtccttggtgagggattctcagtgcgctggacgagggctgcggagagctctgtgggtctttctctgtggccgggctggagggcggcgtcaggatcccggctcgctgcagcctcggcctcccaggctcaggcactgctctcacctcagcctcccaagtagctgggaccacaggcacgtgccaccatgcccagctaatgtttttatttttttgtacagacaggatttaaatggggagaggtagcaataggagaaaatgtctttgtaataggcttttgttaactaagtctgggtttttgcatttatagagtaaggtctttctaaaacaccctgtcagctccttcctgaggccctgggtggtgggtgcaggaagagtcccacagcagcagagtctcaagatctgtcgccaggatttttttttgagctggagaggcagccttgctgtgggacacagggcagccttgctgtgggacacggctgctttttaccttcagcttggattaaagattttttcttaattcgaaccacgaagtacttaaaaatcactgaaagttttattttatgtttgttttctggctgggcagcacatttccatggttcacagtttaaacagcgaacaattggtagtggcaagttgccatcctggccatcctggttttctcctgtgaggtcttctccaaggtctgggatttcccccgtgtccttcacatgggagggtacagttaccactgcccgcccttcagcccaggcccccacaaggattggcgcccgtgggtggcacgggacctgtgtgccgtgggcgccactgcctggccgcgtgaaatgtgcttctgcctttccagtcaccgtgaccccctcgggacagatcacgacctcgggggcactgacctttgaccgagcgtccacggtagaggccactgctgtcatatcagagagtccggcccagggcgacgtcttcgcaggggccacaggtgagctgctccagtgcctgcctgacgcgtcctcagcatatccctgtctgtgacatcacatccccgacgccacattgggctgcataggctgctgggtgcctcgagaggggccttgaaccaggcgtttgttggtggggacagcgtgtgagccacgtcaggtgggcggtgcagtgtggatggggttggcgtgtggcagtgggttacttgtgacagatgccagaactggcaaagctgaaaatactctctgtctgccggctcctgcttttgactgcagttgtgcaacagaaatgcagcctagctggttgtgtgctggagaatattctagaagccacactgaggaaaatagagttagaactgatttttttttttttttgaggtggagtctcgctccatcccccaggctggagggcagtggcatgatctcggctcattgcaagctccgcctcccgggttcacaccgttctcctgcctcagcctcccaagtagctgggactacagcgcctgccaccatgcccggctaatttttttttggtatttttagtagagacagcgtttcaccatgttagccaggatggtctctatctcctgacctcgtgatgcgcccatcttggcctcccaaagtgctgggattacaggcgtgagccaccgcgcccggcctgatttttataatctattttatttcacctgatatagccccaatcctattatgtcaacgattcaggatcaccacatttcaggggctcagtagccacgtgtggccataagctactatgtgtactgaatggcgcagccatacagcgtgatatttagagtctgctgtgcggacaaccatcccgagcctccctgtcctttttctccccaacagtccaagaggccagcgtgcagcccccatgcagggccagccaccctgagcctcactaccccggctatcaggacagctgccagatcgcaccgtttccagaagctgcgttgccaacgtcacatcccaaaataggtaggtttgaaagaattcacacatgtacaggttattgtcctcagaattgcttccaatgaaagaattcctaagtgaaatgggattcattttggtttggtttgttgtttttgttgatgcattagatcagtggctggtaaagtgtggcccactgcctatgtttgtaaataaagttttactgacacacagccacgtccattcatgtgtgtgctgtggaagttgcttttggtacagcagcagggcacgcccctagaaaccagttggcctgtgaagcctgaagttctttctggtgagtttgctgttgtcctcttgagggtagacactccccagtggcaggtcttggtctctccagagctggcatagacattcggtatctggtgaaagaaagaaaaaccaaggcctaaatgtggcctaaatctttaaaatgacgatacactgtaaatgcattctaactttgatttttcgtttaactgcacttctatttttttgagactgagtctcgctctattgcccaggctggggtgcagtggcgcaatcttggctcactgcaacctctgcctggttcaagtgattctcctgcctcagcctcccaggtagctgggattacagatctcgaactcctgacctcaagtgatccatccgcctcagcctcccaaagtgctgggattacaggtgtgagccaccacatgcagccaagatttctgtataattatacgttttttgtttttttttttgagacagagtgtcactctgtcgcccaggctggagtgcagtggtgcgatctcggctcactgcaacctctgcctgccaggtttaagcaattctcctgcctcagcctcctgagtagctgggactacaggtgcacgccaccatgcccagctaatttttttttgttattgtatttttagtagagatggggtttcaccatgctggtcaggctggtctcaaactcctgacctcatgatccacctgccttggcctcccaaagtgctgggattacaggcgtgagccatcgtgcccagccatcattatacttttttaaagggtgcatatgatcaatacatgattgattgaaccctcccctgctggtggcaaatgcatgttttccatttttcactgtcacagacagcgcaagaaacttgttcatgaaaaacttaccttttcattttcatttgcttgtttcattattctctcttttgcctatctaaactctttccatctttaaagcttacctcagggctgggcgtggtggctcatcctttttttgttttttttttgagatggagtcttgatctgttgcccaggctggagtgtagacttcaggcacgcgccaccatgcccggctaatttttgtatttttagtagagatggggtttcaccgtgttggccaggatggtcttgatctcttgaccttgtgatctgcctgctttggcctcccaaagtgcttggattacaggcgtgtggcttacctgtttaatcccagcactttaggaggccgaggccaggagtttgagaccggcctgggcaacataaggagaccccatctctattaactggaaaaaaaaaaaaagtgtggggtgggtgttggtgaagtatttataccaagaaatcagcaaatgcttgaaatcagagctttttctccaggagggctggggttcgcatcgaccgcttgcccctggtacaaggtgtgcatgtggctcctggatctctgtccccaggtgcccttggtgggcagaagtcagaaatgttctcatgtgcacgtgtgcgtgtttgtgctccaaatctgtgtgtgttgaaaaccatgagtttgccccagtgtctctagttccagtgcagaacctcagggtttgtgctagttcctttgtaactttcttctccaattgtaagaaaccccgctgggcgtggtggctcacgccggtaatcccagcgctttgggaggccgaggcgggtggatcacctgaggtcaggagtccgagaccagcctgaccaacgtggagaaaccccatctctactaaaaatacaaaattagccaggcctggtggcagatgcctgtaatcccagctactcgggaggctgaggcaggcgaatcacttgaacccgggagggcagtgagccaagatgatgccaccgccctccagcctgggcgacacagcgagactctgatttagccacttccctcccctggtcattgtccacggcgctgattctgcgaacatttcagggtccagcagccgcattcagatgagttgtacaacatggagctgggtgggtggagcaggaagggatgggacatcctcctgcctgtgttgcctgctggggggatgtcaggctgagtgctcggggatgtcaggtgctggggggatgtcgggtgctggggggatgtcgggtgctgggggtgtcgggtgctggggggatgtcaggctgcgtgctgggggatgtcaggtgctggggggatgtcaggtgctgggggtatcgggtgctgggggatgtcaggctgagtgctgggggatgtcaggtgcttggggatgtcagatgctggggggatgtcaggtgctgggggtgtcgggtgctgggggatgtcagatgctggggggtgtcaggtgctgggggggatgtcgggtgctggggggtgtcggatgctgggggttgtcgggtgctggggggtgtcgggtgctggggggtgtcgggtgccggggggtgccaggtgccccgggggatgtcgggtgccgggggatgtcaggctgcgtgctgggggatgtcaggtgctggggggtgtcaggtgctggggggatgtcaggcagtgatttgttgtttgctggtcagttttttacccgacttcccaacattgcgtgagagttttcttttcttttcttttttgagatggagtctcactctgtcacccaggcttgagtccactggcaccatctcggctcaccacaacttctgcctcccaggttcaaatgattctcatgcctcagcctcccaggtagctgggattatagacgcttccacgcctagctaatttttgtattttttggtagaaatggggtttcaccatgttgaccaggctagcctcgaactcctgacctcaagggatctgcccgcctcggcctcccaaagtgctgggattacaggtgtgagccactgtgcctggcctcttttctttttgagacagggtctcattaagtcaccaaggccgaaggacggtggcgcagtcatggctcactgtagcctcgaccacctgggctcaaaccatcctcccgcctcagcttcctgagtagctgggatcacaggtgaatgtcaccatgcccatctagttctttgtttttgatttctgttttgtagaggcaaggtcctgctatgttgcccaggctggtcttgaactcctgagctcaagtgatcctcccacctcagtctcccaaagtgcagggattacaggcatgagccactgcaccgggtgatgagaatttttatttattttttatttttaaattttatttgtttatttttttgagatggagtctcactctgttgcccaggctggagtgcagtggtgccatctctgttcactgcaagctctgcctcccggcttcacacctttctcctgcctcagcctcccgaggtagctgggactacaggcgtctaccaccacgtccagctaattttttgtattttttttagccaattttttgtatttttttgtatttttttaaacacagtgaaacgcggggtttcactgttagccaggatggtctcgatctcctgacctcatgatccgcctgccttggcctcccaaagtgctgggattacaggcgtgagccaccgcgcccggctgagaatttttaacggaggccattttgaagctaggagatgtattaatttcttggtttgttttgctttccaaatgctctagtgttgacatccctgcctgcgctggcggtcccacccccgactcccaccaaagcggcacctcccgcgttggtcaatgggctggagctgtcagagccgcggagctggctgtacctagaagagatggtcaactccttgctcaacacagcgcagcagctgaagacgctgtttgagcaagccaagcatgccagcacctaccgagaagctgccacaaaccaggccaagatccacgctgacgcagagcggaaggaggtaaccttggaacaaatgggaagacacgacctgtgccgagtaaccccaggccaccctggtgcctgtgcccagctgcgcaagccccaccttggctcacaaggcccctgccccacctttctggaaaagggagctgtggagagtcatttacaaatgaagcttttcctaaagaaaagtgacagctattgttgttaaggtggttttggtttttgtaaataaggttgctttgtttcagaaagggaaacaattttgtgcgcatcggccgttgtgaatactcaccttttctaggcattattcatcctttgtcttcctgtagtgaaatgtgcttatattttatgaagtttggagaacatcatctattgagtctctgagtatcagcgactggcagggcgaatgctgagccccttcctgggagccgagctccgtccatctgctgtcacaaagccctcccagcttctggcacgttcttcagaaggcggctcctgtgcatggtgggaggctcacagggcgtagtgcccatgttttctgtagcttcctattactgcagcacaagcaaaaggtcacttaggccccttcggcctcttttcatatggagtctctacttcatatgaaccctttacttagattgaagactttgaggtaatataaaggttcaggtgggtgacatgaatagggtagatagaaattactagagccagagtaaactggagagagggtggaggtttctcagctacttctcatagcccaaacccagcagacaggtaccgtgtgtcacagggcacggggacgagaaggtgagagaggagggcgcctgtctgctcagcacagatggggagctctgaaggccacaggaaaggacagggatggattttgttgtagctgctttttcgggtacggtaacgtggactttggtttgtaaacaaaagtcaaattcatatttttcccaccaaatctatgtaagaaacgttttcccccatttcttttctactttctatttttatttttatttgtggaacaggctgtcactctgtcgcccaggctagaatgcagtggcacaatctcggctcactgcaacctttgcctcccgggctccagcgattcttgtgcctcagcctcccaagtagctgggactacaggcacccaccaccacacctggctaattttctgtatttttggtagagacggggttttaccatgttgcccaggctgatctcacactcctgagctcaggtgatccacccgcctcagcctcttaaagtactgggattgcagatgtgagccaccatgcccagcttctactttttatagaagaactttttatttatgtatttattttattatcattatttttttttcagctgctgctttattttactttattttattttttgagacggagtctcgctccatcacccaggctggagtgcagtggcacgatcttggctaactgcaacctccacttcctgggatcaagcaattatcctgcctcagcctcccaagtagctgggactacaggcgcctgctgccatgcctggctaatttttgtatttttagtacagacagggtttcaccatgttggccaggctggtcttaaactcctgacctcaagtgatctacccgcctgagcgtcttaaagtgctgggattatacgtatttatttatttatctatttaaaaaaaatttttttttttgagacggagtcttgctgtgtcgctcaggctggagtgcaatggcacaatctcagctcactgcagcttcctcctcccgggttcaagtgattctcctgcctcagcctccggaatagctgggattacaggcatgtgctaccacacctggctgattttttgtatttttagtagagacggggtttcactatgttagccaggctggtcttgaacccctgacctcaggtgattcacccacctcagtctcccaaagtgctgggattacaggcatgagccaccttgcccggcctatttattttttaatttttaaatttttctgtcattcagtgcacatcaggtacttgttatagattctactagacaagcacataacgaacagtgattatcatcccaggccgtattcaatgttaggggtttgttacggattctactagacaagcacataatgaacggtgattctcaacccaggccgtattcaatgttaggggtttgttacggattctactagacaagcacataatgaacggtgattctcaacccaggtcgtattcgatgttaggggtttgttacggattctactagacaagcacataatgaacagtgattctcaacccaggtcgtattcgatgttaggggtttgttacggattctaccagacaagcacataacaaacagtgattctcatcccaggccgtattctatgttaggggtttgtgtagtttccccaggacctgtagtggtgattgtccagaagccttccataggaggaatgcatggtcattaggtatgccacagctccaaacaccagcaacaccactcaatgactattgaggtaatgacagtgacactgcagctccacatggctggggaggtctcaccatcatggcagatggcaaagcgggaggaaaggcatgtcttaatggtgacaggcgagcagaagagctttttagattcttaattttttaaatgactgatcaatatgtgattagtgttttttgtgtttctttttttttttttttttttttttaagaggtaaggtctcactctgttgcctaggctcatggctcattgtaggctcaaactcctggaaatacgggtgcatgccaccacgcttgcctaatttatttttttattttttattttttgtagagactgggtcttgccgtgttgcccaaggtggtctcaaactcctgggctcaagagatcctcctgcctcagcctcccaaagtgctgagattacaggcgtgagccactggacccagcattaattttctttcaaggaagaaaagtgtttctactcctgaagacaaagataattttaaaatactttttcactgggcacagtggatcacacttgtaatctcagtgctttgagaggctgaggtgggaggatcttttgagcccaggagtttgagaccagcttggacaacatggtgaaaccccgtctctacaaaaaaatataaaaattagctgggtgtggtggtgggcacctgtagtctcagctacttaggaggctgaggcaggagactcacttgaacccaggaggcagaggttgcagtgagctgagatcgggccactgcactccagtctggcgacagagcaagactctgtctcaaaaaacaaaaagtccaggcgcggtggctcacgcctgtaatcccagcactttgggaggccgaggcgggcggatcacgaggtcaggagatcgagaccatcctggctaacatggtgaaaccccatctctactaaaaatacaaaaaattagccgggcgtggtggcgggcgcctgtagtcccagctccttgggaggctgaggcaggagaatggcgtgaacccgggaggtggagattgcagtgagccgagatcgcgccactgcactccagcctgggtgacaaagtgagactctgtctcaaaaaaaaaaaaaaacattagccaggtgtggtgacatgccagtcaagaggctgaaacgtgaggattgcttgagcctaggaggttgatgttgcagtgagccgtgatcacaccactgtactccagcctgggcaacagagtgagacctcgtctcaaaaaaaaaaaaaaaaaacaaaaacaaaaagaaaaaagaaattaaaaaggaaaaaaataaagaaaaagatatatatatattttgagatggtcttgctgtgtcacccaggctagagtgcagtggtgtgatctcggctcactgcagcctccatctcccaggttcaagcgattcttgtgcctcagcttcccagatagctgggattacaggtatgtgcaaccacgcccagctattttttggtattttaggagagaagaggtttcgccatgttggcgaggctggtcttaaactccaggcctcaagtgatctacttgccttggcctcccaaagtgttgggattacaggtgtgagccaccgcacctggccaaaaaaatactttaaaaaaaaaaaaaaaaaagtatacttccaaacaaacagctacttaatgctgaaatttatagaggaaaagaaagtttaaaggcaaaaaaatctataaccctgcacccaaagataatgaccgtgaacacttactgtgtgtccttttggtcttttttggtaattgaggtaaactgtatgtacagcaaagtgcctcaatctccaccataaaatgtagtgagttttgatgaatgcatgaacctggtcatgagaccatttcaatccctgcagaagcaccactcatgtccccttccatcggtcccctgccccatggacagtcactgctctcatttttttttttttcttttctcttttgaggcagcatctcactctgtcactcaggctggagtgcagtggcatgatcttggttcactgcagccttgcgccaccatgcctggctaatttttgtattttttgtaaagatggggtttctttttttttttttttttttttttttgagacagtctcacactgtcacccaggctggagtacactgatgcaatctcggctcactgtagccttcgcctcccaggtttaagtgattctcctgcctcagcctcccgaatagctgggattacaggcacatgccaccatgcccagctaatttttgtgttttaagtagagacgaggtttcaccatgtttgtcaggctggtcttgaactcctgacctcaggtgatcctcctgcctcagcctcccaaagtgctgggattacaggcatgagccaccgcacctggcctcttttttttttgagacaagtttcgctcttgttgcccaggctggaatccaatggcacaatctcggctcgccataacctccacctcccaggttcaagagagtctcctgcttcagcctctcaagtagctgagattacaggcatgcgccaccacgcccagctaattttgtattttcagtagagacagggtttcaccatttaggtcaggctggtcttgagctcctgacctcaggtgatctgcccacctcggcctcccaaagtgctgagatgacaggtgtgaggtactgcacccagttgattttctagatttcctaccacaactgatttctaattcaactccaatatgcttagaaaatatactctgatttcagttcttttaaattgattacgatttatttcggccaggcatggtgactcacacctgtaatcccagcactttgggaggccaaggtcttgaggccaggagtttgagacaagcctggacattgtgagaccctgtctgtacaaaaaaaaaaaaaaaaaaaagggtcgggtgcagtggcttacgcctgtaatcccagcagtttgggaggccgaggcgggcagatcacaaggtcaggaggtcgagaccatcctggctaacacagtaaaaccccgtctctactaaaaatacaaaacattagccaggcatggtggcaggcacctatagtcccagctgctcaggaggctgaggcaggagaatggcatgaatccaggaggcagagcttgcagtgagccgagattgcaccactgcagtccagcctgggctacagagcgagactctgtctaaaaaaaaacaaaaaactttttttttaaagggtttcactttgtcacccaggctggagtacagaggtgtgacctcggctcactgcagcctcaagttcccaggctcaagcaatcctcttgcctcagccccccaagtagctgggactatgggcatgtgccaccatgcttggctaatttttgtatttttcatagagagagggtctcactgtgttgccaggctgatctcaaactcctgagctcaagccatccacccacctcagcttcccaaagtgctgggattacaggcatgaaccactgtgcccggccaaaatgtttccttcattagccggatcactggagcccaggggtagaggttgcagcgagctgtgatcacgccactgtgctccagcctgggcaacagaatgagaccctgtctcaaaaaaacaaaaagatgtgttttatgatcatgtatatacttttcgtggtgaatattgcatatacacttgaaaagagttttattcagtcattggttttcgttttctgtaatgtcattaggtcaaggtggttcatagtgtggtccaaatcttgtttttcttcaacctaaagatgtactttcagcttttcttttcatataggtctgttggccatgaattctctgtttttgtctgtaatgtccctctttcacctttatttttgagggacgtttttgagtgacatggaattctgggttgtcacttacatatatatatttttttgagacagagtctcgctcttgttttccaggctggagtgcagtggcacaatctccgctcactgcaacctccatttcccaggtttaagcaattctcctgcctcagcctcctgagtagctgggactatcggcgtgcgccaccacacccagctaatttttgtatttttggtagagacggggtttcgccatgttgctcaggctggtgttgaactcctgggctcaagtgatccacccgcctgggcctcccaaagtgctgggattacaggcatgagctaacacgccggcctatttatttatttattattttttgagacaaagtctcactctgtcaccaggctggagtgcagtgatgccatctcggttcgctgcaacctccgactccctggttcaagcgattctcctgcctcagcctcctgagtagctggaattacaggcacacaccaccatgcccagctaattttttgtatttttttattagagacagggttttgccatgttggccagaccggtcttgaacacctgaccgacctcaggtgattcacctgcctcggcctcccaaagtgctgggattataggcatgacctacctgggttgtcactttttatcattcaccagtttaaagatgtctttccatcatcttctggccagcctgcctacctgccttccttccttccttccttcctttcctcttttcctccttccctccttccctccctccctccctctctccttccttccttccttcctccctccctccctccatccctcccttccttccttcttttttctttcttttttgagacagggtcactgtctgtcaccgaggctaagaagcagtgttgtggtcacatctcaatgcagccttgagttcctgggctcaggtgatcttcccttagcctccagagtagctaggactaccggcactggccactactcccggccaatttttagctggggtttcaccatgatgcccaggctggccgcaaactccttggctcaagcgatcctcttacctcagccttctgagtagctgggactacacatgtgtaccaccatgcccagctatttttttgtttgttttgtatagatggggtttcactatgtttctcaggctggtcttgaactcctggactcaagcaacccaccttccttggcctcctaaagtactgggattaccagcatgaaccactgctcctggctataactatttctttttttcttttttttttttttttttttttttggagacagagtcttgctctccaggctagagtgcagtgacacgatctcagctcactgcaagctctacctcccaggttcaagcgatctcttgcctcagccttccaagtagatgggactacaagtgtgcaccaccacacctggctaatactttgttgttttgttttgttttgagacggagtcttgctctgtcgcccagggttggagtgcagtggcacgatctcagctcactgcaacctctgcctcccgggttcaagtgattctcctgcctcagcctcccgagtagctgggactacaggtgcatgccaccactcctggctaattttctgtatttttggtagagaggaggtttcaccatgttagccaggatgttcacaatctcctaacctcgtgatctgcccgcctgggattacaggtgtgagccaccgtgcccagcctcaggatctgcttcttttggctactttttcccttcatcatggatcctgttatcccttcttcacacgtccagtacttcctgattgtgtgttggaattttagtttatatactgtttatatggtagagtttatatggtagagactctgaattttgttggattctgttgtcttcccctgaagagtgttgggctttgttctcgcaggctgaattcttatggatcaccctgaagaggatcagtgttgatgctgttagggcaggtctgtctggctttttcttctgcctgacacatccttagtcttggatctgcgaagctgtggttttctggatgttcctgggaagtccgtggtgtttttaagcctctaacttgtgaaggttcaaactccagactttcaggtggtgagcagcagccgcagtctctgctcagtgttctcggtcttcagccgtccatttctgctgagtcttccccacatgctgtgtcatcagctcagggtcaaacaaggacgtggggagcgtttatgtgctggatgggagtgtcctctctctgtgcttgctcctttctagggtttctcccctcattttccagccactttgtcagctctggccagggtgactgcagcctgctaccacggtgtggccgcccatgtctggtggcctggggctgcctccaggagaagccttcctggctccatctccctgctacgtcacctgtccctgctatgtcacctggctgcctctctcccctgctcatttggcagccagagtgtctgatgctgctgcgtcagctgggtccctgccctgaaaggctgggctttgaattttattagtaattttatgtatttctatgagagaaatgtggcatgaaatccctttatccttaaaatcccgtttggtagacagccaagccttttaaaacgttagaaagggcggcccctttctcagctggaagcagctgttgcagtgaacatcccgtgcatctgaaaatgtcaggagttagaagaaatgtcaggaagtgttagaagcgatgtgttccctttctctaaagctgtgtatcggacgtgtcattcataaagccattacttgaatagctgagccaggactcagaggctctgagtgtgacaccctgtcctcctcctctcagtgtgaatagctgagccaggacttagttagagtgaccgagtgtgacaccctgtcctcctcctctcagtgtgaatagctgagccaggacttacttagagtgaccgagtgtgacaccctgtccttctcctctcggtgtgaatagctgagccaggacttacttagagtgaccgagtgtgacaccctgtcctcctcctctcggtgtgaatagctgagccaggactcagagtgaccgagtgtgacgccctgtcctcctcctctcggtgtgaatagctgagccaggactcagagtgaccgagtgtgacgccctgtcctcctcctctcggtgtgaatagctgagccaggactcagagtgaccgagtgtgacgccctgtcctcctcctctcggtgtgaatagctgagccaggactcagagtgaccgagtgtgacgccctgtcctcctcctctcggtgtgaatagctgagccaggactcagagtgaccgagtgtgacgccctgtcctcctcctctcggtgtgaatagctgagccaggactcagagtgaccgagtgtgacgccctgtcctcctcctctcggtgtgaatagctgagccaggactcagagtgaccgagtgtgacgccctgtcctcctcctctcggtgtgaatagctgagccaggactcagagtgaccgagtgtgacgccctgtcctcctcctctcggtgtgaatagctgagccaggactcagagtgaccgagtgtgacgccctgtcctcctcctctcggtgtgaatagctgagccaggactcagagtgaccgagtgtgacgccctgtcctcctcctctcggtgtgaatagctgagccaggactcagagtgaccgagtgtgacgccctgtcctcctcctctcggtgtgaatagctggagtcaggacttagaggctccgaatgtgataccgtttctgtcttcctcctctcagtgccatggcttggggtggatactgcttcacactccttcagggtggcccagacacagtaggtttcattttcctttttttttttcttttctctggtggctacaaaagtgaactttttttcttttttttctttttctttttttcttgagacagagtttcgctcttgttgcccaggctggagtgcaatggcgtgatctcggctcaccgcaacctctgcctcctgggttcaagggattcttctgcctcagcctcctgagtagctgggaatacaggcatgtgccaccacgcctggctaatttttgtatttttagtagagatggggtttcttcatgttggtcaggctggtcttgaactcccagcctcacgtgatccgcccacctcagcctcccaaagagctgggattataggcgggagccatggcactcggccctattttgtccgttttcttgagacatcttaaatgaacatatagcttcaggaagccatggtagcagacaggaccacagtgctttccgtgatgtggccgtctcctagagtccagcagaccggaccttcgcaagaaaaactgctgaggagatggagaaggaaaggccaaaagcctggtattcactccagaggcagtcgctgaggagatggaggaagggtcaaaagcctgatattcacttcagaggcagtcgctgaggagttggaggaggaaaggccaaaagcctgatttatcagtccagaggcagtcgctgaggagatggaggaggaaaggccaaaagcttcgtattcattccacaggcagttgctgaggcgatttgaggaggaaaggccaaaagcctggtattcacaccagaggcagttgctgaggagatggaggaggaaaggccaaaagcctggtattgactccagaggcagtcttttgttgttgttgttgagtctcactctgtcacccaggctggagtgcagtggcagaatctcggctcactgcaacctccgcctcccgggtgcaagcgattgtcctgcttcagtctcccgagtggctggaattacaggcacgcgccaccacgtctggctaatttttgtatttttagttgagatggagtttcgccgttattagccaggctggttttgaactcctgcgttcaggtgatccaccctccttggcctcccaaagtgctgggattacagacgtaagccaccatgctcaactaggttttgtgttttttatagagacagcatcttgttttgttgccgaggctggtcctgaacacgtggtctcaagatattcgcccagtcagcctcccagagtgctgggactctaggcgtgagcccctgcttctggcccccaggccagtagtaaaaagccaaatatcatccctttcagagcatcaggacagcggttgtgctcagggaggctgggaatgggcatcgtgccctctgggggtgcggcagggtcagttggctggaggatattcatggtgctgctgccccctgctgccgtgctgagggctgacatggtgaacagtcatgggcacttgcagacgtggttgtgcccagtgctgtgtgcatgcagccgttccagcaaaggtggtggtcacttggaccattgtggtgccatcatggtacagcacccaggcaggagcaaggccgttgtgttctggtgagatgatggttctgaattagatgtggagatttctttgagatcagctccacaggtatcttacgagggctcgggggtgaggctcagaagtcctacaaggaggggcctcaacctgtgtcccttcacctgcagcaacagcaacgcggagcaacctccaggagcctggggggcgcctgggctgggcgggagtcggaggtcggcgaggggaggaaggtggtcgcatgttggcgtcctcctgccctgtaggaagtactgaatggttccccacaacagtaggatgaaaatgagtttctgttccctgatcccacgccactgcagaatgggaggaaggctttatgccggggtgtccaatcttttctcttccctgggccacactgcaagaagaggaattgggccacacattaaaaatctcataatttttttttgttttatgagacggaatcttgctctgttgcccaggctggagtgcagtggcgcgatctcagctcaccacacacaacctctgcctcccgggatcaagcgattctcttgcttcagcctctcgagtagctgggattacaggtgcgcactactgcgcccagctagtttttgtattttgccatgttggccaggctggtcttgaactcctgacctcaggtgatccgcccacctcggcctctcaaagtgttgggattataggcatgagccaccgcgcccggcccataatgttttaagaaagtttacgaatgtgtgttgggcctcatgcaaagccatcctgggctgcatgcagcccgcgggctgtgggttggacaagcttgctttgtgccattaaattgttatttgtaattagtgctggaaagtcagggtttgagaggcagacactgctgtctctgaatggaaaggtccacgtgtgggaatgaggaagccttgctcatgagcaccctgacagagcacccatgcctccagcagtgggagggcaggcgtgacgctgccgattccacattgtatctggaatgtttgttttggagatggagtttcgctcttgttgcccaggctggagtgcagtggtgcgatctcagctcactgcaacctgtgcctcccaggttcaagcgattcttctgcctcagcctcccgagtagctggggttacaggcgcttgccaccacgcctggctaatttttgtatttttagtagacgcggtatttcaccatgttggccaggctggtgttgaacccctgacctccggtgatccacctgtctcggccttccaaagtgctgggattacaggcatgagcctcggtgcctggccttttatctggaatttaaaaaaaaaaaaaatcaaatgtagcccagctgaagctattaaggggattgttgccagctttaaccatgggaaatctgcattcgtgtgtatgtaatgagctctgcagagattcaacaaggcagaaaagcagatgcccttggctgtcaagggcacagtgtccagtggaagccagccgagtggctgcagggtcttggactcactgccctggccccggcttgttgttggccatgctgccctgagcgcaaaccccattcctctagcctgtccccgtttctagtagctcgctctcaggctttctccagtctccctaacttccttttaaagtgttaaatatagtacagcacagaagggtatgaaagggagaagaatacgtaagttggacagtaacaatgtccttgactcctaggaagctcagaaataggtctgtgctgtgcctggatggtgcctccgtgcctggggatctggaagggtggagacagaccccagagcagccgcttccctgcgggggcctctcccaacaccgtaaggccgcgggtgcctcaagcagcgccgagaggggcttgtgtttcagtgacatttccttgaagtccaggtatggggtttctgtaaatgaaggcttttgcctgccttgttctccagtgtcagcctaacactcacgtgagccaaataggcccggccagacccaagacagctcagtcacctgttccgcatcaaacatcagattccagagccggactggaccaacgtcctgccgtggcccagtgagcgagggttgctggcgtctttgggatactcgggagcagcccgccatccccgtgtccccagggaactcttcagagcaccccccagcagcgtggaagcccccggaaatgcaggcttggagtcccccgagggagccaggggtgttgtggtgggaggggcggccaggtgcccgggacggggtgaggcggcgccggcggggcagcctgggaaaagcacagaggtggctttgcagtcccacttcagggggaccctgcctgacctgggatgaggtgtgtgggctttctggggcaggggcggggacaggttgtaaatctgaatttgtctgatgcttcctcagagatctgtatcatggtcatttcatagaaacggcaaactctgtcccagctcaaaaagatgctattagactaatcctttgatctctttacgtgtgcggctcagctttcagataaacctgcttgatgttttgagggttttctcttatttccgttgcttcctcgagggagagtaatccagtctaatttgcatttctcttacttttaagctgagctgctgcgccctcacgggacacagtcatggggagccctctgccccatggtgggcattggtgaagccacagtggtcccgggggcagacctcaagggtgcacagcagcagccccttgggccctgcctgcccaagccccacctggccccacctgccctgtgttggggactttgtatttcagcctccatgcagggtgacgctgggactccccagcttccggttcacggcttcagggtccagcaggttctcctgaagccccatctaccgctggcttcctgctcactctcccctctcccgctctgtctctccagaggaggccgggcctgtggaattaggcggctgcttcacctgaactcactgcagtgccgggaaaggagcctctggaactagacccaggagcggatctgcaaaggctactcagggttctcccagcggctctgaaccccgaggccaactcgccctccaatcacctggcccctgaagcaggcggaggcccctgtgcacagtgggcctgtggccccatttggttcaggagtgatggtgacacggagttggctccatcgaggctcctggcagcattacatcctctaagaataagtcataaagaaagcactccttgtaagatacacgatccaccaggctgcctccaaccacagcctcatctccatccggggtgtgtctaggttttcttttttattattattttttatcatttgagacatgttctccctctgtcacccaggctggagtgcactggtgtgacctcagctcactgcaacctccacctcccaggctcaagcaatcctcccacctcagcctctctggtagctaagaggtgcatgccaccatgcccagctaattttttttttttttttttttgtagagacagggttttgccatgtcacctaggctggccttaaactcttgggctcaagcgatgctcccgcctcggcctcccaaagtgctgggattacaggtgtagccaccatgcctggccagtatctaggttttcaagttagacttagttttatttgcagaaagaataatgaatacattattaacttattctttgatagttagaaattaataggcattttatatgtgatcttatggtcttactcttggttggctgtttctgaaggagtggctttgttatctgtaatttgtctaatttaaaaatcaattataatgaaaccagcatatgtgattcacaaggcttttttccacctggaccagagtacaccagctattgcattgccaaaagtaggtgtgttcctgttgtgtgatgtgcagatggggggcccctgcagcagggaaggcaggccaggaaaccccttcgcagtctctgctgaggggctggacccgctgcttgggcgggactccccgcagggtgctctgctgcagtctcctcctctgcccgcctgcggcccagagaactctgaatgctaatggcaatgccagctgcttggcagcatgagcttcttggggcgcctgggcaggcctgggcacttctgccctttgtgccatccgcagtcctgtgatttcctgacagtttcctgaaagcgcagaatgggacttgtcgatgtccttggctgcggaaacgcggtgtcttgtcctaaccttctgcaacgcacacacacctcttccgcagtaatgaatggttttttgtttttgtttttgagacagagtctagctctgtcacccaggctggagtgcagtggcgcgttctcggctcactgcaagctccacctcctgggttcatgccattctcctgccttagcctcgcgagtagccgggagtacaggcacccgccaacacgcctggctaatttttttgtatttttagtagagacagggtttcaccgtgttagccaggatggtctcgatctcctgacctcgtgatccgcctgcctcagcctcccaaagtgctgggattacaggcgtgagccaccgtgcccggctaatgaatggttattttaaaaaataaacgtatttcgggataattttaggtttacagaaaagttgcaaagtgagcgcagagggtcccttctgccactccgcagcctcccctctgtaacttcaaagcccacagggcatggctgttgtagctgagaaaccgtcgctgggtgtccctgtgaactccggactttgaatttcactatcaatgtcctgtttctgctctaggaccttgtccccgctgccacctgtgggagacagcctcccgtgcaccatttgcccagcaccctcaggcctgtgacggtctctcagtctttccttgtcttccatgccctgcagttctgagagggcctggccaggcagtttgtccaggtgccccgatccaggcttgtcttgtgctttctcgtgggggtggacgacaggtttcagggaggggtgctgccgcctgtctcaccccactgtggcgtccctgacatccaagtgacattacagacagctctgaccttcctcaccagagtcaggtgtctgtaggtgtctccttggtgacaggactgcttctccctttgcacatttagtcaggcagcaagtccacggccgtgggggggcttctcctagacgggaggatctggaatagcttggacttgtatttatttatttgatcatttgtttgtatccggatgggctcattttatatgtgttttaaactctgagctagaaggcaacactactttcttgtgaagcacaccatctgtccttggccctagggagctcctgccgtcggctcctgggtcccctgatgcacccctttcaacagacttttcattttggggtacgtcctgacttcctggcactgcagggtgctccagcctcctcttgcattccctgccctggcccgggaatcagccccttctccaaggagccccgggtccttttattggcaagtcttaagagagtgaggcctgggtgccaggcagggagccccaggtccttttattgggaagtcttagagagtgaggcctgggtgccaggtgggtgccaggtgggtccggtgctgctgggatgttgtcacgtggaggccctcagctgcagagcagggacgagggtgtcacctgttcagctgcagagcagggatgagggtgtcacctgtgtgtatgaacatctccgcagccacttctgtatctgtgaagagaacatgagttcatgctactgcctctgactctaattcagaccccaaagctccttctaaccttcctagaacgttatttttcagtttaaaaaaaaaaaaaagttttgcaaagggcataccgcgaaaggcccaagtggttgaaagtcccagctgaggctgaagaggcgcctgcgaggcaacaggacaggcttcccgttcagttcaggggtgctgtcctccaggaactatgctggggggcaagtacaggacgtcctggtgtgtggtgcacagggactgctggacacggagacccgtgcccttctcagcgtgggggccgctccccgggacagtgaccacgctcccgccagcctcccaccccacctgacctctgtctgtgaggggctggaccagggtcctgcctggcccggccatccacagagcaacccagaatgttaataaagcctgcagaagctgtgttctccttcgagaagcttctctgtggttacagactttttaagaaatattttgtcggctgggcttggtggctcatgcctgtaatcccagcattttgggaggccaaggcaggcggatcacctgaggtcaggagtttccgagaccagcctggccaacagggcaaaaccccgtctctactaaaaatacaaaaattagccaggcatggtggcaagcgcctataatcccagctacttgagaggctaaggtggaagcattgctcgaatctggaaggtggtggttgcaatgagctgagatcgtgccactgcactccaggctgggcgacagagcgagactccatctcaaaaaaaaaaaaaaagtttgtcatttaaagtagaggcacaggccaggcgcggtggctcatgcctgtaatcccagcactttggggggccgactcaggtggatcatttgaggtcaggagctcgagaccagcctgaccaatatggtgaaaccccatctgtactaaaaatacaaaaaaattagccaggcgtggtggtccgtgcctgtagtcccagctgtggggaggctgaggcacaagaatcacttaaacccaggaggtggaggttgcagtgagccgagattgcgccactacactccagcctgggcgacagagtgagactccatctcaaaaaaataataataataataaataaataaagtagaggcagggggcaacctaaattagcaccaaaattcctcctaatgctcctgttttctgaagtgagtgactgaatgtcggagctctgaatgtcttacaactggaaaaatgttaaagatcacgtttgcgaaggagggaggcaagcatcagaacagaacctcggagcaggtctgcacgcgtgcaggggccgtggggccgcgctggagtcgtttcctgtgctgctctgtgctgctcacagacgctgccactcacccactggccacggcccctcccgcagctgcggatgatctgggcgcatagcgggcgtgcaggtcgcggcgccaaggcctctcctaggcccagtggtcttctccgtctcagagagcattgacggcggagctcacaactgtcaagcaccttagtcatgccgcaaacattaatcattgacagcatgttgacctatgcgctgattaaaaagaaaagctccaataatgtaattccaggagaaagtacacaaacctctggtggcatcttttcaatccaccacagaaaccagctcaggtggggccgtgggggtgttggctggggcaccgccgcagcagtttgggacacatgcctgccacggtgcgcccaggctgatgcccacagccctgctcaggagtgttgggagcggtggactcctgagtttgattttctgtgctggcctggctggagtgaagctccttggagtttggagaaagatttccatgctgatttccctttgtttttgtttgtttgtttgtttgtttgttttggagacagtcttgctctgtcgcccaggctggagtgcaatggtacaatctcggggtttcaccgtgttagccaggatggtctcgatctcctaacttcgtgatccgcccacctcagcctcctaaagtgctgggattacaggcatgagccactgcatccggccctgatttccctttttttttgagatgggagtctcgctctgtcacccaggctggagtgcagtagtgcaatctcggttcactgcaacctccgcctcctgggtgcaagctattctcccacctcagcctcccaggtagctgggattacaggtggccaccaccacacccagctaatttttgtatttttagtagagactgggtttcgcaacgttgcctgtgctgaactcctgacctcaggtgatccacccgcctcggctgcccaaagtcctgggattacaggtatgagccgctgctcccggcccatactggtcttccagtgaatgaatgtagggggcaaactgcactgaggccaggaaagagctgattctggaggtgacaagaacgttctgagcagcactggggcagaggcgcagtcaagagtccaatgggagctgggcgcagtggctcacgcctgtaatcccagcactttgggaggccgaggcaggtggatcacgaggtcagaggttcaagaccagcctgaccaacatggtgaaaccctgtctctactaaaaatacacaaattagctgggcgtggtgtcaggcacctatcatcccagactcaggaggctgagacaggagaattgcttgaacccaggaggcggaagttgcagtgagctgagatcgcaccacggcactccagcctgggcgacagagtgagactccatctcaaaaaaaaaaaaaaaaaaaaagggggtccaatggggggaacttggggcctcctgcctgcacctgcctctgtccccggtgtctcaggggctctccacggccacgtcactgactggcctgttgtgtccttcttgcagcagtcctgcgttaactgcggccgggaggctatgagcgagtgcaccggctgccacaaggtcaactactgctccaccttctgccaacgcaaggtaggtctcacctacaccaggctcagtgcccccgcctcctccctcgctacgaagacccctgggtggccctccctccccttgtgctcctggtgccacacctgactcccctccctgtccctccctctgggaatccggggctcctgcctggctccgtgaagaccctgcagaaggctcacatgtgacatggccaggtagtgctctcatgtgaggccccacagttggtggccggaaaccctgagggctgctggtcagtgcttcccagccctccacacccctgcacagccacgcaagagagactgtccacagttccattattgagccctccacacccctgcagagccacgtgagagagactgtccacagttcctctattattcagccctccacacccctgcagagccacgcaagagagactgtccacagttcctctattattgagccctccacacccctgcagagccacgcgagagagactgtccacagttcttctattattgagccctccacacccctgcagagccacgcgagagagactgtccacagttcctctattattgagccctccacacccctgcagagccacgcgagagagagcgtccacagttcctctattattgagccctccacacccctgcagagccacgcgagagagagactgtccacagttcctctattattgagccctccacacccctgcagagccacgcgagagacagcgtccacagttcctctattattcagccctccgctccacagaaattcaagagaaattttgtaggctacaaacggtagttcaggattgtataactttgtctaccataatcagagtactcgggagcatttagtcactctttttttttttttttttttttttttttgagacagagtctcattctgtcacccaggctggagtgcagtggtgcgatcttggctcgctgcaacctctgcctcccgggttcaagcgattctcctgcctcagcctcccgagtagctgggattacaggcatgcgccaccatacctggctaatttttgtatttttagtagagacggggtctcaccacgttgggcaagctggtctcgaactcctgacctcaggtgatccacccaccttggcctcccaaagtgctgggatttagaggtgtgagctactgttcccagcagctttactaatctttttgatggtttttttttctcatatttatgagagatgctggtctatattttgtcctgtgatgtctttgtttcatgttggtgtcagagcaacactggcctttcagatcaattgggaagtgtgcccttctgccctccttctctattttctttttgagacagttttgctctgtagcccaggctggagtgcagtggcaagatctcggctcactgcaacctctgcctcccgggttcaagtgattctcctacctcagcctcccgagtagctgggattacaggcatgcacctccacccccggctaatttttatgtttttagtagagacagggtttcaccatgttgcccaggctggtctcaaacttctggcctcaagtgatctgcctgcctcggcctcccaaattgctgggattgcaagtgtgagccacggcacccagcctgtgtttcatctttattcagttcgaatattttatgcagttgaaaatatttgccgtgtgatttttttctgtgacctatgagttatttggaagtgtgtgctggattcaggagtagatctaaaaaagaagtatgctaatttcaaatatttctggatttcttaaatgtacctttataattaatttctactttaattacattgtggttcaagaacatacttagtgtttttcagtacctttaaatttattgagatttgtgttagggcctagcgtatggtcttatcatggagagtgttgcttgtatattctgctctgttgggtggagtattagatatcagttaggttggttgatagtattgttcaactctttcatattctcactgattttctctatttgttctaccccttatttagagtgaagtgttgaactctccagctattactgttgaattatctggtttttgtttttgtttttgagacggagtctcgctctgtcgcccaggctggagtgtagtggcgccatctcagctcaccgcaagctccgcctcccaggttcacgccattctcctgcctcagcctcccgagtagctgggaccacaggcacccgccaccacgcccggctgattttttgtatttttagtagagacagggtttcactgtgttagccaggatggtctcgatctcctgaccttgtgatctgccctcctcagtctcctttcaaagtgctgggattacaggcgtgagccaccgtgcccagctgaattatctgtttttatctgccattatgcctgtttttgcttcatttattttgggtctctgttgttaggtgcatgtatgtttagtttataattatcattcctgatgaattagctcttttatcattataaaacatccttctttgtctcaataagttttttattttttatttaattttttttttttttttcttacagagatggagtcttactatgttgaccagcctggtctccatctcctggcttcgggcgatcctcccatgtcagcctcccaaagtgctaggattataggcatgaggcactacaccagccaacagaagtttttatattaaaatttactttttctagctgggcacagtggctcacgcctgtcatcccagcactttgggaggctgaggcaggtggatcaccggtcgggagtttgagaccagcttggctaacatggtaagaccccatctctactaaaaacacaaaaattagccaggcgtggtggcgcgtgcctgtaatcccagctactagcggggctgaggcaggaggattgcttgaacctgggaggcggaggttgcagtaagccaagatcactccactgcactctagtctgggcaacagagcgagactccatctcaaaaaaaaaaaattaccttttctgatagtagcatagacactccacctgtcttatggtgaatgtttgcatcttttacttttgagacagagtctcactctgtcacccagactggagcgcagtggcatgatcttgactcacggcagcctctacagatacacgccccacgcccagctaattctttgtatttttagttgagacggggtttcgccattttgcccaggctggtctcgaccccttggactcaagtgttccacccccgcttggcctcccaaagtgctgggatgacaggcatgagtcactgcgcccagcctgcatctttttaaaaaaaacctttttggctgggtgcagtggcccacaccagtcatcccaacactttgggaggccaagaggggaggatctcttgagcccagggccagcctggccaacaaagcgagaccctgtttctattttttaattaaataaacatataaataaacaaacatcttgttacttctaattttgtgtccttggctcttaagcattcccttagagacagaatgtggttggatcttaggttttaatctagtctgatagtctctgccttttttttttttttttttttttttttgagacggactgtcactctgtcccccaggctggaatgcagtggctccatctccactcactgcaacctccatctcctgggttcaagtgattctcatagctcagcctcccaagtagctgggattacaggctcctgccaccacactcagctaatttttgtatttttaatagagacgggtttcaccatgttggccaggctggtctcaaactcctgacctcaagagattcacccgcctcagcctcccaaagtggtgggattacaggtgtgaaccaccacactagtctctgccttttgattggagtgtttaatctacttttttgttttgtttttgtttttgtttttgtttttgttttttagacaatctcactctgtcgccaggctggagtgcaatggcacgatctcagcccactgcaacctcaacgtcccgggttcaagtgatttcccttcctcagcctcctgagtagctgggattataggcatgagccaccacgtccaactaatttttgtgtttttagtagagatggggtttctccgtgttggcaaggctggtctcgaactcctgacctcaggtgatccactcgcctcagcctcccaaagttctaagattacaggtgtgagccaccgcactggaactcggcctgttttgttttttgaattgagacagagtatcactttgttgcccaggctggagtgcactggcgtaatctcggctcactgcagcctccacctcctgggtttaagggattctcgtgcctcattctcccgagtaactgggactgcaggagtgtgccatcagacccggctaatttttgtacttttagtagacacagggtttcaccatgttggtcaggctggtcttgagctcctgacctcaagtgatccgcccgcctcggcctcccaaactgctgggattataggtgtgagccaccacacccagctgttttgtttttttttttaagtggggtctctctctgtcacccaggccagagtgcagtggcacaatctcagctcagtgcaacctccgcttcccgggttcaagcaatactcctccttcagcctcccaagtaactgggattacaggcacccgccaccatgcccgtttttgttgttgttgttgtgtgtgtgtgtgatggagtctcgcacggttgcccaggctagagtgcagtggcgcaatctcggctcactgcagcctctgcctcccgggttcaagcgattctcctgcctcagcctcccaagtagttgggattacaggcatgcaccaccatgccaggctaatttttgtatttttcgtagagagagggttttgccatgttggccaggctggtcttgaactcctgggctcaagtaaccctcccaccttggcctcccaaagtgctgggattataggcatgagccactgcgcaaaacctaatctcatgtttaatgtaattatcaatgtgagtggatttgtgtttatatttgcagtttatgtttcatgttttgctcctctgttctttcactgccttcttttctgttaaatgtgtattttctagttgtgttttctagtgtaccacttcaattcttttgttgaacatttttaaacagtatctttaaagttgttattttcttactgctataggtattacaatatacattttaatttatctcagtttcagtaggaggatagaatttcctcaagcagggaaagtgtactgcagaggctgagtgtatacattcctggcaaacactatttgggccccaatataagcacttactgagctcctttcacctacagaacgaacacatcccgttcttttaaaagctgccttccagccggacctccagcccaggacaccctgtcctcaagcctccctcagatcctgttctttaaaaagctgccttcagctgggcacggtggctcacgcctgtaatcccagcactttgggaggccgaggcgggcggatcacgaggtcaggagatcgagaccatcctggctaacatggtgaaaccccgtctctactaaaaatacaaaaaaattagcttggcgtggtggtgggcgcctgtagtcccaggtactcgggaggctgaggcaggagaatggcatgaacccgggaggcggagcttgcagtgagccgagatcgtgccacagcactccagcctgggagacaaagggagactccgtctcaaaaaaaaaaaaaaaaggcagtgataattttaaaaattaattgtagaggacttggtatgtacacaaaagtatacacgagtttatgcatgttatgaagccccaacaggaatcccctgctcccagcaccgcctgggtcaagtccacccacctgctcccagcaccgcctgggtcaagtccacccacctgctcccagcaccgcctgggtcaagtccacccacctgctcccagcaccgcctgggtcaagtccacccacctgctcccagcaccgcctgggtcaagtccacccacctgctcccagcaccgcctgggtcaagtccacccacctgctcccagcaccgcctgggtcaagtccacccacctgctcccagcaccgcctgggtcaagtccacccacctgctcccagcactgcctggattgagtcacctacgtgctgtggtggcaacacttttcttttaatccttaactttggaaaatgtgagacgtgcacatgagttggatcgcccaggagaggcccgtcgccctcacctgtatcagctgctttagcgcctgccctcctggcttgtccccctctctctttgggctgagggctgagcattttaaagcaagccccacgcatcattattttcatttgtgaggcctggatcactgtaagtcagatttggattgtgttttaattggatttttagtcactgtttttatttcattacttatttttggtttttatttgttcgtttgtttttggttttgtttctgtttttgagacagggtctggctctgtcacccaggctggagtgcagcggcgcgatcttggctcactgcaacctccacttcccaggttcaagcgattctcctgcctcagcctccctagtagctggggattacaggcacccgccaccacgtccggctaatttttgtatttttagcagagacggggtttcaccatgttgttcaggctggtcttgaactcctgacctcatgatctgcctgccttggcctcccaaagtgctgagattactggcatgagccaccgtacccagcctattttaggttttctatagacagggtctcgctttgtcacccaggctgcagtccagtggtgccatcacggctcactacagccttgatctcctggctcaagtgatcctcctgcctctgtctcccaagtagcttggaccacaggcatgagccaccacacccagctaattttaaaacatttttttttttttatagagatagggttttgctatgttgctcaggctggtctccaacccctgacctcaagtgacctcaacctcccgaagtcattgtttttacagtctgtgatgttggcttttctcatttatttgtatcaggcactttcattgttagcttcttgtgaatttaaccatttttttccgtttttcaaaaactgaaacgctaacttctaattctggcttttcagataatgatttttttttcaaaagtgttttagcattatactgtaagaagcatcacattgatgtttaagatggaaaaatttgctttaaaaaagaactgagtagttctgattttaaaagtcaaccctgggcctttgcctctttgctggaagaacctgatggaagcttctgtagctcagagtcaacactgatgtgcgccctctctccctccatctgcacaggccccagggagtggctcaaacctgtagaccagagaaggaagcatctagaactcctgggggccttgtccgccgcccacatcctctcacggggggcagctcccatgaggggtgcaggcccctcaccccacacagagtctcggcaggaaccggaacccttcctggttgccccagagtggaggcccgggaggggcgggcggtgggtctgcacccgatgctgcagtttgctgatgtatgtgctttcatgctatgtagatttatagtctattaccaggtaattttaattttttttttttttttttttttgagacgtagtctcactctgtcgcccgggctggagtgccgtggcacaatcttggcttactgcaacctctgcctcccaggttcaagtgattcttgtgcctcagcctcccaagtagctgagattgcaggtgcgcatgaccacaggcggctagtttttgtatttttagtagagatggggttttgccatgttgggcaggctggtctcgagctcctggcctcaggtgatctgcccacctcggcctcccaacatgatgggattacagccgtgaaccactgcgcccggcctaattttgctcttttattataatcagctggaattctgctctctagggaataactctgtcaccatttggaagcatttatttctgctctgtgtgtcatatacgtacctatcacgcccccgtgcacggagctgcctctgtctgacgaggccgtctcagcttcagcacctggcgcttcctctagagctctgctccattccgaggtgctcgacgtagcagggaggcagagcctggttctgtgtgctgacctcacaggagctgtggcttctcccaggcaccatcccccacctcctttctctgcagccacgggctggttccagtttgctttttcatctttgccattaaaaacagaactggggcggggcgcagtggctcacacctgtcatcccagcactttgggaggccgaggcgggcagatcccctgaggtcaggagttcgagaccagcctgaccaacatggtgaaaccctgtctctactaaaaatgcaaaacattagccaggtgtggtggcgtgcacctgtaatcccagctgctagggaggctgaggcaagagaattgcttgaacccaggaggcagaggtcgtggtgagccgagattgcgcgttacactccagcctgggaaacaagagcgaaactctgtccgaaaaacaacaaaaaaacccccacagaacttgatcgtaatttacatatgtaatatttacatatttaaatgtttttctgcatgtgtgatattttttgtttacatccctaacacaaaacaactggtttggagagtcttaccctggtttgttgtttgactttttttttttttttttttgatatggagttgttctgtcacccgggctggagtgcagtggcaccatctcggctccctgcaacctctgcctcccagggctgagcagttctcctgcctcagcttcccgagtagctgggattagaggtgcctgccaccatgcccagctaatttttgtatttttagtagatacggggtttcaccatgttggccaggctggtctcgaactcctgacctcaggggatccaccctcctgggcctcccaaagtgttgggattacaggcgtgagccaccgtgccctgcctgttgtttgccttttgatccaattcctcaaaccaagagagtgtggggaaggctgtattggagcagagcccaccagagtttgggcgcacgggggctggggagggcattctcagcacctccaggtgaggttacagagggctgcaccctctggggtctgccttggggaccctgcccagaccctgctccacccactgaccctgctgacatgggtgtgtcctcccttccaggactggaaggatcaccagcacatatgcggccagtcagcagctgtcaccgtccaggcagacgaagtccacgtggctgaaagcgtgatggagaaggtgaccgtgtgaggctccatcggccgccctgggagctggggcccctcgcactcctgtgaggcttttgcaggtcgaaggcccccctgaggactctggggggacgttgagaagaggggtgtgggaaggtaaagaaacttgctggacaagtcattaacacactttaagcgaatggtgccctgggaagcgcactccccctgcccgggccccctgcccgctcgcggacagattttttatccctgggatcatgagcgtccggtcttgcccacagggcctgtgctgcgacgcacatacatacgtgttgtgtctgtcaataaagtgtaaataaggtctccctgcc

SEQ ID NO: 37232 - DNA, 4571 bp, Homo sapiens
atcagaggaagaggaaggggcggagctgctttgcggccggccgcggagcagtcagccgactacagagaagggtaatcgggtgtccccggcgccgcccggggccctgagggctggctagggtccaggccgggggggacgggacagacgaaccagccccgtgtaggaagcgcgacaatgccccgctacggagcgtcactccgccagagctgccccaggtccggccgggagcagggacaagacgggaccgccggagcccccggactcctttggatgggcctggtgctggcgctggcgctggcgctggcgctggcgctggctctgtctgactctcgggttctctgggctccggcagaggctcaccctctttctccccaaggccatcctgccaggttacatcgcatagtgccccggctccgagatgtctttgggtgggggaacctcacctgcccaatctgcaaaggtctattcaccgccatcaacctcgggctgaaggtgagcactgaaggggctgcagtggaggaggccgaaaggagtgctggggctgggggctggggctgatgctggtgcgctgggctcagaatgcatccctgatggagagggtggcatctacaatccatcactgagtttgctcccctttggggacacccatggctacatgccaccatcaccccattgtgacctttgtgaagtaagaaaataatgcagacagtgcctgaggaagtcagcttgccaagcaaaggcctcatgccacaggccgctgagctaaagaagaagcgatggcctggtgctgcctgagttacagggcaatatctggaaggcaaaggtgtgcactgagcttggtgcactgagtcctgcccagccccagtttggaaatggaggcccaaggggtggtggccaggggttggcctggttcctctgctctgcctctgatttctcaccatgcgctcctcccactgcagaaggaacccaatgtggctcgcgtgggctccgtggccatcaagctgtgcaatctgctgaagatagcaccacctgccgtgtgccaatccattgtccacctctttgaggatgacatggtggaggtgtggagacgctcagtgctgagcccatctgaggcctgtggcctgctcctgggctccacctgtgggcactgggacattttctcatcttggaacatctctttgcctactgtgccgaagccgccccccaaaccccctagccccccagccccaggtgcccctgtcagccgcatcctcttcctcactgacctgcactgggatcatgactacctggagggcacggaccctgactgtgcagacccactgtgctgccgccggggttctggcctgccgcccgcatcccggccaggtgccggatactggggcgaatacagcaagtgtgacctgcccctgaggaccctggagagcctgttgagtgggctgggcccagccggcccttttgatatggtgtactggacaggagacatccccgcacatgatgtctggcaccagactcgtcaggaccaactgcgggccctgaccaccgtcacagcacttgtgaggaagttcctggggccagtgccagtgtaccctgctgtgggtaaccatgaaagcacacctgtcaatagcttccctccccccttcattgagggcaaccactcctcccgctggctctatgaagcgatggccaaggcttgggagccctggctgcctgccgaagccctgcgcaccctcaggtacttatcgtccgtggaaacccaggaagggaaaagaaaggtgaatgaaagtgaagggagaagggaacctggggcattgtctctgattgctctagcatgagtccttagtgctcttcatttggctcccctaatctgactcctccttccctttctactgttttgccgcaccaggctttttttttttttttttttttagtttagtttttgtagagacaagatcttgctatgttgcccaggctggtctcaaacacctaacctcaagcaatcctcccgcctcggcctcccaaaatgctgggaccacaggcatcagctactgctcctggccctccctttttttttttttttttttttttttttttgagatggaatcttgctctgttgcccaggctggagtgcagtggcaccatctcagctcactacagcctccacctcctgggttcaagcaattctgcctcagcctcccaagtacctgggactacaggtgcacgccaccacacccagctaatttttgtatttttagtagagatggggtttcaccatgttggccaagatggtcttgatctcctgacctcatgatctgcccacctcggcctcccaaagtgctgggattacaggcatgaaccactgcacccagctttccagccctccctttctactcttatctccagccaccctccttcaaaggtctggcagcataacctctctatgccccagctgtgtctttgctcatgttggccctctggaaatgatttcccccttttttttaagtgctccagtttttcccaccttatccatcccatgtcatcttccctctgtgtggtccttgcttcccattctagctaactcttatccctcccccatactcctggagccctctgccctcagagtcttttgtgtcacacagacccaataattagaactgtttggtctctggctagactgtgagctccttgcaggtggggaagatgtcatgtatgcttttaccctccacccaaatgcccagcacaggaggaccaggattggaacaagtgttgacctctcatgtttactttgtttcagaattggggggttctatgctctttccccataccccggtctccgcctcatctctctcaatatgaatttttgttcccgtgagaacttctggctcttgatcaactccacggatcccgcaggacagctccagtggctggtgggggagcttcaggctgctgaggatcgaggagacaaagtgagggccagtagtgggaacacggtggtgctgggggacaagcaggctcctgttgagctggagcacctctgggcacagaagttttattttcctggcattcccaacaagtgttccctggggattcagctcatggtcactgttgaaagccttcattcagtccccctttctctagccagggctgcctggacccctggatgccctgattaccatccttaattctccctactaggtgcatataattggccacattcccccagggcactgtctgaagagctggagctggaattattaccgaattgtagccaggtaggacggagatgagggtgggaatagggacagggtgagtgtctgaaggctgaaaattcccttgagcatctcaccatccctgttgtcccatggagtggggaggctcctcactagaacaggttggagaaagagggcatcctatctccccagatgtcttcctacccctccctagaatcttctgaatgtagtaccttctggccaggtatgagaacaccctggctgctcagttctttggccacactcatgtggatgaatttgaggtcttctatgatgaagagactctgagccggccgctggctgtagccttcctggcacccagtgcaactacctacatcggccttaatcctggtgagtgaggcagaagggagcctcccttatcctggagttggtgggataggggaaggaggttggagccagagcctgcaaagcatgggcaggatgtgtggcccctccctggagttacccttgctccttgcccctccagtcagccccacatccttgcaggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggatatgggagggggtttggctgcctgtgcccaggagctagactgccttgaggctgctgtcctttcacagccatggagtagaggcctaagttgacactgccctgggcagacaagacaggagctgtcgccccaggcctgtgctgcccagccaggaaccctgtactgctgctgcgacctgatgctgccagtctgttaaaataaagataagagacttggactcc

SEQ ID NO: 37233 - DNA, 80098 bp, Homo sapiens
ggcgggaaacagcttagtgggtgtggggtcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggtgagggccgggacggcgcgtgctggggagggacccggggccttgtggcgcggctcctttcccgcctcagagagtgggcggtgagcagcctctccagtgcggaggcacgggggcggaacgttggtgcttgtgcggattccgccgtccccaggttctgcttggctccggagggacgcccccctcagccctgaaacccgtgcctctccagccgccccggatctgaacttgtgatcacggagtgtttacgtcgtgccaggcattttaatgcattgttctagttcattttccagcagtcgcattcctcgccttggccctacatgtagcgctcattacaaacacggccagaatctcttattaacaaacagcagccaggagtgagatttaaaatagactgggggtttaggagacccttttatgacacgtaattctgctcccacgacgctcccatttataccgccggtccagctaagggtctggtaatggagcgccgttgaagagcagtatgatgaagtggtcaggaccaacggactctggagctgggctgcttgggatcaagtcgctgcccctctgcttattaacgtgtgaccttgggccagtcatggacgctatctgcttcagctcagcattcagtgctctccgtcacccgaccccatctatccaggattatctctccctggaaagctacaaacgtctcaccctatgtgggccaaatgttctggataggcctagttaacctcttctctccctgttttctttgcgctttcttgcagctatgtagttatgctaatgaaaagagcatcctagggggagcagagttgtggattctagtcctgactagaggactagtgcaaatgcgatactcctgatgaaaaatgtttcattcgttagatataaatgtgttaggcagggttatggacactagatgaaaaaagaaatacctctactttcatagagatcactattggacagcaaggcagaaataattacaattcaagttggaggcttatggaggtgagcttgtaagaggttacaagaggcgccaaggcaggatcgccaaagacggaagactttggaagagtctcatacaacggaagaggcgttatatgagacaccaaagtccacgttgagtcttggtggactagaagtttgctagggagagggcttgaaacgaggtagattggcgttgctggtgtagaaaaggaaggagactggcccaggtgggtggggttagatgaccaaaggcttttagtgtggtgttgagctgttgaaattttatgctgtagccaatgaaaagtctgaaatgttttttttttttttttttctgagacggagtcttactgtgtcgcccaggttggagttcagtggtgtaatcctggctcactgcaacctccacctcctgggttcaagcgattctcctgcctcagccaccggagtagctgggattacaggcacgtgccaccacgcctagctaatttttgtatttttagtagagatggggtttcaccatgttggccaggctggtctcaaactcctgacctcaagtgatccacccaccttggcctcccgatgtgctgggattacaggtattagccactgcacctgacctacatagattttacataagactttaaaacagggcgggcgcagtgactcacgcttgtaatcccagcactttgggaggctgaggtgggcggatcacaaggtcaggagatcaagaccatcctggctaacatggtgaaaccctgtctacactaaaaatacaaaaatcccagcactttgggaggctgaggtgggcggatcacgaggtcaggagatccagaccatcctggttaacactgtgaaaccctgtctctactaaaaatacaaaaaattagctgggtgcggtggcaggtgtctgtagtcccagctacttgggaggctgaggcaggagaatggtgtgaacccggaaggcagagcttgcagtgagccgagattgtgccactgcactccagcctgggcaacagagcgagactccatctcaaaaaaaaaaaaaaaaaaaaaaaagactttaaaaaaaattataagaaaggacagaccaagtgcagtggttcgttccagcacttagggatgccaaggtgggaggattgcttgatgctaggagttgaagactagcctgtgtaacatagcgagacccatctctacaaaaaaattaaaaagttacctttagaacttacgatttttatgtgtagactccatataagcagagggtctatgcttattcactatttattaccttccatagtccctgcacatataataggtgcttcataaacaatttaatgaatgaataaattactgagaaaacactggaagtttttgggttagcattgtgttaggtgcttgatatggtctggctgtgttcccacccttatctcatcttgaattcccatgttttgtgggaggtacctggtgggacataattgaatcatgtgggcaggtttttcctgtgctgttctcctggtagtgaataagcctcacaagatctgatggttttaaaaatgggagtttccctgcacaggctctctctctttgcctgccgccatccatgtaagatgtaacttgctcctccttgccttcctcaatgattgtgaggcctcctcagccatgtggaactggctgcagagtcattaaacttcgttcttttgtaaattgcccagtctcaggtatgtctttttttatttttttttgagacagagtctggctctgtggctaggctggagtgcagtggtgcgatctcgactcactgcagcctccgcctcccgggttcaagcgattctcctgcctcagcctcccaagtagctgggactataggtgcacgccaccatgcccagctaatttttgtatttttaatagagacggagtttcactgtgttggccaggatggtcttgatctcttgacctcgtgatcttcccgcctccgccttccaaagagctgggattacctacccagctgggtatgtctttattagcagcgtgaaaacagactaaaacagtaaactgataccaatagagtgggatgcagctgaaaagatacccgaaaatatggaagcaactttggagctgggtaacaggcagaggtcagagcagtttagagggctcagaagaagaccagaaaatgtgggaaagtttggaacttcctagagacttgttcaatggctttgaccaaaatcctgataatgatatggacaatgaaatccaggctcatgtggtctcagatggagatgaggaacttgttgggaactggagcaaaggtgacacttgttatgttttagtaaagagactggtggcattttgccctgccctagagatttgtggagctttgaacttgagagaaatgattttgggtatctggtgggagaaatttctaagcagcaaagcattcaagaggtgacttgggtgctgttaaaggcattcagttttaaaagggaaacagcatgaaagtttggaaaatttgcagcctgacaatgtgatagaaaagaaaatcccgttttctgaggagaaattcaagctagctacagaaatttgcataagtaatgaggatcccaatgttaatccccaagacaatgggaaaaatgtttccagggcatgtcagaggccttcatggcagcccctctcatcacaagcctagaggcctaggagaaaaaagtgatttcatgggccagcccggggtccccatgctgtgtgcagcctagtgacttggtgccctgcatcccagctgccccagctgtggctgaaaggggccaacctagagctcaggccatggcttcagagggtgcaagcctgaaaccttgacagcttccaggtggtgttgagcctgcaggtgcacagaaatcaataattgaggtttgagaatctctgcctaggtttcaaagatgtatggaaacgcctgcatgtccaggcagaagtttgctgcaggggtggggtgctcattgagttcctctgctagggcaatgtagaagggaaatgtagggtcagagcccccccacagagtccctactggggcaccacctagtggagctgtgaaaagagggctaccattctccagacctcagaatggtagatccacagacagcttgcaccatgtgcctggaaaagctgtagacacttaacgccatctcatgaaagcaaccaggcagtgtgctgtaccctgcaaagccacaggggcagagctgtccaaggctgtggttgcccagctcttgcatccgcatgacctggacatgagacatagagtcaaaggagatcattttggagctttaagatttgactgccatgctggattttggacttgcatggggcctgtagcccctttgttttggccaatttctcccatttggaatggctgtatttacccaattcctataccccattgtatctgggaagtaactaacttgcttttgatttgacaggctcatatgcggaaaggacttaccttgtcttgaatgagactttggactggaattttgaattaatgctgaaatgagttaaggctttgggggactgttgggaatgcatgattggttttgaaatgtgaggacatgagatttgggaggggtcatggcagaatgatatggtttggctatgtccccacctaaatcccatcttgaattcccatgtattgtgggagggacctggtgggagatagttgaatcatggggatggatctttcccatgctgttgtgatagtgaataagcctcatgagatctgatggttttaaaaacggaagtctacctgcacaagctctttctttgcctgctgccatccatgtaagacatgacttgttcctccttgccttctgccatgattgtgagacctccccagccatgtggaactataagtccagtaagcctctttttcttcccagtctcgggtatgtctttatcagcagcatgaagtccagctaatacagtgcttgaacatgtaatatctcaaatctgtaatgtactttttttttttttaaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggtaattatcttcctttttaatttacttatttttttaagagtagaaaaataaaaatgtgaagaatttaattgtgttttagtattttaagtagattgtgatagtagaatggtttgagacactttaatagcaattagcatgtggtttttaaaaagttgcagtttggctggtcgcagtggctcatgcttgtaatcccagtattttgggaggctgaggcaggtaggttgcctgagcccaggagttcaagaccagcctgcccaacgtggtaaagccccatctctactgaagataaaaaaatttaaaaaaattagctggggctattggcacacacctgtggtcccagctaatcaagaggatgaggttagaggatcacttgagcccaggaggttgaggttacagtttaactttcagaggccaaggcaggaggattgcttgagtccaggagtttgagaccaccctggggaatgtagggagatcccatctctatagagggatagattagatagataatttctgaggggaggggagggggagggccagggaaggggagggaaaggggaggggagggcagggccagcagtaaggtcataatagagacatgtatctgtaagatccttataataggtgaggatggccacaaattagcgccacagatttgtatttttagtagagacaaggttttaccatgttggccaggctggtcttgaactcctgacctcaagtgatccgcctgccttggcctcccaaagtgctgagattacagatgtgagccaccatgcccaaccacaagcatttatttatttatttatttatttatttatttatttatttagagacagtcttgctctgtcgccaggctggagtgcagtggcgccatctgggctcactgcaaactctgactccctggttcaagcttttctcccgcctcagcctcccgagtagctgggattacaggtgcatgctgcaacacccggctaatttttgtatttttagtagagatggggtttcaccatgttggccaggacggtctcgatctcctgacctcgtgatccgcctgccttggcctcccaaagtgttgggattacaggcgtgagccacagcactcagccagttatttttttataagaaaacattttactggccaggcctggtggctcacacctgtaatcccagcactttgggaggccgaggcaggcggatcacgaggtcaggagttcgagaccagcctggccaacatggtgaaaccccatctctactaaaaatacaaaaattagccaggcgtggtggtgtgcgcctgtattcccagctactggggaggctgaagcaggagaatcgattgaacccttgaggcagaggttgcagtgagttgagatcgcaccattgcactctagcctgggtgacagagcaagacttcatctcaaaaaaaagagaaaacattttattaataaggttcatagagtttggatttttcctttttgcttataaaattttaaagtatgttcaagagtttgttaaatttttaaaattttatttttacttaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacaggtaagcaaattgagtctagtgatagaggagattccaggcctaggaaaggctctttaattgacatgatactgtttcatttaaggaaaaataataaaaaaactcttttttttgtatctaattaaaataatgttctgatgtttacagaaactttgtatatttaattggacattagaacaagctgtttgttgtgtaagatttattttacctcagatcttttctcccccctttcctttctgtcttgtgttccaaaagagtaattattacggtaaatattactgtaattatggatttatcaaataagatgcagttctttagcattttttgataaatcgagtggaactttagcctgttattttactatttgttttattttaactaaattctgattgtgtcattttttttttttttttttgggaccgagtctcgctctgtcgcccaggctggagtgcagtggtgcgatctcggctcactgcaacctctgcctcccaggttcaagcaattcttctgcctcagcctcctgagtagctgggattacaggtgtgtaccaccacacccagctaatttttgtatttttagtagaggtgaggtttcaccatcttggccaggctggtcttgaactcctcacctcgtgatccacccacctgggcctcccaaagtgctgggattacagccatgagccaccatgctcggctttgattgtgtcatttgtataggcatgtggtttattatttagttatttttttttttttctttgaggtggagtatcactcttggtgcccaggctggagtgtaatggcgtgatctcagctcactgcaacctctacctcctgggttcaagcaattctcctgccccagcaggagtagcttgggattacaggcatgccccaccacacctggccaattttgtgtttttagtagagacagggttccaccatgttggtcaggctggtcttgaactcctgacctcaggtgatctgcccacctcagcctcccagagtgctgggattataggcatgagccacggtgcccagcatatttagatttttttttttttgagactgagtctgactctgtcacccaggctagagtgcagtggcacgatccacgatcttggctcactgcagcctccaccttatgggttcaagcgattcttctgcctcagcctcccaagtagctgggactgcaggcacatgccaacacgcccggcttatttttgtatttttatagagacggggtttcatcatattggtcaggctggtctctaactcctgaccttgtgatccacccgccttggcctcccatagttctgggattacaggcatgagccacagcgccaggcctagatgtttcttaaggtatgtatctcccaaagattctttttgtggtcctcaagtaccataagcaccgctggagataacacatgtgatgggcatttttagcatagattgtatctaagcaactttccacaagtaatagttctgttaagggttgttattgtggccgggcgcggtggctcacacctgtaatcctggcactttgggaagctgaggcggccggatcacctgaggtcagggattcgagaccagcctgtccaatgtgctgaaaccctgtctctactaaaaatgcaaagaaaaaaaaaatctagccaagcatggtggcttgctcctgtaatcctagctacttgggaggctgaggcaggagaattgcttgaacctgggaggcagaggtagcagtgagccaagatcgtgtcaccgcattccatcctgggcgacagtgagactctgtctcaaaacaaaaaaagagttgttaccgttgggactattttttgaaagctttatgtgaacgtaattttatattttgatgaaaatttagtttattgatgtaaaaagtgtatcagtacatcatatcagtgtcttgcacattgtataaacatttaatgtaggtgaatctgttatcactatagttatcaatgttataattttcatttttgcttttcttattccttttctcatagtagtttaaactatttctttcaaaatagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggtacatggattataaatgtgaattacaatatatataatgtaaatatgtaatatataataaataatatgtaaactatagtgactttttagaaggatatttctgtcatatttatctcaaaacctaaactgtgtatcaatgatattaagcttttttttttttttgagacagagtttcacttttgttgcccaggctggagtacaatggcgcgatcttggctcaccacatcctctgcctcccaggttcaagtgatcctcctgccttggcctcctgagtagctgggattacaggcatgtgccaccacgcctggctcatcttttttgtatttttagtagagatggggtttctctatgttggtcaggctggtctcaaactcctgaacctcaggtgatccgcccgcctcgggcttccaaagcgctgagattgcaggcatgagccactgtgtctggcctatttttatagtttatgtacttggaattatataatatattctgcctagcttctttcattcaatatttgtaagatttatccatattattgagtgtagttgtggatttttgcatttatatttcatagcacgagcatgtcagaatttatccattttacttcccttctgcccgccactgctactctccccattttacctttttttttgtttttttgagatggagtctcagaatttcgctctgtcgcccaggctggagtgctgtggcacggtctcagctcactgcaacttctgcctctgggttcagctgcacgccaccatgcctggctaatttttgtattttcagtagaggggattttgctatgttggccaggctggtcttgaactcctgacctcaggtgatccacccaccttggcctgccagagtgctgtgattacaggcgtgaaccaccgtgcccgacccccattctaattttgatggacatttgggtaattttcatttttggctgttataaatactgctgcaattacagttaattttcacagtttttttttttttttttttttttttttttttttgaggtgagtttcgctcttgttgctcaggctggagtgcagtggtgcgatctcagcccactgcaaccttcaccttctggattcaagcaattctcctttctcatctcctaagtagctggggtttacaggcatgtgccaccatgcccagctaatttttgtattttaatttcacagttctggaggctgggaagttcagaattaaggcactggctgatctgttgtctggtgagggcccacttgttcatagataaccattttctcactctaacctcacaaggttgaaagggcctaatttttgtgtttttagtagagacggggtttcactatgttggctaggctggtctcaaactcctagcctcgagtcatccacccgcctcgtcctcccggagtgcttggattacagcatgagccactgcgcccggcccccattttagttttgatggacatttgggtaattttcttttttggctattctaaataatgctgcaattactgttaattttcaccttgtaaaaaccattttcaaatctcaagagattaacctttagttttcttggtttggattgggaaggaacaccaaggaaaatgagggacttcagaatttattttcattttgcatttgttttttaaaatctttagaactggatccagtggtatagaaatcttcgatttttaaattcttaattttaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcaggtaaaaaaaaaaaaaaaaaaaaaaaaaaagggttaaaaatgttgaatggttaaaaaatgttttcattgacatatactgaagaagcttataaaggagctaaaatattttgaaatattattatacttggattagataactagctttaaatggctgtatttttctctcccctcctccactccactttttaacttttttttttttaagtcagagtctcacttgttccctaggccagagtgcagtggcacaatctcagcccactctaacctccacctcccaagtagttgggattacagttgcctgccaccatgcctggttaatttttatatttttagtagggttgcggggacagggtttcaccatgttggccaggttggtctcaaacttctgaccttaggtgatcctcccacctcggcttcccaaagtgctgggattacaggcttgagccatcgtgcccagcctactttttacttttttagagactgggcttggtggagtgaagtggcaagatcatagctcactgcagtattgaactcctgggctcaagcgatcttcctgcttcaacctcatgagtagctgggtctacaggcacaagccaccatgcttgcctaattttaaaatttttgcagagttggagtttcacagtgttgcccaggatgttcgctcactcctgacttcaagtgattcttctgccttagcctctagagtggtagctgggattacaggcatgaaccaccatgctctgctattttttttcaaggtttttttttttttttttttttttgagagactggtatgactatgtatgctccctaggctggagtgcagtggctattcacaggaagtgccatcagagtgtactacagcttcaaactcctgggctcaagcacttctatcatagtctccaaagtagctgggactacgagtgtgtctcattgtgccttgctctcgaattgctttttttttttttttctggtttcaagctatctatgtggtattagtcctcactttatgaataattttgtatactactaatagcaattttttttttttttttttttttgagacggagtctcattcttgtcgcccaggctggagtgcagtggtgtgatcttagctcactgcaacctctgcctctccggtttgggcaattagctgggattagaggcgcctgccaccatgcccagctaatttttgtatttttagtagacatggggtttcatcttgttggctaggctggactctaactccaggtgatctgcctgcctcggcctcccaaattgatgggattacaggtgtaaaccactgggcctggcctagcaatttaaaatgacattctaagaagttttatgtctaaatctgcagtaagtggctgggtgacgtggctcatgcctgtaatcccaacgctttgggagtccagggtgggaggatgacttgaggccaggagttgagaccagcctgggcaacatagtgagactctgtctctacaaaagaaaaaattagcggggcttagtggcgtgcgcctgtagtctcagctactcgaaaggctgaagtgggaggattctttgagccccaagggttctggcttgccgtgagccaggatggcaccactgcactccagtctgggcaatagagtcagaccctgtctcaacaaataaaataaaactgtagtaattataaagtggttttggctgggggagaaatgtacagttgaacatacggattaagaggttgaaagttggtcttaggaagaggaactttttgtggaaatttcttaatatttgaagaatattatgttattgttcctctgtttttcatggcgtagtaaggttttcactaatgagcttgccattctttctattttattttttgtttactagggttctgttgaagataccactggctctcagtctctggctgccttgctgaataagtgtaaaacccctcaaggacaaagacttgttaaccagtggattaagcagcctctcatggataagaacagaatagaggagaggtatgttattagtttatactttcgttagttttatgtaacctgcagttacccacatgattataccacttattgtaatatgcagttttggaagtatatgttaccatttaactgtacagagtacatagtaatagagtggtaattatttagattgattaaagaactcatttttttaaataagttttttttttttcactataaaagtttattttatttgagatggtatggtatcgaacatgttcatattgtgtgtaatcgtgggtaaattactcaacctttatgtcatagtttcttcacctttaaaatgacattaataaaagagctacttaataggattataagcatgagatgatttaatatacataaaatacttacagtctgatatataggaagcacttaactctttatcctagaaaagatttaaggtgaccttaacatatatgtcagaaaatctttaaaattgtggaaataaaaggttgtataattctgctatcctaaaattactagtatttcaatatattttattttagtcttttcttttagatacaagttttaaaacttttaagtgaagtgtaatatacgtaagtactgcttgatgaatttaaggtgatttctaaagccaggtttgttggggaagaggagtgggatttagtgatttagaaccagaaattggggctgggtgcgatgtctcatgcctataattccagaacttcgggaggccatagtgggagaattgtttgtgccccggagttcaagaccagcctgggcaactcagtgagacgccatctctacaaaagaaaaaaaaaaaaaattagctcagtgtggtgacatgtacctgtagcccgagctactcgggaggctgaggtgggaatatcaccctggcccagaagtttgaggctgcagtgggctatgattgtgccactgaactccagcctgggcaatggagtgaaaccctgtctcaaaaaacaaacaaaaaaagaaactgaggctgggcacggtggctcacacatataatccagcacttggggaggttgaggcaggataattgcttgagcccaggagtttgagaccagtctgggcaacaaaatgacaccccatttctaccaaaaaaaaaattgtttaaaattagctgggcatggtggcatgtgcctgtggtcccagctacatgggaggctaaggctggaggattgtttagcccaggaggttgaggctgcagtgagccatattcatgtccctgcactccagcctgggtgacatagtgagacgctgtctcaaacaaaaatcaacaggccagatgcagtggctcacccctgtaatcccaacactttgggaggccgaggtgggtggattacttgaggtcaagagttcgagaccagcccggccaacatggcgaaaccccatctctactaaaaatacaaaattagatgggcatggtggtgtgtgcctgtaataccagctactcttgaggctgaggcatgagaatcgcttgagttgggaggcaaaggttgcagtgagccaagattgtgccactgcactctaccctgggtgagaaacgagattttgtatcaaacaaacaaacaaacaaaaaaagacgcccaaaatcaacaacaacaaaaacgatattggaatgattggatccccaaagataaatgtttgaggtgatggatatctcagttaccctgagttaagtattatacattgtatacgtgtattaaaatattacaaacccccaaatgtgtacaattatgaggtatcaataaaagagattggaaggactgggtaatttgcaagtaattaaggcaatttacaatttttaatttttatttgtgaataagtagttatacgtgtcaaaattcaaaaaggacaggtggatatacagtgataagtcatccccccttctctgtcagctccataaagagcccctgtcttgcatggctccagggtcacatttcctattgtattttgccaccacctgccctgggagcaacagtgttagtttcttgaacatccttccaagcagagtctgggcctacacaagcaaaacaagtatgtctattctctctcctctttaatttttttaaaggaagtgattgataatttaacactcaagctataggtcattggttatatttttaatttccaatttatgggaatagaggaagtgtcagtgatccccttctggtttaagaactggaggatgcatgtgtttagaccctttagaaacctgaaatgtcacctaatataattatcagagtaacactttttagtaagcaagctatctatcaaaagtaggtttttgaagaagagggtaaggaaaggttactttcatgggacatagcaataatttctaaaatctaatggttttacaagacttgttcattagaagtaacatctgtgaggatggctttatgagtcaaaatattatctgcttaataccccacctgtagggtaagaagaaatgtttttttcttggtgacaatttttagcagcaagcggggagggcctgtggcttccaaggccaaacgttgaaataccacagactaggaagaaaaagatccactccttatacaggatttgtttgtttcttcttttttcttcatttttgtagagatgaggtctcactatgttgcccaggctggtctctcttttttttttgagcccgagtttcactcttgacgcccaggctggagtgcagtggtgtgattttggctcaccgcaacctctgcctcccgggttcaagcgattctcctgcctcagccttcctgagtagctgggattacaggcatgcgccaccacgtccggctaattttgtatttttagtagagatgggtttctccatgtgggtcaggctgctctcgaactcccggcctcggatgatccacttgcctcggcctcccacagtgctgggattacaggcgtgagccactgagcccagccatgctggtctcaagcaatccacacccacctcagcttccaaaagtgctggcattacaggtgtgagcccccgtgcccagcctgtttcttataattattcctctttctcaactctgtctgctgtggtacctcatgcttcctagtttaagccttcttgggagttctcaggagaaatctgttatctcccttactaagcatttgggattgatgttccttccaggttactataaaaccaagttttttttggttcttttttttttttcttttaaaagaaatgagattttgtcatggttagcctggtttcaaactcccaagctcaagtaatccaccttcctttgcctcccaaagtgctaggattacaggcatgaaccactacacccgatctgtactgttcctctttccattcactaaaacctacttgcaactatgagcatatgttattgccatctagaaatgagtttctagggacttgttcctttttgtactttatttaaacagtcgaattagaaattattattatcattatttattttttgagatggagtcttgctctgttgcccaggttggagtgcagtggcgtgatctcggctcactgcaacctccacctcctgggtttaagcgattctcctgtctcagcctcccgagtagctgggactacaggcatgtaccaccacacctggctaatttttatattcttaatagaaacagggtttcactattttggccaggctggtctcgaactcctgacctcagatgatccactcaccttggcctcccaaagtactggaattataggcgtaagccaccgtgcccggccaaaattatttataataagcaaggcatggtggcttgtgcctgaagtcccagctacttgggaagctgaggcaggaggatcacaggttcaggtccaccctgggaaaatagtgagaaccttccctatccccagtcttcaaaaaagaaaaaaatttgctggagaaggtcacacaatgctgataggtcccattgtgctttcatgctttctagttttcaatgataactggttgttacttttattgtctgactcattatagtgaccaactcccgattttttactttgccttaagccttcagctatctcctacctctaagcggatgatttcttccttaacacttaaaacctcaaaatttatctgtacttccactcttttactctctggctctttctcagaagaagaaataacacttttatttcttttcaaagccaacctttccatactttacttggagacatatttctttttttttgttttgtttttgtgagtggagtctcactctgtcgcctggtctggagtgcaatggcgcaatctccactcagtgcaacctctgcctcccaggttcaagcgattctcctgcctcagcctgctgagtacctgggcttacaggttagcacaccacacccggccaagttttgggtttttagtagagacagggttttgccgtgttggccaggctggtctctaactcctgacctcccgatccgcccgcctcaggtgcaagccaccgcgcccagccctagtgtagcaatcttaatcagaaatatgtctctggctgggcgaggtggctcatgcctataatcccagcactttgggaggccaaggcaggcagatcacctgaggtcaggagttcaagaccagcctgaccaacatggagaaaccctgtctctattaaaaatacaaaattagctgggtgtggtggcatatgcctgtaatcccagctactcaggaggctgaggcaggagaatcgcttgaacctgggaggcggaggttgcggtgagccaagatctcaccattgcactccagcctaggcaacgagcaaaactccatctcaaaaaaaaaaaaaaaaaaaaaaagattgctatgttaatcttatttatttatttatttattttgagacagagtctcacactattgccagggctggagtgcaatggcataatcttagctcactgcaacctccgcctcccgggttcaggtgattctcctgcctcagcctcctgagtagctgggattacaggcgcccgccaccacgcctggcttattttttgtgttttttagtagagacggggtttcactacgttggccaggctggtcttgaactcctgaccttgtgatttgcccacctcagcctcccaaagtgctgggattacaggcgtgagccaccgtgcctggcttatgttaatcttattttatataaaaagaaataatattaaactagaaggcaataaaaatgccaaattcaatacacaaattattttgtcagcatttccacaagaataaactattttatatgctaacatatgttcaatgttccttacagaattctgacattaaaaatgaaaaattaccaaagcttcagatgaatctataaatggacaaaagaaaaagcttaaaaggataaagagcaacactccaagtgcatgtataaacataaggactcttgggacttaacctttttaaaaatctttaggcctagcacagtatttgctatttaatgtatcaaatgggtggttttgacttcattaatccatatataggacagatgaaaaaaagaattatagacttgtaattacagttctttaggaaccatatttgctctcagccttttaaatacgctgtcaggcaattccagtcagcacttttgaaaaaaacctacctacctacctacctacctatctatctatctatctatctagagactgagttataagactagctagtttttgtattttttgcagagacaggatttcatcatgttttctaggctgttcttgaactcccaggctcaagccatccacccgcctcagcctcccaaagcgctgggattacaggcgtgagtcaccatgcccaaccaattccagtcagctcttaaaatgaaagcctagaaatggtagggttaaagaggggacagaatgttgattttaaaatacctagaatttggccaggtgcagtggctgtaacccagcactttgggaggccaaggtggccggattgccttggcctgcctcagcctcccaaagtgctgggattacaggtgtgagctcaggagttcgagaccagcctgggcaacacggtgaaaccccttctctagtaaaatacaaaaaattagctgcatgtggcggcgtgcacctgtggtcccagttacttgggaggctgaggcaggagaattgcttgaacctgggaggcagaggttgcagtgagctgagattgcgccactgcactccagcctgggcaacagagtgagactctgtctccaaaaaaaaaaaaccccaagaatttgattaattctgttggaattttaagagttaactgatccccaaaatgactcagctgtatgcaatttaatgcaatattaattcgcatgttgactctcagaattgcatacagctgagtcattttattgagtaggattgataagtatactatgttatgccaacagtaactgtgatgcttctaaaattgtgatttttaaattggcattgtcacagaaacagcagagtagttgtttttttctttaagcttcttttagccagaaacataaactgaaactgtaattattactgcaatcgtatgttgaatagacttgtgaaactagcaatttattaggcttttaatgatatctggaccaaaggctgagggagctgtgctgtgtgtatgttgctttgtgctttgttttttagaagcttgtcgtttctttgccattttacttctttctttttttttgagacggagtcttgctctgtcccccaggctggagtgcagtggcgcagtttccgctcactgcaagctccgcctcctgggttcactccattctcctgcttcagcctcccaagtagctgggactacaggcgcccaccaccacgcccggctaattttctgtattttttagtagagatggggtttcaccatgttacccaggatggtcttgatcttctgaccttgtgatccgcccgcctcggcctcccaaagtgctgggattacaggcttgagccaccacgcctggcccattacccattacttgtttcttaatgttacattctctttccctctttttttttttttgttttttgagatggagtttcgctcttgttgcccaggctggagtgcaacggtgccattttggcccactgcaacctctgcctcccaggttcaaatgattctccagcctcagcctcccaagtagctaggattacaggcacctgccaccacgcccagctaatttttgtatttttagtagagatggggctttgccatgttggccaggctggtcttgaactgctgacctcaggtgatctgtctgcctcagcctcccaaagtgctgggattacaggtgtgagccactgcacccagtccttaatgctactttataggtgaaaattgtgaaataacttaaatttcattttaattaaagttaatttttgggaaattaacgaaaggttgacattttattcttttgaatattgcagttgttatttgggtttaaattggggggcttaggaaggaaagaagcctgatggttgtttctgaattttctgaaaattatgtttgatatgctgtatatgaaatccagcttggagagaatatgtccattgttaaggaaaaattaatgaagatttgatctagataaggcattccaatcatttggaagtggtttgagtatctttttttctttttttaatttgagacagagtcttgctctgtggagtgtagtggtgcaatcttggctcactgcatcctccacctcccgggttcaatcaagcaattctcctgcttcagcctcccgagtagctgggattacaggtatgggctaccatccccagctaatttttttttttggatggaatcttgctcccgtcgggcaggctggagtgcagtggtgtgatctcagctcactgcaacctccacctcccagtttcaagcgattaagtgattctccttcctcagcctcccgagtagctgggattacaggcgtgtgccaccacgtcgccaccacgtctggctaatttttgtatttttagtagagacagggtttcgccatgttggccaggctggtcatgaactcctgacctcaggtgatccacctgcttggcctcccaaagtgctaggattacaggtgtgagccactgtgcctggcttaagttttgtatttttagtagagacggtgttccatcatgttggtcaggctggtgtcaaactcctgaccatgcgatccgcctgcctcggcctcccaaagtgctgagattacaggcgagagccaccgtgcccggcctgtttgagtatcttttaaaaccagtaaggacaaactagaggtgtcagctctcttcatgggctttggagaaacaagacaaaaaggaaagagatgtttcgccgggcgcggtggctcactcctgtaatcccagcactttgggaggctgaggacagcggatcacccgaggtcaggagtcaagaccagagccattgcactccagcctgggcaacaagagcacaactttatctcaaaaaaaaaaaaaccaaaaaagaaacaggaaagagatgttttgattttttaagtctagagtgttctgttcttactctacagcacttagcagtagtccatctatcctccttgtttgttctttacaacaaaaccccattggttctctcttaccaagtttgctttattcttggtttatcctttgtaagatgtgaaagggatatgaagagcaaataggaagtgttactcttgctgcttgagagaaagctgttttacaatttgttggcaaacaatttgtaaaagtacaacaaaagtgtgcatttttggcttcttatttatgttttatcattgctatatctcataatttgtgatttttaaaataactttttatttgaaaagcactacagggtcacgtcatgtttttaaaaaataaattaagaaggtaaacacccgtacttctactttacctctagtcctagtctatggtggtaatcagtgttaacagtttagtttgtgttcttacccttccaggggttttttttctctatgtatacagatatatgcatttttaaaaacatagttaacacttaaaaacaatatgggatcgtattaggaatacaatctgtattccttcccaacagtatatacagtttttttccatttcactatgtatctatttataaattttttatttctaataatttctcttgaataggtgagacatcatatagtataaaattcagtagaaaatcagtttttcagaggtacaaaattggctgactttgcacagactcctttcatttcacaggtagggatgcacagccacctcttccaccgacgagaggaaaggatatgtgtgcctgtgggctcttcaactctgttgattagttatgatttattttctggtcagtttgagaggaaacagtgataaaatactgggaacagggaagaagcataagattattattgtttttttttttttttttgagacagagtcttgctcagttgcccaggctggagtgcagtggtgcgatctttgctcactgcaagctccgcctcccgggtccatgccattctcctgcctcagcctcccgagtagctgggactacaggcgcccgccaccacgccctgctaattttttttttgtatttttagtagagacagggtttcaccatgttagccaggatggtctcgatttcctgacctcgtgatccacccgcctcggcctcccaaagtgctgggattataggcgtgaaccaccgcgcccagctttaattttttttttttttttttttttgagacagagtcttgctctgtcgcccaggctgaagtgcagtggcgcgatctcggcttgctgcaagctccgcctcccaggttcacgccattctcctgcctcagcctcctgagtagctgggattacaggcacccgtcaccatgcccagctaattacgggacctcgctctgtcgcccgggctggagtgcagtggcacagtctcgctcactgcaatctggcaagtgattctcttgcctcagcctccagagtagctgggactacaggtgtgcgccgctacgcccagctaatttttgtatttttagtagagatagggtttcgccatgttggttggccaggatggtctcgatctcttgacctcgtgatccgcccttctcggcctcccaaagtgctgggattaccggtgtgagccatcgcacctggccttcctactttattaagatacctaagggatttctgtgattgttaggattcaaatttctgtgagcataagaatcaagctgtgtgcataataattgcatgggatttcacagctgggccccattcccagggattttgtattatctacctccaagtgattttgatgctggtgatccttggaccagacttggtgaagctcaatgcttagctaggaaagccccaaaaatttgctttattggattgtgtaatttgactacatccattgtttcttttttcaaatgtagagttatatgccacaaaaatattttccgtagcagtaggcatcctaattaatctcgatgtttgtttatagccccattgatggggctataaacttggcagcaaattgttttcccactaatttggcattttccataaatgtttgtttatagccccattgatggggctataaacttggcagcaaattgttttcccactaatttggcattttccataaaaaacacgtatctgttgttagctgcctagacgttagctggacatggtttaggttacttttctcttaaaaagtaaattttaattcaagttcctttaagccagcagtctcaacctggggcagtttttccctccaggggacattcagcagtgtctagagacatttttggttgtcatgctgaggaagagagtgtatagtgggtagaatccagggatgctgttaagcatggaacagccccttacaacaaaaaattatgtagcctaaaatggcagtgttgccaagattgagaaattatgctttaaatgtgtttttatatatggccattttgtgtttactctggagataacatgcttttcctcatataacatgcttgataaacattttggtaacacaggaattgtaaatgctggtgatgtcagtaaatagttaagaaatttagggctgtgcgcggtggctcacgcctgtaatcccagcactttgggaggccgaggcgggtggatcccgaggtcaggagatcgagaccatcctggctaacatggtgaaaccccgtctctactaaaaatacaaaaaaatgagccgggtgtggtggcaggcacctgtagtcccagctactcaatttagaaagcagatttgtttcctttctatacctgtgtaatttgaggtttagtttactgtcacatcgtttataaacataaggaagatcgttgctcatctgatagcattccgaaccttgagtcatctgtaatgcctatggcctccagaaaagcttctctaatactgtacttagagatgtgtaaaatatgtaggaacattttcccaccttcgattgttagtttacctttcagcttcagtaatttacctttcagctattactttagtaacatcttcaacattgtttttcaaactgcaaggtgtgacccagtagtgggtcgttaaattagtaggtgacagagcatttttgaagaattaaatacaatagaacatagcagagtgggctcacgcctgtaatcccagcactttgggaggcgaggctggcaggtcacaaggtcggcaggtcacaaggtcagaagatcgagaccttcctggctctaacatggtgaaaccccgtctctactaatagtacaaaaaattagcggggtgtggtggcatgcgtctctagtcccagctactcaggaggctgaggcacgagaatcacttgaatccgggagctggaggttgcagtgagccgagattgcaccactgcactccagcctcagcaacagagcaagactatttcaaaaaaaaaaaaaaaaaaaaagaaagaaagaaaaaaagaaaatagagtgtatcacataattagagtagcaagtattgatttgtgaaacctattttaatcatagatctatgtatgtatgtgctggattgtgatgtaaagacatttcttgctgtggttacactgaaaaaaatgaaaagtcactgatttccaataacttacagaagcagtatgaactacatattctgtcgttcttgaaacaagctgagattttattgactttgggaagcagtagaattattttagttttttaattaacagtttttggctttgtactgtcaagaggtaattttagaaagcattctaaaaatgtaagtactggatttggcaacattcttgaactgtaattctgtttcgttaaacatcactatttacatgtgcaacagcgtgtctgtaacaatgtcccagtaatgaaattctttcttctatttaaggcatgtctgtttgataaaagtcaaacaaaattgggtatatgtcagtgtcttatgatactgcttaattaaacattaatttgactcttagctaatcaggaaatgtttgcctcacagtcttacagagctttccaccttctaaaaaagctaacgtttcagaatagattcaggattcaaccttctttctgtctttttttttttttgtttgagacagagtcttgctctgttgcccaggctggagtacagtggcgctatctcggctcactgcaacctccgcctcctgggttcaagcaattctcctgcctcagcctcccgagtagccggggttacaggcgtgcgccaccatgcccagctaatttttttgtatttttagtagagacagggtttcaccatgctgggtggccaggcgggtctcaaacttctgaccttgagatctgcccaccgtggcttcccaaaatgctgggattataggcgtgagccaccgcacctagcctagattcaggctgcttctttttttttttttttttgagacagagtcttgctcttgttgcccaggctggagtgccatggcatgatctcagtgcaccacaatctctgcttcccaggtttaagcgattctcctgcctcagcctcccaagtagatgggatcacaggcatgagccaccatgcctggctaattttgtattttttgtacagacggggtttctccatgttggtcaggccagtctcgaactccctacctcaggtgatctgcctgcctcggcctctcaaagtgctgggattacaggtgtgagccactgcgcccagcagattcaagctttttaaatggaattttgagctgatttagttgagacttacgtgcttagttgataaattttaattttatactaaaatattttacattaattcaagttaatttatttcagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggtaacaagtgattttgtttttttgttttccttcaactcatacaatatatacttggcaatgtgctgtcctcataaagttggtggtggtgactcactcttaggacacattcagatttcttttttttttttttttgagaaggagtcttgctccgttgccaaggctagagtgcagtggcacaatctcagctcactgcaacctctgcctcctgggttcaagcgattctcctgcctcagcttcctgagtggctgggattacaggcatgtgccaccatgcccggctaatttttgtacttttagttttaccatgttggccaggttcgtctggaactcccaatctcaggtgacccacctgcctcggcctcccaaagtgctgggagtacaggcgtgagccacagagcctggccatgttcagacttctaataacaggtttgtattgactcttagcctcatggcagaagccaagagacatgagacagcttagaaatttttgctttttggaaatgaatgttagagttactggtttgtgattaaggcctattgcactgacagaggcagtgaaaaagggtttgattgccaaggaagattcacagggcctagaatggcagtggttatgcatctacagtttattacaggagaaggatacaatccagtagcaggattatggtaaggatatgcatcacagtcaaaggctgtcatagcaagtcatccagagagttcgggtgcaagttccagttttcctttgttgtgtaaagtctgtggtggggtgcattttctctctcagagcaggatgtgtgcacaggacaccttggaacctaggagcccaaaatagagtcttcactggactttttaatatttttcttgtcaagcggacatgttcctgttctctaactagcctcttcagtggaggtcagaggaagagcctcattgagaccaagtgcaactcatcaatcacatgaaacaatgctgataaataaaccacctaaatatcccctgacccacaaatacaaaacaacaccattcaatcagtatttttcatgccttgatcaggggtcattgccatgcaggaactttaacaaaacagtacaggctaataatagaattgttggaattaactcacacagcacacctatgagagagagttaagatagagggtcttggtggtctctaacagttgaattcaaagtgaagttaccagagtaaagtgagcaaagacacatattagtacaatattggtagataaaatcacgttgctctaataagcatagttttaaactttaaccatgtttctccagtaattttagtaattatattgttgttatgtctaatacataaagcattttttacttttttaaaaaatttttaggcaatgtggggtccaaagtaattaaaaaaaaatttttttaacataaagcatcttaaaattttacttaatcatgatcacttagaaccattaaaacatacgttttgatattatggggaagcttcgttgttcctttgtagacagacttaaagaaatacaactttatgatgacaagatataagataattatagatttaaattttatagaaaccttttcccttatctagtgcaagaggtagctaagtgcttattttctcaaagtactgtgttataaaaagtattcctagtgtagtcaaagcttctctttagactgataaaacttagagcacctgcatttacttccaacaaagcagaattaaagaaaatgagacttggccgggtacgtttgtaatcccagcactttgggaggccgaggcaggtggatcatgaggttaggagatcaagaccattctggctaacatggtgaaaccctgtctctaccaaaaatacaaaaaattagctgacatggtggtgcgcacctgtagtcccagcttctcaggtggctgaggcaggagaatcgcttgaacccaggaggtggaggttgcagtgagctgagatcacaccactgcgctccagcttgggcaacaaaaaaaaaaaaaaaaaaaagaaaaagaaaatgagtctttactggctgggcacagtggctcacacctgtaatcccagcactttgggagaccgagacgggcagatcacctgaggtcgggcattcgagaccagcctgaccaatatggagaaaccccatttgtactaaaaatacaaaattagcggggcgtggtggcgcatgcctgtaatcccagctattcgggaggctgaggcaggagaattgcctgaacccgggaggcggaggttgcggtgagcagagatcgtgccgttgcactccattctgggcaacaagagcgaaactctccatctcaaaaaaaagaaaatgagtctatactttgctgttttcatactctcttagtgtggtgtaggcagccatgtatcccccttgtgcctctatttctccattctgtgaatgagtgtcttccactgctgtgcttttctgattccgtaacctttgtttgtttgtttgtttgtttgtttgtttgttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaatgagcgtgctgccttcaagcatctgtttaacaaagcacatcttgcaccacccttaatccgttcaaccctgagtggacacagcacatgtttcagagagcacagggttgggggtaaggtcacagatcaacaggatcccaaggcagaataatttttcgtagtacagaacaaaatgaaaagtctcccacgtctacctctttctacacagacacggcaaccatccgatttctcaatcttttccccacctttcccccctttctattccacaaaaccgccattgtcatcatggcccgttctcaatgagctgttgagtacacctcccagacggggtggtggccgggcagaggggctcctcactacccagtaggggcggccgggcagaggcgcccctcacctcccggacggggcggctggccgggcggggggctgaccccccccccccgcctccctcccggacggggcggctggccaggcggggggctgacctccccgcctccctcccggatggggtggctggccgggttgggggctgaccccccgcacctccctcccggatggggcggctggctgggcagaggggctcctctcttcccagtaggggcagccgggcagaggcgcccctcacctcccggatggggcggctggccgggcggggggctgacccccccacctgcctccaggacggggcggctggccgggcagagcggctcctcacttcccagtaggggcggccaggcagaggcgcccctcacctcccggacggggcggctggccgggcagaggggctcctctcttcccagtaggggcggccgggcagaggcgcccctcacctcccggatggggcggctggccgggcggggggctgacccccccacatccttcccggacggggcggctggccgggcagagggtctcctcacttcccagtaggggcggccgggcagaggcgcccctcacctcccggacggggcagctggccgggcggggtgctgacccccccacctctctcctggctgggcggctggctgggcggggggatgacccccccatctccctcctggatggggcggctggccgggcggggggctaacccccccacctcccttccggacggggtggctgccgggcgcagacgctcctcacttcccagacggagtggctgccgggcggaggggctcctcacttctcagacggtgtggctgccgggcggaggggctcctcacttctcagacggggcggttgccaggcagagggtctcctcacttctcagacggggcggccgggcagagacgctcctcacatcccagacggggcggcagggcagaggcgctccccacatctcagacgatgggcggcctggtagagacgctcctcacttcctagatgggatggcggccgggcagagacgctcctcactttccagactgggcagccaggcagagaggctcctcacatcccggacgatgggcggccaggcagagatgctcctcacttcccagacggggtggcggccgggcagaggctgcaatctcggcactttgcggggccaaggcaggcagctgggaggtggaggttgtagcgaactgagatcacgccactgcaccccagcctgggcaccattgagcactgagtgaacgcgactccgtctgacatcccggcacctcgggaggccgaggctggcggatcactcgcggttaggagctggagaccagcccggccaacacagcgaaaccccgtctccaccaaaaaaataccaaaaccagtcaggcgtggcggcgcgcacctgcaatcgcaggcactcggcaggctgaggcaggagaatcaggcagggaggttgtagtgagccgagatggcagcagtacagtccagctttggctcggcatcagggggagaccatggaaagagagggagagggagaccgtggggagagggagaggagggagagggagagggaaccttttgttttattccagtaggaccagctagaaacagaaggtgattgaccagtattagggatggaatcagggtacaattatggagacaggctatctaaacaattcactctcaccatttaaatcagctgtttgatcattttttttccatatatctttaccatcgcatagtaaataatatcctttttattttcaagagggagtattggccttaagttaggaactctcttaatttttttcccccatcatcccacccgcacttcttactccttacttcctacttgcttttattctttactggctctttaccactgcgtatttttaggtgcatacatctattttttaaaaaagcacccttgttcctgggtcctcttccagtaccatctattaatatatctctctccctctttccactcccagctgggtttctgaaagcgtgcacttcccatcttccattcattcatctggtttccagccctgaccacagtactgaaatggcatttgctaggtgacctttatttttttttaaatccagtgaatgcggtatagtccccccgcttttttctttctttttttttttttgttttttgttttttgtttttttgagacagagttttgcccttgttgcccaggctggagtacaatggcgtgatatcggctcacggcaacctatgcctccccaggttcaagcgattctcctgcttcagcctcccaagtagctggattacaggcacctgccaccacagctggctaattttgtatttttagtagagatgggttttctcgatgttggtcaggctggtttcgaactcccgacctgaggtgatccacacacctctgcctcccaaagtgctgggattacaggtgtgagccactgcgcccagccttggtatagtctttaacgaaagttcactgatcttgaaaattttgatcttgaaactcttttttttttttttttttttttttttgagatggagtcttgctctgtcacccaggctggagtgcagtggcacaatctcagctcactgcaacctccacctcccaggttcaagcgattctcctgcctcagtctcccgagtagctaggattacaggtgcccaccaccatgcctggctaattttttgtatttttttagtagagatggggtttcactacattggccaggatggtcttgaactcctgacctcatgatccacccacctcggacctcccaaagtgctaggattacaggcgtgagccaccatgcccagccttgaaactctcctaaggttatgttaaacatttttgtattcttggttttctttttgttccatgggttatttctctttatccttctttttagctttcttaagtgttcctttaccttatcaaattctatttttggctcccatttcacttaataagaggaaaagctgggatttttttttttcttttgtggagacagagtctcactttgttgcccaggctggagtgcagtggtgcgatctcagctcactccaacctccgccttctgggttcaagcgattcttgtgcctcagcctcctgtgtagctgggattgcaggcatgtgccaccacgcctggctaatttttgtatttttagtagagatgggggtttcaccatgttggccaggctggtctcgaactcttgtcttccaagtgatctgcctgcctgggcctcccaaagtgctgggataaatttgagccattgtgctcgtctaagctgggattctttgaatgagttcttagaggcttcctgaaactttgtgcaacattttgtgtatgtgtatattttctggggaaaggatttgtaactttctattttttgagagggagtctctgtggctcagggtggagtgcagtggtgtgatctcggctcactgtaacttctgcctcctggttcaagtgattctcctgcctcaggctcccaagtacctggaattacaggcatgtgctaccacacctggctaattttgtatttttagtagagacagggtttcattatgttggccaggctgggaatttgtaactttcatcagatatcccaagggatatatgtctttcctggtagagagggaagaaacaaaaaacgtgtgtaaataccctcctctcccccagaaggtaagaagtactgctctgcacattccttgggtgatctttctcactccctgggataattaaggaagttagggattggggttgagggtaacttggcatccttccccaacctccctgtataggcacagtctaatatacttgatgacagtttgcaacaagtcaacaatttcctacttttctggtgttaggtttaagttatatagacctatggtgatcataacattatctaaatcagatgcttcacattataggtcttgcagctgatgtccagtttaggtgtttgaagtggcttagcctggaaaatgttacaggggaaaatctgctttccatgtgttatgctcagagctgtgttcttttcttttacacaatatgtttgacatttgttgaattttaggtgtaccctggtcattaggaactccctaaaggatctctgtgaggttttaaaaaaacaaaacaaaacaaaaaaacagtggcattttgcagaactcagtatagctctttaccatactgactgcaaggagaaagtaaaaagtgagactaattttgcaattagtctcccaagtttctttacaagaaaatagaccaaaggtactatgtttaaaagcaaaatcatggcttaaaagtttttctttttcttaatatattaatatattgctataaattgagtattgctctcttgctatcttgtgtttttttggtttttgattaactctaagcttaatgttattcctgacaaataaataaataaataaataaataaataaataaagtgaattcagagagacagtagagggcagcagccgtttagaaagtagattcacattgagtgattacggctcttttaaatctttctccactaagagatagctaatttccgaaaaggtatacttggcctcccatattccttatgtctcttaaaactaaaaaagctgggacaaaacttaaaataacagtattctacggttagggcaaatttctgatactgcttaaaacaatttaccgaggtatctttatttttttttgagacagggtttcactctgtcacccaggctggagtgctggagccttgacctcctgggctcagctcaagtgttcctctcacctcagtctgccaagtagctgggactacaggcatgcaccatcattcccaactaattttttaaaattttttgtagagatgggggtttcatcatgttgccaggctggtctcgaactcttgggctcaagcaatctgcccacctcgtcctcccgaagtacagggttataggcatgagccaccactcccagcctcagatttttttattgatgaattttattataacagctacaatactgagatgcataacccttccctttcctgatacccagttatcatctgtttctgtttaatacactccttaagtacctcacatttgctattcccctgccccccatggtctatgcatcttcttcattgaagtggtagtagtctttgttagctcatctggtcatgtcatcaattcagagcacattacctctttagttcagaacacattaattgcttcccataatcttcaggacacggccccatttcttcacgtggcttggccattgcttccctgttcagcttcccccacactccctcacctacaccttctgtctcagtatagtactgctagtctccagacatgccatgcctttttatgcttctatgcgtgttttcctgtctttaatgtccttgtccatgtgatgaacccctactcatttttccaagattgaactcaaatgtcaccttttctgtgagcttctctgctcttctcatgcagagtagaagtgtttatctccattgcccttgaccctaaataacagtacattagtataataatcacattttttacctgtttgtgtgctttccttctaaatggagaataagaatataaaagtgatttatttggcatttctgcaaagggagatgataaaaagaatctgcgttacttagcctttttaaaaaacccttagcctatgaaggctactatttaaggtttggttggattttgtatgttggaaatatgttctttaaatctcatcttcatcagtttataaaagcaatataagttctttgtagatcattatcatgccatccagatgtagtcattattgttttgatataggttgtttcagtctttaaaccaaattatacactgttccgctgtaactcttgttttgaaaacagatttgttccaatgtgggtggtatattagggaacaatttgagcataatgtaaattttgagtttgcttatgcacaaatccctaggcaacactaggtgaatgcagaaaaatgcatgcagctgaactcagcagtgtagatatatacaaaagatacacatacacacgctcttcaaatacctaccttattttcctgtatgtgttatgaaccatacccattcacatctggtattacaactttgccacccatttcagacagtattcctttgaccattctgcagtaactcagaagctgcagccctttagaagtctactccactgtggctcacgtctgtaatcccagcactttgggaggccgaggtgggtggatcatgaggtcaggagatcaagaccatcctggctaacacggtgaaaccccgtctctactaaaaaaaaatagaaaaacctagccgggcgtggtggtgggcatttgtggtcccagctactcgggaggccgaggcaggagaatggcgtgaaccggggaggcagagcttgcagtgagccaagattgcgccactgcactccagcctgggcgacagagcgagagtccgtctcaaaaaaaaaaaaaaagaaaaaaagaaggccactccacaagcaaaccgcagatgttttgcaaggtgacttatttattgtaatagttgtgtatttcttaaccatttcacatgtataaaactgtgctactacttttatgaggttcctgtctttattttttttaacatgtcgctggtgaaggttctgagagttgtggcttgaactccagttttctcataagcacggttttttgttgtttttttttgaaatggtctcgctgtgttccccaggctggagtgcagtggtgtggtctcggctttctgcagccttggcctcccagcttaagctatcctcccacctcaagctatcctcccacctcagcctcccaaatagctgggactgcaggcgtgagcctttgcccacctaatttttatacttttgtagagacagtttttccatgttgccaggctgctttggaactccttagctcaagcaatcagcccgccttcacctcccaaagtgctgggattacaggtgtgtcctaccacacccagacggctctggtatttactgcatagtgttctgatttttaggaatacatacgttgcattatatagcagaactggctgtattcaaaagtctaatagaaaatattgatagggtgataatgtatatagtactaattgtcagttgccataatttaactaatattgttttactttttactttttttttttttgagatggggccttgctatattacctaggctggtcttgaactcctgagctcaaggaatcctcttgcctcaacctcctgaggatgtttgacattttttgacttttttttttttttttttgagacggagtcttgctctgtctcccaggctggagtgcagtggcatgatctcggctcactgcagcctccacctcccgggttcaagggttcaagcacttctgcctcagcctcctgagtagctaggattacaggtgtgcaccaccaccacggctgatttttgtatttttaatagagatggggtttcaccatgttggtcaggctggtcttgaactcctgacctcgtgatcctcctgtgtcagcctcccaaagtgctgtgggtacaggcgtgagcctccatgccggccggctttttggcaatttaaatagttacagttacctattataattgatatttagctaacatctatttttattttaatattccaggaaattattatgcagaaactttaaaggtctgtgtacttctctggtgttttgattttttttttttctttttctgtgagtaattttctaaaactggtttctaggccaggctatttatgtcttgctttttattttttttggcgatggagtctcgctttgttgcccaggctggagtgcagtggcgctatctcatcttgctgcaacctctgcctcctgggttcaagcagttatcctgcctcagcctcccgagtagctgggactacaggcacatgccaccacgcctggctagttttttgtatttttagtagaggtggagtttcaccgtgttgcccaggctggtctggaacttctgagctcaggcagtctgcctgccttggcctcccaaagtgctaggattacaggtgtaagccactgctcccagccttattattttatttttatggattcggggtatatgtgcaggtttgtcccatggatatattgtgtaatggtgagttttggacttctgttgtgcccatgaacattgtacccaataggtggtaatttttcaattctcatccctctctctgcctctgcccttttggagttcccagtatctgttaattctctctgtatgtccatgtgtacccattgtttagctcctctattttttattttattttattttatttttgagacaagagtcttgctgtatcacccaggctggagtgcagtggtgcaatctcagttcactgcaaccttggtctctgggttcagatgattctcgtgccttagcctcccgagtagctggaattacaggtccgtgccacgatgcccggctaatttttgtattttcagtagaggtggagtttcgccatgttggccaggctggcctcaaactcttggcctgaagcaatccgcctgccttggcctcccaaagtgctgggattacggtgtgagccactgctcctgaccccatattttttcttttaattataaaggtaataatgtaaaaagaagtcaactcccagtttaactctagcagagtaaccagtgttaatttttttttttttttttttgagacggagtcttgctctatttcccaggctggagtgcagtgatgccatcttggctcactgcaacttctgcctcctgggttcaagccattctcgtgcctcagcttcctgagtagctgagattataggcgcccagtgccacgcctggctaatttgtgtatttttagtagagatggggtttcaccatgttggctaggctggtgttgaactcctgacctcgtgatccacccgcctcgatgctgggattacaggcgtgagccactgagcctggccaatccattcctttttatggctgagtagtattccattgtgtgtgtgtgtatatatacatatatatacacacatatacatatatatacacgtatatatgtatgtatgcgtatatatgtatgtgtgtgtgtatatatacacatatacatatatatacacctatatatgtggtatgtgtatatatatgtggtatgtatatatatgtggtatatatatgtggtatgtgtatatatatatgtggtatgtgtatatatatatgtatatatgtgtgtatatatgtggtatgtatatatatatgtatatatgtggtatgtatatatgtatatatgtgtgtctgcatatatgtatatgtgtgtatatatacacgtatatgtgtatatatatacgtatatatgtgtatatatacatatatacgtatatatatacacacacacatatatatacacatatgcaggcacacatatatatacatatatatatatacataccacagtttctttatccacttgttgattcatgggcatttgggttggttccacgtttttgcaattgtgaattgtgctgctataaacatccgtgtgcaagtatcttttttgtataatgatatcttttcccctgggtagatacccagtagtgggattgctggatcaactggtagttctacttttaaggaatctccacactgttttccttagtggttatactggtttacattcccaccagaagtgtagaagtgttccctgttcactgcatccacaccaacatctatttttgattttttgattatggccattcttgcaggagtaaggtggtatcgcattgtggttttgatttacatttccctgatcattagtgatgttgagcatttttttatgtttgtttgccatttgtatatcttcttgagaattgtctattcatgtccttagcccattttttgataggattgtttgttttttttcttgctagtttgtttgagcttgttgtagattctggttattagtcctttgtcagatttatagattgtgaagatttttttcccactctgtgggttgtctgtttttgtctgtttccttctgctgactgttccttttgccatgcaaaagctctttttttttgagacagaatctcgctctgtcggccaggctggtaacaaagacacaggtactggtaataactgccatggcttattgcctacattaatgatgaaagcaaatgctaaatttcagctagaggctagagaaaataagcctggaattttcttttatgtttatatactgctatgaataccaggagtccttgggttaagactgtagggctttctaaagcctgtgatcactagtggagaatgtagctttacaaagtctagttggaaattggcaactgggggttagtacaagttacaaggaagggatggaatttaagatgctagtgaaagcttggaggataagggagcaggtgaactcataaggaagtttatgaactgagaagggctgcagcaaagtgggctcatgtgcttgaggagccagaggacatgttgagggtgacataggttctgaagttcgtacagatacttatgcagtatggattcttggaaaaccttctttagtcatgtgatagaaaaataacagcttatggaaaaaacagggttgaggcagacctgaaaatacatgaaattttaaaaaccgcttctaacagaagcataacagactgtaataaaaactgtggccttcctggcatttgcacccaaacaacagcattagccaactctttgaagccttagatctgtggctcttgttttctcctttgaggtgtaggtccttgagggcatttgcttctaatagaggctagtttcatcagaattaaaaatctgaaccatggtatgaaattcaattcttttttttttttcttttttgaaaacactggcaaatgttttgtatccttgagctttcccacatatcttaacatagtgagtggaaagtacagtggctgttaagccaactactctgaggtcttcactgctaaggcttactcttaattgtgtgagagcttaaccttgatccctttaaaacattaatgggctagaaaaaaaaccattcataaaccagtgccacctctgaattttgctaccacaattcccttatttaccaatagtgcatgagctaatttggaataaagaactaggcattgtagcacaacagacattatgtgggcaaagtgttgtttatattctgtctaaatagtgcttcacatgtatgtactattttctaaatatgtatagatgcttttgtgattaataataaaacatgaattcttaaaacaattttgctgacttcatagtagcttttcaccgttttttcagtagctgctaaaatttctggagaagtttgggaactattgttttggagtgaaatgcagtgtgttagatatcacttgcagaattcttctaagggtatttattggcgattagaaaaaaaatccttgtgttataccagtagtaatacaaagtaattgttcagcttctgttaagtgtaaaggactatacaagtattgtgtatagttatctcatttattattttctgggtagctattgttattattacttcgtacaaaaagggaaaaggaggctcaaagtatcatgctccagataacagagccagtaggtagcagagctgggattgctacccaggtctctagtcctgctttttcacactatatactcattgcttcacttactccttcatacatgattccccagcatgtactcttttttttttttttttttttttgtttgagatagaatctcgctctctgttgcccaggctggcaggcagtagtgtgatcttgggctaactgcaacctccatctcctgcattcaagcagttctcctgcttcaacctcctgagtagctgagattataagcctatgctaccacgcctggctaatttttgtatttttagcagagatgaggtttcgccttgttggccaggctggtctcaaactcctgaactcaagtgatctgcccacctcagcctccgaaagtgctgggattataggcatgagccatcatgtccggcctccccatcatgtacccttaaataccatcaagcacagttccattgtgtaaaaacttggcttgatttaacctgttaattggaacactgtcattaatggaaattaggaatatgaggtaagctagaggttttattttaatgactttgggttattaaatctataagaaatgaaattcatttagtcataattaatgtcatgtttctgcatctatattacttgttgggtttacagacgaggtagtgtattattagtgggaagctttgagtgctacatcatctccctttctataaaataaattgagtacgaaacaatttgaattaaaacacctgagtaaatagtaactttggagacctgctgtactatttgtaccttttggatcaaatgatgcttgtttatctcagtcaaaattttatgatttgtattctgtaaaatgagatctttttatttgtttgttttactactttcttttaggaaaacaccagaaattattgttggcagtttttgtgactcctcttactgatcttcgttctgacttctccaagtttcaggaaatgatagaaacaactttagatatggatcaggtatgcaatatactttttaatttaagcagtagttatttttaaaaagcaaaggccactttaagaaagtttgtagatttttctttttagtatctaattgtagcacctttgtggacagtggatgtaatattaagtgacagatgggaaaaggatttttaaaaaaatagcaactgtttcagtggatgaaataaagattattagcagagaaaatgaatattgggcataactgtcctggtgaaagacaatctcataaatgaacaatttcataatttcgtaaatgcaactgcattttattttcaaagagaaggaaaattatagtcactggaaacggaaagagaagttagaggtaaacataggacacacaagaaaactttcattttgtttattttcttgtttttcttttgagacagggtttccctctgttacccaggcttaagtgcagtgacactatcatagttcactaacccctcaaattcctgggttcaagtaatcctcctgccttagccttagtaggtgtaaatacaggtgtgtaccaccatgcctggcgaattttaaaaaaacttttttatagagatgagctctcgccgtgttgcccaagctggtcctaaaacgctggcctcaagctatcctccggcctcagtcttagcctcccaaaatgctggggtttcagtagaagccaccatgccgggccacttctgtttcttttccatgtagagttctttgcaggaggaggttagaataggtgtgcatctcctaaatagttgtcgaatataactaaaaagttaaccaggactctaaatactatttacttctaaaatttgttaattgggaacatttagggtttaactgatctatatcttatgtctttaacaattttgaatgataattatatgtaaagtaagaacagtttgtgaaatagttgaaaatatccttacatgaaagtgaattttaaagcacagtttatgtaatgttaatgttttgttttgtatctgttaaaaatttgtttatatgaacaagtttacaggtttactgtggtgagcccgttgaatatagtgggttttttttgtttgttttgtttttgtttttgagatgaagtctcactcttgtcccgaggctgatgtgcaatggcgcgatcttggctcactgcaacctctgcctcctgggttcaagcgattctcctgccttagcctcccgagtagctgggattataggcacctgtcaccaaacccggctaagttttgtatttttggtagagatgggatctcagcatgttggccaggctggactcaggtgatccgtctgcctcggcctcccaagtgctgggattacaggtgtgagccaccatgccgagcctgaatatagtgtttttaagttgcaggactttaaaaataatattttgaaatttttctaagttaaattccctgttaaaatggtcatgcaggaatatacgcttgcattattcatattagggtaactgtttggtttgctagttgttagattctttgcattcctttttttttttttttttttttttttttttgagacggagtttcactctttttgacaaggctggagtgcaatggcgctatctcggctcacctcaacctccgcctcctgggttcaagcgattctcctgcctcagcctcccaagtagctggaattacaggaatacgccaccaagcccggctaattttgtatttttagtagagatggggtttctccatgttggtcaggctggtctcaaactcccagtctcaggtgatcagcccacctcggcctcccaaagtgctgggattacaggagtaatcccccacccttttaaaaaaatgagacagagttttattctgtcacccagggtggagtgcagtggtgcgatcatggttcaccgcagccttgaatctgggctcaagtgatcctcccacttcagcctcccaagtagttggaaccatagatgtgcatcaccacacctggctgatttttaaattatttgtagagatgaggtcttgcttgttgtctaggctggtcttaaacttctgggcttcagcagtcctcctgcctcagcctcccagagtgctgagatgatagacatgggccactgcccctggccgcatttttcttttcttttcctttctttttttttttttttttttgaaacggagttttgccattgtcgcccaggctggagtgcagtggcacgatctctgctcactgcaacctctgcctcccgagttcaagccattcttctgcctcagccttccagttatctgggattacagtcatgtgccaccacgcccagctaatttttgtatttttagtagaaacagggtttctctatgttggtcaggcttgtcccaaactcctgacctcagatgatccacctgcgtctgcctcccaaagtgctgggattataggcgtgagccaccatgcccggccctaactgcatttttcttagtatttgtggtttgagttaatacttgccctatgtgatgttgatttattattactggatcattaagtgaggtttaaagaagctaaatgccatttgctctatgccctctggattttaaaagtgcatgggtgtgcacgtgtgtaggtataaatgtttccatattctagtatattctgtgtcagtgatagagcagtcttagagctgtcttttccatttacttgtaggttaagaagccaaaaaaagttgtgtcatcatcccgtttaggaaaacttacattttggctattgtttcctctagtgctgctattagtggaatgattttaggtgttcaactttcagatcaatgggagacagaaatattgttctgagacatctggaagccgaatgtgttttattcctgcctgtctgaggatgtggtcttgcctttgatagggcaaagttatttgtaaacattgctttaaataaaaacatgtaaaggtgtttttgatggttaacaaaaactatgagtataatagagcctagtccctattacggactggtattgatctggtgtgggaagagtattgagcttttcagtgtcacctacctgtattcccttgaagggacccagagcccaggcaaagctctgctgaggtcgggcgtggtggttcacgcctgtaatcctagcattttaggagaccaaggcgggtggatcacctgaggtcaggagttcaagaccagcctagccaacatggtgaaaccctgtctctactaaaaatacaaaaattagctgggtgtggtggtgcatgcctgtaatcccagctatctgggaggctgaggcaagagaattgcttgaacccaggagacggaggttgcaatgagccgagatcatgccactgcactctaggtgggtccctgagtgagactccatctcaaaaaaaaaaacaaacaaaaaaaaaaaaaaaaaaaaacctctgctgaaatgctacagttaattttgccatttgtggtcagcattcttcttctaaattgctataatcttgccttcatattatgtgtctcaaatttaagcaggtatcagaatgtccacgggaacaaattgccatggctctaagcccagaatcagattcttcagatctggagtagggctggggaatttgcatttctaacacacaagtttgttgatgctgtttgtctggggtccacgcttgcctaacttctgatgtgatttatttctgccagtttctttttttgttgttgttttatttttttgagatggagtctcgctctgtcactcaggctagggtgcagtggcatgatcttggctcactgcaacccctgcctcctgggttcaagcgattctcctgcctcagcctcctgagtagctggggttataggcacactgcaccacacccagctaatttttgtatttttcgtagagacagggtttcaccatgttggccaggctggtcttgaactcctgacctcaggtgatccattggcctcggcctcccaaagtgctcggattacaggtgtgagccacccaccatgcctggcccttcctaccaatttctatcctccctgaaatgctgcacacttaggcagtcactggacaatatctgccccaaaattggtttgtataattgagaatatttaagaggttgttaaaatttgaaccactttctattcttctattaagtgtacacatctattaaagatccccttgtagctctttttatctgggccatcacatttctgcccagcagatgcagaggccctgtcctctcttccacctccccactacctctccttccctacttttggactgtaaaagctgtctttctgcagttaattgttttattctttgtaggttctactcgttgataatgttatctactgctataataattacagacggcaacaggatgatcaaatcttggatattttaaatttacattatgccttttttattttatttttttaaagtctctgcttgacagcaaataagcctaacgttccctaacaaatgatgatgtcccattaatgatttgatgacttcctgtttgtagtttttatttagagtgcttgtgggtagtttttcataacgacatttaaaaatcaggatataaataattttttaagttttttttttaggcggggcacagtggctcacacctgtaattccagcattttgggaggctgaggtgggcagatcttgtgaggtcaggagttcaacaccagcctggccaacagggcgacaccccatttctactaaaaatacaaaaattaggccgggtgcggtggctcacacctgtaatcccagcactttgggaggccgaggcaggcagatcacaaggtcaggagatcgagaccatcctggctaacacggtgaaaccccatctctactaaaaatgcaaaaaattagccgggcatggtggcaggcgcctatagtcccagctactcggaaggctgaggcaggagaatggcttgaacccaggaggtggagcttgcagtgagccgagatggcgctgctgcactccaacctgggcgagagtgcgagactctgtctcaaaaaaataaacaaataaaaaataaaaaaattaaccaggcatggtggcgcatacctgtagtcccagctacttgggaggctgggacagtagaatcgcttgaactcgggaggtggaggttgcagtgagctgagatcacccactgaactccagcctgggcaacagagcaagactctgtctccaaaaaaaaaaaatgtatttttctttgaagcttttctacttttaaatgtaatgtatagtattataacaagtgaacaaaatgatacaaagaagtatggcgggaaaggtgtggtagagatgggaaaacatatttcctccagcctcttaggttcattggaggagcttgggaattcaactgacacacgacagatttacaggagaaaagttttatttcaagtacacatgagagcttcatagaaaagaagtgaagacctaaagaaacagactggagagttcatatgccattttaataaaggataatgtattagtctgttctcatgctgctaataaatacatacccaagactgggtaatttataaagaaaaagaggtttaatcgactcacaattgcacatggctggggaggccttacaatcatggcagaaggtaaaggaggagcaaaggcacatattacatggtgtcaggcaagagagtgtgtgcaggggaactgccctttataaaaccatcagatctcgagagacttattcaccatcacaagaacggcatgggaaaaacctgcccccgtgattcaattacctcccaccgggtccctcccatgacacatggggattatgggagctacaactcaagatgagatttgggtggggacacagccaagacatatcagataataaattgtggagaggcagtaagattgaagaaaagaggtttgagcttcgaggggtggtaaattgtgggaaggtaattatttggggcaaactaatggcacataaggattgttttagtaaggcttgttatgcatacccaaaacaagtgccatctccagtaatttaagagtctatggtgatcaagagtagttctcttcctgctagaagaggggtgggagagaacaccttcacaaagggaaatttatattctgccttcatgcagaaagggggcgagcagagagttcctacgtatactgtttcttcattatcttcctctcaaaagaatacttaggctaaagtggcatgatttggggtgacattctgatcctcttcagtgacaatccttgatatttttccttctttctctccaggtaaacagtgttaacatcctggtatgcttcccccaattccattatactaactctgtattgtgggttaaagattttttactttgatcagcagtatttgaaacatacctgttatactagatgtactctgactgtaaaatagtggtcagtgttacttctttaatgatgctgtgggattaaaggattttattataaatgctgggaagagcctggatttgaggaaggtaagcagtgcagttaggtggatgtagactagaagaggtcatttgttctcatttcattgttgcccctatgacatgcccgtttctttcttttttttctttttttttttgagacggcgtcttgctctgtcgcccaggctggagtgcagtggcgcaatctcacctcactgcaagctctgccccccgggttcatgccattcttctgcgtcagcctcccgagtagctggaactacaggcgcctgccaccatgcccagctaattttttgtattttcagtagacacggggtttcaccatgttggccagggtggtctcaatctcctcacctcatgatctgcccgcctcggcctcccaaagtgctgggattacaggcgtaagccactgcacccagcctacgtgcccatttcttaaagtagaaaatttagtagttgatgatgtcagggaagaaaagctttttctctgccttacgttaagtagttgggggcaaattaaattaataaaagacagattagtgagagaaaaggctgtaagaatttggactttatataccatcataatagaggaagtaaagggagatgaagggcacttaagggaaaacagatgacttgtaggaaagataaatgaacccttaagagaatagatgagaaatatgaaggttttgtgacaatgtctgtttaggtggttacttctcttcttgttatgagagtcagtcttctggttgctggaaactgctaggagatttataacaattgggctctttcgagaggctcttcttttaagcagataagggagttcacaaaaaagcctgttctcaaatgatttcagcacacacacacacacacttacgacacagttaagtactgtgccagtaagatgtgagttgtgcatttcttttttttctctgagtagactgtttgaggttatttatatcaggacttgttatgcaggtaactgaaaactcaacataatctaggttatgtagttaaaagtatggagagaaggtaggctttatttagagttgcttgatcctgtagatctcttctaccttttgtaattttaatttcaaccaaggatggttccctttttggccctaggaccagttagcagttggggcaccattccaagcaagagtcctgcagtttgtagtgatgggaccatttaaacagtgattgtgaccagggacatagaatgggatgattggcccgaggtaaccatggttgggtatggagtcagcttccctgtaggaagagatagacaaagtctgagcactcctgggaagggggaggaagggaataactgttgtgtaaatcatcagcagtgtctactaagataccatctgtaaccataggcttctatgttttataatataaggctgtcttttaaataaatcagattccctgttaaagatctgttctagattccctagggggttgacctcatatagtatcttctttttctttggttacaaacttttaaacttgtctgaggttataaggtgaattcaactgtccactgtcaatgtagatatttttaatggatttagggatttaaattacatgattcagaaccactttgaggaagtctagggaatatcagttgtttctgtataatttctgaaagcttcactgttttctaggtgtgcacttaattcatgtgatgaagggaacagtatttacatgagtggtttggttaatttttcccctcctaagcttagctttgtgtatcgtgcgtgcttccagtgtttttgtggctgctttacataagtcttttagaagtattttctatttttgaagtaaatgtggatcaaaaccaccccaagacaggattgaaaaaaagacagtttttcgcaagaaagtaaataattttatttagcttgggactttaaatgatatgtcttaaatgtaaacatttctatactgcattttggccatcttttgatactagttttcagatgcatattgttatttcatttattattggaaaagtagtaactttaaacaaatttttattgaaaatgctgacagaggccgagtgtagtagctcacacctgtaatgtcagcactttgggaggccgaggcgggcggatcacgagctcaggagatcaagaccatcctggctaacacggtgaaaccccgtctgtactaaaaatacaaaaaaattagccgggcatggtggcaggtccctgtagtcccagctactcaggaggctgaggcaggagcatggcatgaatctgggaggcggagcttgcagtgagccaagatcgcgctactgcactccagcctgggcaacagagcaagactccatctcaaaaaaaaaaaaaaaaagaaagaaaatgctgaccaaaaaaaatgaaatagttttaaagaagccacagttgtgtgatcctgatacaactatatcattattgtatgagtatatatgagttataaaaatagtatatgtaaatgcttcataatttttattattagaaatgaaaaagtataacaaggggggtattcatattctctccacttagaattaaccctcaacatgttgacatctttgtttatagtaatccttttttgttttttttgttttttattatactttaagttctagggtacatgtgtacaatgtgcaggtttgttacatatgtatacatgtgacatgttggtgtgttgcacccattaactcgtcatttacattaggtatatctcctgatgctatccctcccccctccctccacccctcaacaggtgtgtgatgttccccttcctgtgtccaagtgtcctcattgttcaattcccacctatgactgagaacatgcggtgtttggttttttgtccttgcgatagtttgctgagaatgatagtttccagcttcatccatttccctacaaaggacatgaactcatcattttttatggctgcatagtattccatggtgtatatgtgccacattttcttaatctagtctgtcattgttggacatttgggttgattccaagtctttgatgttgtgaatagtgccgcaataaacacacgtgtgcgtgagcctttatagcagcatgatttataatcctttgggtatatacccagtaatgggatggctgggtccaatggtatttctacttctagatccctgaggaatcgccacagtcttccacaatggttgaactagtttacagtcccaccaacagtgtaaaagtgttcctatttctccacatcgtctccagcacctgtcgtttcctgactttttaatgatcgccattctaactggtgtgagatggtatctcattgtggttttgatttgcatttctctgatggccagtgatgatgagctatagaaatcctttttagaaacaacagagccttgttgtaaaacaggtaaatgtacgtgaggacttcaaaaagtttgtggaaaaatggaattaaaagataaaatttaaaaacacattttaaatttatttcccaacataagctcctcaagttcaagacacttttataaatgatgatctcagctgtttagttcatccgtaaagaactgagggtactagaaattttaccatgtcaatgcagtctctttacattactaactaaagaaaaataggtgctctttaaagatcttttaagattaggaacaaaaagaagtcagaagaagccaaatcaaggtggatgcttaacgactttccatagaaacttacaaaattggccttgtttgatgagaagagcgtgcaggaacgttgtcatggtggaaaaggactttgatgatgctttccctggcatttttctgcaaaaacttgggataactttctcaaaacactctaataataagcagagcttatgttctttatccccccagaacatcagcaagcaaaatgcctgaacatcccaaaaaactgttgccatgacctttgcccttgactggtccacttttgcttcgactggaccacttccatttttggtagccattgctttgattgtgctttgtcttcaggatggcattggtaaagccatgttttggctcctgttacagttctttgaagaaatgcttcaggatcttgatcccttgtttaaatttctatggaaagctctgctcctgtctgcagttaatctgggtgcaacagttttgtcacccatcaagtgaaaagtttgttcagctttaatttttcagtcagaattgtgtaaactggaccaattgttgagatgcctgtagtgttggctattgtttctgctgttagtcattagttctcttcaattagggaatgaacaaaattaatttttcctgaaaaattgatgtggatggtctgccgctgtgggcttcatcttcgacatggtctcatcccttgttagaacaagttatccgtttgtaaactgctgatttcctaggagcattgaccccataaaattttcataaagcatcagttatttcattattcttctatgcagacttcactataaatttgctgtttggtcttacttcaattttagcagaactcatactgctctgacatctaaactgatgtcttagccttcatagtgtctctgactagatcctattcagacgtgttatagcaaattagtaaagtttattttggtgccaaaaacttttgaatccacgcatagttttttcacaacacattttccatgaactttttgaagacccttcatatattataagaagaaagttaaaaatatcccctgcatctactactcagaaataaccactgttaacattaagtctgttctcaactctaggcattattgagggttttgaggacaggtcttgaaaatttctatggctaccttttactgggtggagactagcatgtatagttgaccgcataggttaatccctccactcaaaaagccacaattttaaagtgtagtattcactagcatttagtatattcacagtgttgtgaaatgaccaccaccatctagtttgaaaatatttcatcacaaccaaaagaaaacctcatatctattagcggtctctcctgtttccccagacaccggcaaccactaatgtactttttgtctctgtggacttgtcagttctggacattttatataaatggaatcatgtgaccttttatgattgacctctttcacttagtataatgttttagaggctcatccacattgtagcatgtgtcagtacttcatttccttgtgtattggtccattcttgtactgctataaagaaatagctgagactgagtaatttataaagaaaagaggtttaattggctcatggttctgcaggccgtacaggaagcatgatgatggcacctgctcagcttctggggaggcctcaggaaatttaaaatcatggcagaaggggaagtgcggcgtcttacatggtggagcaggagcaagagagagaagggggaggtgctccacacttttaaacaactagatctcaggacaagtcagtcactataatgagaacagcacccaggggaaaccgccctcacgatccagtcacctctcaccaggctccacctccagcactggggattccagttccaattcaacatgatacttgggtgggggcacatatccagaccatatctcctcgtatagctgaatagtattcccttatatggacataccacatttattattaatttattgattgattgacaggatcctgctctgttgtccaggctggagtgcagtggtttgagcatagctcactgcaggccttgaattcctgggctccagtgatcctcccacctcagcctcctgcgtacctgagattataggtgtgtgccaccacacctggctaattttttttattttttagcagagacagggtttttgctatgtttcccaggctggctttgaactcctgggctcaagcaatcctcctgccttggcttcccaaagttgtaggattacaagtgtgagtttagagaggtataatttcttactcaacttcaagtattttatttctcttatcatttgttgtttggtttgttaattatttggaagtatatttttaaatttccaagcttagtgtgtgtcagtttcataaaagttccccatgtatttaaaaattggatgtgtactctaattttgggattgctttttcattgtctatatatgcttgctaatttttgatctgctgggttactgagaaggatgtgggtttctccatctagttctatttttggttaatatgttaggcacagagctgttgtttttttgtggtgaattgaatcttcatcattctttagggactctgtccttaataatgctttttttgccttacattttgtttcattgtaagagagctatgtcagagtactttttaaaacactttttaatatggtatatatttttttcttttttaatgaggttttttaaccgtaagtttaagcaaaataaagcttaataactggattttatttagttttaaatttaatttgatttttttttttttgagactaagtctcactctgtcgcccaggctggggtgcagtggtgcgatctcagctcactgcagcctccgcctcccgggtttaagtgattctcctgccttagcctccctaggagctgggattacaggcgtgcgccaccacgcctggctaatttttgtatttttagtagaggcgggctttcaccatgttggccagtctggtctcgaactcctgacctcaggtgatccacctgcctcagcctcccaaagtgctgggattacaggcatgagccaacactcctggctaatttaattcgatttttttagtagcagttttagtctattatgtttgttgtagttactagtatctttggatttatttctacctaattatttggtgattcctcttcttcctggttccacttacacattaaaaaaaaaaacaaaaaaaacttagaatagagatggtgtctcactatgttgttcaggctgctctcaaactccagggctcaagttatcctcctgccttggcctcccaaagtgctgggattacaggtatgagccaccatacctggtcccccttgcccattctgttttacttttgtattgcttgggtttctaaaattccattttgtcctctccctttgctcttccccaatcctatctcatcacacacactggtttggaagatagccacttttttttttccaatgtgtttacttatcttatcagagtcaaaagcctatcagtatcttctcagatatcccaaaaaatactaggaccttaagacacctaaaatcaggttacatttcttcataattgtctagtattctagttctatcagttttacctctcagatctccattctgtaagtcaatgttaagtttagatttgtccatatgcatacgagtttctttggtattcaatacttcctgtatatttttaagaagttcctttgttggaggtctgttaggttttatttgtttgaaaatgtctgtatttcacccttgttcttgaaggatggtttttctaggtatacagttcttttttttttttctttgatacagttttgctcttgttgcccaggctggagtgcaatggtgcgatcttgactcactgcagcctccacctcccaggttcaagtgattctcctgcttcagcctctcgagtagctgggattacaggtgcccaccatcacacctggctaatttttggtatttttagtagacggggtttcaccatgctggccaggctggtcttgaactcctgacctcaggtgatctacctaccttggcctcccaaagtgctagggttacaggcgtgagccaccgtgcctgacaaaggcctaactttccttcctcattcttttcatcttgtttcttggtttcatcatcccattttttagtttcttttcagtctccttttgtgtagcctgaagcaataactgtgtttctgatgcctaggtaagtatactgtaggtaggctgatactgttcagctagtacatagtagaagtcagatgtcacatttttagaatactccagttctagataagaataccttgttgggtgatatattttattatcctggattgtttggcggatgtaatggattgctgaagacgcccagtttcctgtgtggcccttgagtatttattttagtaagttagaggctagttgttcacttttcccttgtttaactggggactcctcagcagccctttcaaaacagtataacctcatctgagaaaggaaaatgtaaggatattcattaagttttcttctctccagatttgggattatttttaggaattctcaagagttttgttgacttaccaactaggtttcttgaagatggtgagtgaggataggaacttggcctggtttggctcacctctcagattcattggaagaggcaagttcattagcacagtttcagtccaccattacagcatttttttcctgaattattataagtcttagtcaatatttccagataatcatcattatctgtttaaattactgcacagtattctattttactgatgtaccattgtgcaaatactatgatgttttattatttttaagttttgctataacagataagtctgcagagattttattcagctctgtattgttttgcttctgttgcattgtttcctcagattgaatttctaggagtagaattgctatgtcaaagagaataacaagtatctctgagccttgccgcatactgcttttttcatttttaaaggttataccaagttagagtctcactagaactgaatgagtgtactaattttactgtagctagtttctttttttttaaaaaaaaaaaaagctgtagaataatctcaaggttgcttaaatatttctgtcttttattcttacagcatttcctgtggattagttcactacttattttcttatctgtgagttgtaagtgcttacacatgcccacttgatgaccttgatgttttcttacacatggaagcaagtgctttttgtaaaagaatatattaacctttatctttttacattttgtgaagctttttttttaatgtttcatcttttaaaaattaggtttattcagaattttaaattttaatattatattgaatttcttttggttggtttaaattgagaaagttattttatgtatattctctttttttgctagctttctgtaatttgattttaattccttattccttgcatagtttgcttctggtatgttaaagtgtgctctctctaagtgggtagtaattaggaacaatttatctcaacctcatttattgaatgttttaaatcaagagaacggactctgttatattaagcttctatatataattgtctgtttcactgtaatgcctagtaaggatacacttcattctttttttagatgttctttcacaatttcatgtaaattttagttgttttgtttcaaaaaacaattcctattgaacaatctctaggaatagatagcttaataataatattagatctagttttctcttttcatagtttacctcttctttcttttctttcttttttttttttttttgagacggagtctcgctgtgtcgcccaggctggagtgcagtggtgcgatctctgctcacagcaagctccgcctcccaggttcgcgccattctcctgcctcagcctcccaactagctgggactacaggtgccccccaccactcctggctaatttttttttttttttttttttttttttttttgtatttttagtagagacagggtttcattgtgttagccaggatggtctcaatctcctgacctcgtgatccgcccacctcggcctcccaaagtggattacaggcgtgagccaccgcgcccagcctctgtctctcttttctttttctttttcttttcttttcttttcttttcttttcttttcttttcttttcttttcttttctttcctttcctttcctttcctttcctttcctttcctttccttttcttttctttcttttcttttcttctctcttctcttctcttctcttctcttctctgtctttttttgacgagtctcagtatgtcacctaggctggagtacagttgcacaatgttggctcattgcaacctctgcctcccttgttcaagtgattgtcctgcctcagcctgccaaatagctgggactacaggtgcgcactgctacgcccggctaattttgtatttttagtagagatggggtttcaccatgttggccaagccggtctcaaactcctgacctcaagagatccacctgcctcggcctcccaaagtgctgggattacaagtatgagccacgatgccagtccaattcttgtgtagttttttaatcagctgaatttaacattcaaattcttcttttaaatcttccaataggcagttatctttataaagatcctatataatcaagactttgtttctgaatattttatgtatgtttttgctactgtaaatgagatctatttctcattgtggtttcttgctgttattactggtaagaatttagtgaaacaaagtacttaagagtatgtctttaaattgtgagattttgatgaacttttaagaaataaaattctttagtttcttagagctttttgagatttctaaggtagatccttggtttgggcaacatataactattacaagttttgcacattgaacgttatttggtaatttttagagaggacattttaaatgtttaggaaaaatataaataaaatgtagaatactattgggggcatatacatcatcagcactgtaactgtttcatatgaatcatttttgtacatatagaactctaaagtcctaatgaacagaattttacatttctataaatagaaagtccttaatagttgtgactgaataacttatggatagcaaattatttaactgaaaacagtaaaatttaagtgggaggaaatatttgctttataatttctgtctttacccattatttataggattttgtcactttgttctgtttgcaggtggaaaaccatgaattccttgtaaaaccttcatttgatcctaatctcagtgaattaagagaaataatgaatgacttggaaaagaagatgcagtcaacattaataagtgcagccagagatcttggtaagaatgggtcattggaggttggaataattcttttgtctatacactgtatagacaaaatattgatgccagaattattttataagttccctgtccccaagatgatgacttcacatctctgtcaaacagaaatcgcccaacaggcccttgtatgatgtcatttaaacaagccctattttaaatgtcacctccactggtaacaggatactcctaggaggatcaccaagcccaattcttctaggagtagtgcattgattaggctttggggtttccaagcagttcattaatgtcacttttggaaaaagtctgtctttcataccagcttattaattccctatgggttcacacggttttttttcctggattttcatcaaacatgtgtaaggtactcagtacaaagaagtttagaaatccagaacaaagcagtgtatttaagtagtagtaaacttccagataatctgatgcccatatctacatatataaaaaatttgcaaatagttctgtagagagtccaaacatggagtagatccctaattaagagcctttgcattaaagtccaccttcctcatttcatagctaaggatattgaggctcagagagtttatgtgtctggagttaaagttattttgtgtttccttaatttttgacttactagaaagttaaagtacctacagatttctgtgtttcactatatgttaacttgcttggctggaagtttttctgctgataattggttttatgaaggaagaatcctgttaagaatgcatcattggactgggtgtggtggctcacgcctgtagtgatcctagcagtttgagagaccgaggtgggcagattgcttgagtccaggagtttgacactaacctgggcaacatgatgaaaccctgtctctacaacaaatacaaaaattggccatacatggtggcacgcacctgtggtcccagctactcaggaggctgaggtgagaggatcacttgagccagggaggttgaggctataatgagccataattgcactactgcactccagcctgggtgacagggtgagatcctgtctcaaaataagaaaagagaatgcatcattggccaggcacagtgactcatgcctataatcccaatactttaggaggatcacttcagcccaggagttcaagactagcctgtgccacatagaccacatttctaccaaaaatcaaaaggaaaaaacttgctgggtgtggtgatgcacacctgtggtcccagctactcgggaggctgaggtgagaggattgctttagcttaggtggttgaggctgcagtgagccatgatagcaccactgcattccatccagcctgagggacggagtgagagcgacaccttgtctttaaaaaaaaaaacagaggaatgcatcatagtatatattaaattattgcctatttttttatctattttattgagtgctaataagaaaattaatggcaaaaacttgttttttacagtataaattaagtttaatttcattttaaaattaagtaaatttgttttattaaaaagtatgttgaaagcaacataaatagcactcaaattgagacagaaactgtaactgtagtataagaagcattaggctgggaattgggaaacacgagttctagttgcagcttggaaactttttctgaagctctttacaaattacttaatttctctggttttcaccacattgttctatagcattaacatgttggattcattgctttaattcttagacctacgtgtcatcagaaatgccattacactttgaggatttgagccttattttaaataaagttgtgatcctcatggcagcctaggtttacatgtgttaaataaacagtattctgtaaataccattgtctttcatgtttagtgatgttgctgttgttaacactgcagtgaaatgcatatataagcaaactacattacatactcatgaacatggtcctttgttttgaaactttgatcactgattgttcgcagtctttcattgtggaactactctttcactttgaatgttttgagaggttcctttgttcagatcagtccgatttcgtttctgggtgggtctctactttcccttttctcactggtcaagcgaggtctgtctaattgtttgctactactaacatttgatggccacgcttcagcaagtacatttgtagattctctctctctgtctctcttaatttgtggtctagagatcatattggttaatgaaattatgaagagggaatgtatttataaaaactcaaattcttgatgcagaaggtctagctgattgtgaacccaaaatatccgagacaggtcacaaccaatttagaaactttattttgccaaggttaaggatgcatccatgacatagtctcacaaggttctaatgacacatgcgcaaggtggttagggtacagcttggttttatacattttagggagacatgagacatcagtcaacatgtgtaagatgtacattgattctatccagaaaggcaggacaacttgaagcaaggggctttcaggtaataagtagataagagacaaaaggttgcatacttttgagtccttgatcagcctttcactgaataaacaagcttagtcttgttagtgaatctgcgtttttacataaacagtaggtcagaggaagcaatcagaaatgcatttgtgtcaggtgagccgagggatgactttctgtccctcacctgtgaagataagctatcagtttccattgctagggtgaaattcaacagaattgtttgagagtgaacatctggaggcccacaaggactttccttgtggaggggaagtatgtagtgagggaagtatgtagtttttaaatctttgtcgctatcttatttagaaataagatggaaggcaggtttgtctgacatagttcccagcttgacttttccctcggcttagtgattttgcggttccgagatttattttcctttcacatatcagtcagatcatttggtttgtgaagtttcctatgcttaacagaaaatatgtgcactagttttcctagagtttcattgtcagagtctcaagtttttgtttggaaattgtatttggtcacattaattatactctatgttagttccaaagaaatacctttggttaagaaaagaattctcatgcataactcctcgagggtggggttacaccttaatccatcctcaggtgctcatggtaattggggcaaatatgttgcccagtgctggtgctctgcagccttggatgggtttacccagaaagcagctttcaagtcagaaactaacattcataagggagttaaggattttataaatagatatccataattcatgtagttttcaagtaagtagtatttgaatcttttctggttagataataattgtgagtatgttgtcatataataacagtatgtttttcactatttaaataattttagaattacattgaaaaatggtagtaggtatttatggaatactttttcttttcttcttgattatcaaggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacaggtttgcaagtcgttattatatttttaaccctttattaattccctaaatgctctaacatgatgtgaatgttctatgataagttttactaatgtagtcatcaggtaagagtcaagctttcttccatagagcagtcagctgtcgcaacaccatttgttaaatagtccgtctgttctccattgactgaagtggtactttgggtctattttaaagactctacttttacctcgtctcaccattcttttgtctacacaaaatatattttatcgcttattctgtgttaccatatctattagagctagttccccctcatatctctgctttagttattttcacatgtttcttttatcttttttttttttggagatggagtctcgctctgttgcccaggctggagtgcagtggcatgatctcggctcactgcaagctccgccttccgggttcacgccattctcctgcctcagcctcccgagtagctgggactacaggcgcccgccactgcgcccagctaattttttgtatttttagtagagacggggtttcaccgtggtctcgatctcctgacctcgtgatccgcctgcctctgcctcccaaagtactgggattacaggtgtgagccaccgcgcccagccttatcttttttttttttccccctgagacagagtcttgctgtgtcgcccaggctggagtgcagtgacgcgcagtcttgactcactgcagcctccacctcccggattcaagcgattctcatgcttcagcttcctgagtagctaggattataggcatgcaccaccacgcctagttcatttttgtatttttagtagagatgggttttcaccatgttggacaggctggtctcggactcctggcctcaagtgatccacctgcctcagcttcccaaagtgctgagattacaggtgtgagccaccgtgcctgacccacatgtttattttttctaagaaaactttactatcatttatcaagttaagaaaattattctgatatttcaattgggtgtttaaattagttgagggaaatatgaggccattcactagatgataggttttttttgttttaatcatgtttcatgttgaaacaaaaaagttttttcctgccagttttctggctaatctcaggaagtccctgaaacaaattattgataagtaaaaaaaattatttaaaaaattttaaattatatttaaaatcttctgtgacttatggtggggggaggctaaagcctttctccttctgtactgttctggaaactatggcctgttctactccctcccctcctgaattttcccagaactttacaggtagcttttatatatatgatcccctgtcgtctgtttaacaagtactttgagtgtctattatatgcagacattctaggtgttcagacaccctagtaattagtttgttcctcataattctcagtaaagaagacatgtatatttctcattttataggtgaagaagctaagactttacttttcctcagttagacagctagtgctggtgggtgcctaaacttagatcttccattgccaaatctaggtgtgttgtttttccagcacactagaatcctcctggttcaagaaatgtatatattttagcttggataagatacaacttttggagtgttctaatcatcttcaagtttttcgtggattagttataacatatgaaaaaagatagggctgaatgggccacatgatgccaaaagtgaaaaagtcactcactagattatgacctgcagaatctggtccttgcctgcctctgcttttatattttgcagcttgtcccttcacacagtggtctcacttttataatgtctttccctcatgcatttctttaattctttttatttgcctgttccatagtagtctgtttgtgctgctacttgcccctgtactgttcttgagctatacatatacatgtctgctgtgccattgagtgattccatcaaggccacaattatcatcttgatgaactgattttctcccactgctgataattacttctctctcctttctttctcctttacatcacctctttttgttcttaatttcattccctccttgatgccagtgagtatttttttcttattttattctcatcttccttgagtattgtttatttcaacctctttttttttttttttttttggagaagggtttggctttgtcgctcaggctggagtgcagtggcacaattttggcccactgcaacctccacctcctgggctcaagccatcccacctcagccacccaagtagctgggactacaggtgttgcccactgctttgtatttttaatagacacaggatttccccatgttgctcaggctggtctcgaactcctgggctcaagcagtccacctgccttgccctcccaaagttctgggattacaggattacagatgctgtgcccggcccaacctctaattttaattttctcttcaaattgttcaataagatttagtttcaagacattttcctggccgggcatggtggcttacgcctataatttcaacactttgggaggccgaggcaggtggatcacttgaggtcaagagttcaagaccagcctggccagcgtggtgaaaccccatctctactaaaaaatacaaaaattagccgggtgtggtggtacatgcctgtaatcgtagctattgtggaggccgaggcatgagaatcgcttgagcccgggaagcagaggttgcagtgagttgagatgacaccactgaaatccagcccgggcaacagagtcagactacgtctcaaaaaaaacaaaacaagctgggcgccgtggctcacgcctgtaatcccagcactttgggaggccgaggccggtggatcacgaggtcaggagatcgagaccatcctggctaacacggtggtgaaaccctacctctagtaaaaatataaaacattagccgggcgtagtggttggtgcctgtagtcccagctactcaggaggctgaggcaggagaatggtgtgaagccgggaggcagaggttgcagtgagcctagatcgcgccactgcactttagcctgggtgacagaacaagactccgtctcaaaaaaaaaaccatttttcttattttgaaaacttttggtattgaaagatatttatactacagtaatgagaaatactgtgtgtgtgtatatatgtttgtgtttttttttttgtttttttctttctctctctctcttttttttttttttgacagagttttgctcctgttgtccaggctggagtgcagtggtgctatctcgactcaccacaacctctgcctcccgggttcaagtgattctcctccctcagcctcccgaatagctgggattacaggaatgtgccaccacacctaactttgtatttttagtagagacgggttttccccatgttggtcaggctggtcttgaactcctgacctcaggtgatccacctgcctcggcctcccaaagtgctgggattacaggcaccctgcctgtgtttgtgttttaaaaggggtaatagcttcagtcttttttttctttctctgagacggagttttagttttgttgcccaggctggaatgcaatggtgtgttcttggctcaccacaacctccatttcctgggttcaagcgattctcctgcctcagcctcctgagaagctgggattacaagcacgcgccaccatgctgggctaatttttgtatttttagtagagacggggtttctccatgttggtcaggctggtctcgaactcctgacctcaggcaatccaccgacctcaggtgatccacccgcctcagcctcccaaagttctggggttacaggcgtgagccaccacgcccggctgtcttcaatcttaaataaggattccatttaaatattttgtaaaaggacacagatcacagttttactcaggggaatataattgttatagcaggaattgtgccattgcgctattccaaacagtgtaaaagaacattaataaattgaattctaactacatttgtccctaaggagttgttcgttttccacttgtatttccattttaattatcattatttggatgtttcataggatactttggatatgtttcacgtagtacacattgcttctagtacacattttaatatttttaataaaactgttatttcgatttgcagcaaattgacttctttaaatgaagagtataccaaaaataaaacagaatatgaagaagcccaggatgccattgttaaagaaattgtcaatatttcttcaggtaaacttaatagaactaataatgttctgaatgtcacctggcttttggtaacagaagaaaaatcatgatatttgaagtgtgttttgttattttcgcaagccattacattctgactatttaatatgttaggtttcctatataaaataaggcatggtatgttacagtaggacacataactggaagttactcttgcacatagaaacaaaaaatggcagaaaagcacaaaacttactatagttgtaacagggaaaggaaacactagggcctacaacgtactaatgtcttgggtcatctatgggctcatgaggctctaggttatggaagtaaataccactgaaaagcaaatattaattacacatgaggcaagcctttttgagttctgtatgtcattttgtagattttgagttcattctagtggcaccatttgagatcattttcatgtaattaaaggaacacagcaacctggcactgtgttattgcccttagaatggaatgaatatatgtttagcacaaggtaggaagtgatgcgttaagttggaaggctttgccgatcatggtgtgtatgttgactaacctttattgtgcctttaaaaaatatactcaagaactaccttaaccaagtaattaaagtcaagattaccagttgtgggacaaatgacatgtacttcctggtgtgatatagaaggaaggacacagtatcacctatatagtattcttgaccagaatatttaacctgattttaaacaagaagtaaaaattcaaataaatttagattgtggtgcattcaaggcctgaactttaataaatgtccatgtcacggcagcaaaaaagaaatcaacaggtcttaaagagacagggcaaccaaacgcagtaggcagtagttgattagatcccaatttagaggttggagttggggaatagctatagaggacactattggggcgaattgagaaagtttaatatgagacaatatggtgttagtgtcagatttcttgtgtgaaatggtagtgttatgattaggagaatgtccttgttctcaggatatgcatgctaaattatttaaggacaaatatttttttaaaaggttatgtgcatgagtaattctataaattgtgttgctattatgaattgtcatggtaaatcaaaaggaaacataaaactcaaaaggttttattttaatacactttatgtattgaaatgaatggaattgatttgtaaagattacatttttgcttgttggtgtcagataactgtgacgtaataatcttttgctgaattatgtttcttaggctagatttcattttaaagaaccctgtaaataccatttatttgaactgtggatcttccttaaaaaataatatttattaagcacctagcagggtaaagtttttagattttaacatttaaattgaaggttttatattagaagtcaacctgaatttaaatgaaacttcttcttggtctgatattacatattatgagctatttttatttaaaaatgtaatggcggccagacatggtgattcacacctgtaatcccagcactttgggaggctgagctgggaggattgcttaagcccagaagtttgagaccagcctagccaacatagggggaccccaactctacaaaaaaatccaaaaaatattagccggctgtggtggtacatgcctgtagtcccagctactcaggaggctgaggcaggagaatcacttgaacccaggaggtcgagggtgtggtgagccataattatgctactgtacttcagcctgggcgacagagcaagactcccatctcaaaaagtgtaatggatcactttaataattttctatcatacaattaagtcataaaaggtcatgctattaagagccagttatgtgacatgccaagtatagactcttaattaagatgctttggtttgctttttatttatttatttatttttcagatggggtcttaccatgttgcccaggctttagtgcagtgatgcgatcatgactcactgcagcctcaacctcctaggttcaagggattctccccacttagcctcccaagtagcttgggactactacatgtagtagtgccaccacacctggttaatttttttttaattatcttttgtggagatgaagtctcactctgttgcccaggccagactcaagcagtcttcctgccttggcctccgaaagtgttgggattacaggcgtgagccaccctgcccagcctagttttcttttttttactataaacttattcttgtcagtatgctagcaattttacaagttttaaagtagttatagcaagtacttcactcatgtttaattcttaaaggcttctattgctatataatagggtagtctgaattcttcaaaagtgtactgaggccaggtgcagtagctcacacctataatcccagcattttgggaggccgaggcgggtggatcacctgaggtcaggagttcgaaactggcctaaccaacatgttgaaaccctgtctttactaaaagtacaaaaattagctgggtatggtggcaggtgcctgtaatcccagctactcaggaggctgaggcaggagaatcgcttgaacccaggaggcggaggttgcagtgagccaagatcacaccattgcactccagcctgggcgacagagcaagactctgtctccaaaaaaaaaaaaaaaaaaaaaaaaaaaaagtatactgaaacagaggaagataattaggtctgcttggccattgttaagttgatttttattttcaaaacatttgatcactgttgtggggaacaagggaataaaaaataagttaaatttccagcccctagattaaactaataatttttggttttcctagaattaaatgcttttatcttgaatgttctgtgaagcttttgacatgattgatagctgtatgatagtctgaatgacatgtgggtcatgcaccagcccctccaacctgttaacatttagaatctattcagaaaaatttaagcattgttaatttcctttgttttttgtctagcatgtgtcagatttttttaaatgtatttattaatagcttttaatgttaatactctagaacagtagaatcttgaaaatgttttaagtgacaattagagatttaaatttatgctgacatcctctgcatgtgatactgatgaggaaagaaagccaaactgtcttacggtcagttcgtacaatataccaggccttgatggtcacatttcaacttgctacctttttgcttacatttttcttatggtgattttgaggtgtcattctggtttctcagatacttaaaatataggaaaaggtgtgtcttaaaattgagagaatgtcttggataagcagctgtgtagttttatattttgctgataagggaaggtactctatttttgttttttgtgtgtttttgtttgtttgtttttgagacagaattgcccaggctggagtgctgtggcgcaatctcagcttactgcaacttccaccttctgggttcatgcaattctggtgcctcagcctcccaagtatctgggtttacagacatgcaccaccatacctggctaatttttgtatttttggtagagatggggtttcgccgtgttaccaggctggtcttgaattcctggccccatgtgatcccccggcctcatgcgatctgcccgcctcagcctccctaagtgctgggattataggcgtgagccacccaacccagccagtactctgtttttgatagctattcacaatgggaaaggatgtagcaacacattttaaccctatgttgagttttaggtgggttcctttgaaattttgttaaggctaacttttgttaatttttttaaaaaagtgtaaattaggaaatgggttttgaattcccaaatggggggattaaatgtatttttacggcttatatctgtttattattcagtattcctgtgtacattttctgtttttatttttatacaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggtaaaaaacctggtttttgggctttgtgggggtaacgttttgtttttttttttttttttttaatcttggagtagaaatatatttaaaattgatggagaaaattcccagttcttaacattagaaagggaatatattattcttaccagttagtaatctattcacatttggtttagagggaagatttagaaggtgagataaaagcttgtgagagaatagtgtattcatgtgaaacttcttccatgggttcagagcatttagaaacaaacatcccttcacactcaaagcttacctttgagccagtcctccaatagtgaggtctttgaaggtcaggccaaattggctgtgggaggacctcaggttaggataggaattattttaagacatggcactatattcatgtgaaactcgcaaaaactagccttgcatataggctcatgtatcatgtctcagctgagatgtttgagagatcttaactagattctagaaaacaaaaaaggaagtagttttggggcaaatatatttgggaaacagtttattgtatttcctttccccaaatggattttcaagttcttcatataatctaaccccaacaaataaattgcctgtttttcaaaagaaagatcatgtcttcaggtttttgtgtggggtttaaatgattcgaaagatttgaccatactgatacattcactagtaaccttagttactaatgagtaatggttttgagttaatcagttaggcctgaactacttttctggaagttagtaaattatctcacaggcagccctgtgagccatgggaaaatgtgtatatggtctttctaggccacagtcaaattacaggtatatttgtcatggcttctcttgatgaaaggcccagtatcggtttgtctgaagatatataatagcattgcttttgggggtaatatgggcagtaactctgtccacatctttgggcaggctgtggttctgcctttatatgctatgtcagtgtaaacctacgcgattaatcatcagtgtacagtttaggactaacaatccatttattagtagcagaaagaagtttaaaatcttgctttctgatataatttgttttgtaggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtaagtgcatctcctagtcccttgaagatagaaatgtatgtctctgtcctgtgagaaggaaaagtatatttgcagattctcatgtaaaaacatctgagaatgtttgtcttagtttaatagttgttttcctgtggactttatatactttgtattgtcttaaaagagtgattgatggtagctacggaaaactttgatttttaaaattgtctctttaagtagacaatttataagctactggtacgagttcaccttataaatctccactaccatgtttttgcttggactgttcacacttcctggaatggtccttcttgccgtttatccaacttctttctaatttttaagtccctaatgatgggaattctatttctgtagtgatttttctggtcatacgaccgtaaggtcatgggtgtttttctctgaattcctcttgagatgcctgtaacttgaaccacgtttttattctagacattactgaaatgttttgtctttatttcactttttaggagcttccttgaaggtagggactataccttctatttcttggtatctttttctttctttttttaaaagttttttagagagacagggtctcactcttttgcccagactggtctcgaactcctgggctcaggtgatcttcctgccttggcttcccagagtgctgggattacaggcatgaaccaccgtgatcctccttatttcttagtatcttctaaagaacattaaatatagtaggtgcctagtaaattatgtattgatttaacttctttgaggttctgttgtttgtgaagaattataaaagcaatacaaatgtttgtatagtaattaagcaacaggttaatattcatgacttaaaagattaaagaaataagcaaaacatgttagctggcaactcacagaaaaagaattaaattgccaatgagcacacgagcacatgaaaaattagcaaaagtttcacccctttacatatatttggttaaaattgagaaaagaatagtaatagatggtattggtaggactgtggcaggcacacaatttacatgaccaccaaaagtgtatgcaggtatccatgtcaccacaccctggtctcatcttcattcagttttatttattttttttaatctcggcctatttgattggcacgaaatgaatgatagctgccttatttggaattcctttgattactactagtgtgcttgataatgtaaaacaatattcaaaatctgtttttcctttcatccgttgtttgttcatgttcatgacctttttttttttttcctattctcctccctccctccctccctccctcccttccttccttccctccttccctccttccctccctccctcccacacaaaggtgtgtgctaccatacctggctagtttttaatttttttttttttttttttttttagaggcaaggtctcactatgttgctcaggctggtctgggctcaagtgatcctcccacctccgccttccaaagtgctgggattacagacgtgagccatcatgcctggcccttgcccatttttctattgaagttttagtgctttttattgactttgtttatatattaagataatccattatgtttgtggcatatccttcccaatgtattgtcttaattttgtttttgtatgtgtatgttaccacattttatgtgatgggaaatttcatgtaattatgtgcttcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtatgtactattggagtactctaaattcagaacttggtaatgggaaacttactacccttgaaatcatcagtaattgccttattctaagttagtataaattattgatgttgttatagaacccatttaccccttaattcacagtctgggggtaggaacatgtacatcatatttctgtatctcatagtaggaccactcattctaaagcattcacagaaagaattatctgtactctttttgggacagaatctcgttctgttgcccaggctggagtgcgatctcggctcactgcaacctccgcctcccgggttcaagcgattctcctgcctcagcttcccgagtagctgggattacaggcgcctgccaccacacctggctaatttttatatttttagtagagacggggtttcaccatgctggccaggctggtctcgaattcctgacctcaggcaatccacccgtctcggcctcccaaagtgctgggattacaggtgtgagccaccacgcccggccagaattatctgtactcttgaacatcaccatggaggcattttctgctacctcccatggcagtatgttttcttgttgaattaggataacaaacaatatgctttcaagttccaaagttctagctgttattgtttaacaaaatcttcattataattagcttattttgtgtttaagagtgtgttatagaaacaggttcatttaaagctgggggttccagaaatcttgaaatagtagttatcacatgcagagtgacttatctgttgttgtttcatcctttcaggaaagtttgtcattcgtgggcttgggatctagtcagatccctgtattgatgagattcacatgttataaggctttcaaaggttttaaaaatcatactataaggattgatttcactagtcaccagaataactttttcagatagcgctctgattttccacgaacacgtttttctgcatcagttggttgcacatgagtgagataatcttggttctttatcctttgttatttgtacttcattgggaatccttttgagttagtatatttgagtcattattattattgctgtagaattcaggaacttttagtagatctggcagcataaaattttgcttttaaatcattgtttgtgttttgtatgctatagaaatgggttcagaatattttttaaaaggccagatgaagtgtgaagatagaaaaacttcatccttcactgtgaatgtttaacaaacatttgcttctactttatttttgtttgcttcctttagttgtgcaaagtattcagttctagaatgcatgagatatatgacaaagccaaaaaattctttatagttgataaataattgtggcaaaaacagctgtatagtaactttgcaagcatcatttgattaaatgcttaaaaagtcttgactcagttttaactatttcctgcaaataatcaatatttaattaaagctactccaaattagtgacactttacgtgtctgtctttctccctccccttctcccttctcccttcccccttctcccattctcccattctcccttctctcttcttcctttcctcttcccttcccttcccctttcccttcccccttccctcttctcttcccctcccccttcccatcccccatcccttcccttcccccatccctttcctttccccttcccttccctcctcttcctccttcccttcccccttcctccttcccttcccccttcctccttccctttcctcttccctttccccttcccttcccccttcccttccctcttcccttccccttcccctttcccctccccctctcctcccctcccttaccttcccatgaaatgagaaagcctcagagatagtggcttgattaatttttctttagattaagatatttgtctaagcctttaaggtttatctattgagcttttttgtctcctatttttatttttcctactatgtttgtcgaggataaaatacagcactgtgtgccaagtcataatcacttttcatttgagacttaattaaaatgcctttattttaatgatatatttggctaatgtatttgaagtaatccgaaattaagttttctaatgacaaggtgagaaggataaattccatttacataaattgctgtctcttctcatgctgtcccctcacgcttccccaaatttcttataggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagaggtttgtcagtttgttttcatagtttaacttagcttctctattattacataaacaggacactaagatgaaggttttttgttgttgtttgttttcctctgtgtttctagtgcttattttttaatcagtttttttgatggcaaagaatctatctctgtgttattttgatttctgcagtatatacatctgcatgatcaatattcgatttcaagtaccaaagtaggagtaaaggaatattaacctaggtttaaaattagtcatttcactaaaattagttattatggacgatagatgtctaggtatatctttgttcataaacgaatatatcaagttcagttattaaattacacattaggtaagaaaaggacaaagaaataaaaaagcatgattcataattcctgccctctatttgtctagaatttagttgggaagataagaataacgaacgtgacacagagaataaagtggcatatgacaaatatttattcaagaaagctatatgtggacgggatgtttcagttctcatgggagaagtggattttatggtgcctttgagtaatgggtcatatttgggcgttcacacagaaagacccaagcatatgcctaattttttattattattattttttatttatttatttattttttagacggagtctcgctctgtcgcccaggctggagagcaggggcgcgcgatctcggctcactgcaaactctgcctcctgggttcacaccattctcctgcctcaggctcccgagcagctgggactacaggcgcctgccaccacgcccggctaaattttttgtattttttagtagagatggggtttcaccgtgttagccaggatggtctcgatctcctgacctcatgatctgcctgccttggcctcccaaagtgccgggattacaggagtgggccactgtgcccggcccttttttttttttttttttttaaattagaggattactagttctcttcaattataaaaataaaagaatcttatttcactgcctggtcctggaaacatgtactgcaatatacattgtgacaactttttacctgtcatgtttttagcttttacctgtgaatgtcttatcattgttcttatctgaaggatagatagttgctacaataataatagatggtgtgtatggtttttgagcctaaaaagtgtagttttatctgttgtacctatacaagcaggagaaatataacttgttaataattttaggtatggcaggctgccatcctaaatatgaagtggtctttgtatttgcactttaatgtgttgaaatcatagctttcagtgatccaggattaggcagactcttttatgcaatctcttgtttccagttagaatagaagtcgtgtacttttgataacattaattataatatattttgagccctgtgaggttggtaacattattcccattttatgaatgaggaatgtgtgttaaggagtttgcccaagagtcacatagcaagtcatagtcatgctctctgaagcagcaataacttggcaataaaataaaaatgaagcatcttctgtatgtgttaacttttcagtgactgtttatgccttccagtattctttgtaaaccttgaattctttttttcacagatgattaaagtttatcaattgtaaaggtggaggaatttgggaactagacagtgcacacataaataataaatatgttcttcaaatattgggtgggctaatgtgggaggagtttgagaccagcctgggcaacatagtgagaccctcgtctctaaaaatatgaaaaataaaaaaaaaattttttaaatgtgtgatatgtttagatggaaatgaaacaatttgtcactgtctaacatgacttttagaaaagatattttaattactaatgggacattcacatgtgtttcagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaaccctttttccatagtgttaactgtcagtgcccatgggctatcaacttaataagatatttagtaatattttactttgaggacattttcaaagatttttattttgaaaaatgagagctgtaactgaggactgtttgcaattgacataggcaataataagtgatgtgctgaattttataaataaaatcatgtagtttgtgg

SEQ ID NO: 37234 - DNA, 20928 bp, Homo sapiens
gggattgggagggcttcttgcaggctgctgggctggggctaagggctgctcagtttccttcagcggggcactgggaagcgccatggcactgcagggcatctcggtcgtggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgagcccgggccccgcgggctgctctcgggaagttcccgcggaggggaggggcctggccgttcgatcgaggctgcacccgccacacctttgccctgttgccgcaagaacccttgtcggccccagccttccagatttttgcctcctagggtattgttagtgatcattcttcccaaactggattgtccaaaacttgggttctgagatactgctgttgcccggtttctccttttgcctctctgactccttcccaaattcctccttttttttctaagaaacgttccgtatttgcctttcttaattaattgagggtcttgaaccctgtgagaatctaatgaaagccataggattcccttcctggaaaactgcatataggcggtcattcggctaccgttttggagtgctgtaccctcaagccatccacgggcccaggctaacgctcctccctgcctgaaatgctggcgttctaagtctcagcatctgctccctgaagcccagttacccattcccatcattttcacctttttgtagacttccccctttcagagcggcagacgctggcatacacaggtcctgggcatcgccgtcaaggctgcccgccaggcagcttccacaaatcccaaaatgagcctttccttcttccttctaaaacagcatctccaccttctgtattatttatttcagtgaatgcctgaatctcaaacttgtacttcatcatggactccagtcttcctttcacatccaatttcaatgatcatcaatacagtcattttgctccttagcccactcggactatttctctccatacctgctgcaactgccttgacactggtgtgacagccttttaaaaactggtgtttggggctggtatcactccagtggattctcagacagctgccagaataactttgttcaagtagaaatccaaagcattgcctggtctatagtgggaaatcggtaaatggtgaatgaatgaatgcctacggcacagccggcttatttaaatgcgttaactcatttaaccctcacagctgtatttgaggcttgtaacaataatgatttaataattaagattatgtaataatttaagaatgctccatttaagatgagggaggcttgtccaaggtcttgtaattaggaggaaggtcggctgggaatacggatatagcctccgggtgaggagttgtgactggtgtttaggtagatgactagaggttttctgtgatttattttagccttaggaaggtaaagatagtgagtttattatgtaattttgattacttttaatcccaggaaatttcaggtgctggttacctggggtttgtgctataaatactatacttgttgatagcttaaaaactctcaggtgctattgtcactaaccactctttctacagatgggtgctaaactttttcgtgaaggtactgatgctaggcactttagcgcctgtggaaacatcaggtgtaaattctgcaggaggagctcatgagctgatagggaagataagtgtatgcatgtacaagcaagtgcagctaaggtgggatgtggtaaacactgatgcggtatagaaaaagagaaaagggatttactaaagggatgagaccctgctctggggattgaataaataggcttggataaacctagagggaaacagagatgtactgggagaaattacatcctgggaagaagccacacattccagaaatggtggcttcactctttgagtccttaactgctgtaaacatgccattagcctacagcaaatgttattaatattacttgcaatggtgctattttatgtttgtctcagagaagggattatctccatcctcaattcatactctcttaagaagatcgttacttttctcttaaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtatgttgaaaaaaaatttagtctacacttttaatttattccatcaagatctacaggtatgttgattaacaataatttgtaaaggtaaaaatttaaacatttatcagaatcaatcaagagagcatgggtgttcaaaatggatcggtttgagtcttgaaacaatcattctcaaccttccctcaccccatcccttaacaggttggaaggttaatacatgcccactactatcatttatttactacatttgttgagtcaattctcagacaaacccctgctaggaattaagaggcttactgggtactacggatggttgctctgtggtttgaaaatgttgacatagttagattctgacagctacttctcccccggaccccgaaatctccacccaccatattgagaatcattgcctgagtcattgtttcagacttctatgagcactaaaaaaagcccatggttttcaggtcctaatatcactttattagagtttttgcctgtgacgacatgtgagataggcctgattccagaattctaagaaccatgtgttgttgactataggacatttcagattttctgtgagtacacatttaaaagttgaggaaagaagtgggtatagaattgtctcttcacatctacttaaaaattaaattccttttttttcttgtctgcaagtattttcttacatttctttatgctaagaatgaaagtgcatttactgttttaaaaccacaaaataaataatcattttcttttccaaaagtaagtgagtaaaaacttagcaatatttgaaaatgttggttggaataggttttagagaggaaaacaacaaaacaaggatcctgtcttgagggaaagcctgtttatgagtttactgactaagctcagatttggaaaagtgatgtatactagctttcacttagattatctgctggagagattgattattcctctaagatgctcacatatttattttaagaagagattaaatttaaaagagacattaaatttgtttttaatgatgtaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtaagtattaattggggtagatgcctgccacttgtccctaagtttaagatatagctgcttaaaatcctttttttgaagaagaagacaagagataaatgacatttgaagtttcaagccaggttaccaaggatatccttttctttttaaaatagacttatgtcttttatatatctgttagaatgtcatattttgatcatctgtccttggagtcagttctctgaactttctgtgactcatgtgattcctacgttgttttaggttggtgcaaaagtaattgcaggttttgccaaatatttgccaacctaaatatttcaacaattttccccaagtatctcttgtgcttagtatatcattttcaagcagtcgtcattcaaaaaaagttcaagaagtctccctcagctggtagagaaaattcttaggaatgctaaggtcaaatggacctccctgtctaaaccttcctgctgcgttttataggggatgctctgatatcataacacttctgtttgttcactgtcatccactgagtgcttgcctcatgttctgctgagcacattccctgtgtgatttcttcttattctcaaaactgcatttggaataccttgttgttttaaagaggagggaacggaagcattgccatttgctcaagatctcacagctagtgggtaagagagcccactccagcaccaccactgcgtgtttgcattttcacagacatttggaggtgggatggagaatggatctgaggagacaagactggaggtacagagaccaatgactgggttattgctgaagagatcagggcaagtactaaagcagttaatggtagagttggtttgcattgaagggacatttgaggtataaaattgctgggaattgataatggactgacagggagcgaagagggagaagttgaggctggctcccaggtttctggcttagatgacctgctagtgtcttgagggaagactgctgaacacagtggtcagagcatagagtggcagctgactacctccgtcccagctctgccatttactagctctgtgatcttgggcaagttacttaacctctctgtgctgtagtttcctttgtaaaatggagataataatgacatccacctcatagcattgttagttgctatgagaattcaatgagttcatccattgttcagtgtgggaacagtgcctggcgtacagtgggccctctgtaaaagtttgtcattgtggttatttttactagaagaaaaggaactcagttttggtcttttcagttttaaagtgcctttcagatatccaggtgggatacttgaggttagggactagaaacagatttcggagttatttgggagccatatgagactatgtgatccactaggaaaggggatagaacaccggcatttaaggaatgcgtgggcagaaaagagaagcaagggctgaggacagctaaggagagaagcagaatggagtgttgtcatggaaaccaaagaaaggagtggtcagagggtcaaatgttggtggatacctcaagagtttagagactgagagtgtcaactggattgggtcctggctgatcttcacaaaatccattttctaccagaaaccccctcatctccaaagcttcagcctgcgcttccttctcctgttcatggtgaatcatgaccagccctgtactgagtgtgtgcctgtgggacactgtcatcagggcacatctcacactttccagtgtgccctctctgaagtgtgtaccagcagcaggggagtgtggtttatcttttgtgggccagctcttggcgtactcatggcatagtcgctgcatgagatagcagcaccggatttataccagtacccgccaaactcaagaccggtaccttccacagggcttctgtgatccacacagttccctgagggagacgtgctactatcattggcattgaagacttgaaggcttggcgaggttaactgccttcctctaaagcagatgacgggaaagggtccgaagcactgccccaggcagttggaccctaaagccactgctttcaacaacttcccctgctgccccaagagcatggtccctggggtccaaaaggaatgaactaagagcaaacatggagtcttgggagtgttaaggagaatttgagcctagatacttctctagtaataatttgaataatttactgaagagatgcaattgattatcatcaaatataaataaaaggtgattgctgctttcagcagaatgtagctaatcagaattatataatgattagaagatagtaaggttggctgggcatggtggctcacgcctgtaatcccagcactttgggaggctgaggtgggtggatcacctgaggtcaggagttcgagaccagcctggccaacatggtgaaaccccatctctactaaaatacaaaaaagtagctgggcttggtggtacgcgtctgcagtcccagctccctgggaggctgaggcatgagaattgcttgaacccaggaggcagaggttgcagtgagccgagaccacactactacacttcagcctgggtgacagagtgagaccgtgtttcaaaataaataaattaaataaagaagatagtaaggttttagggtatgtgaaaatgttgtaatctttcttctgggttcatatttccattaggggctagtaagtgtttgctaattacacaaggctaaaagaatcagtaaatcatagtcattacttcatcactaggaccccttgtgacacaggcaattgcagaagctgattaggggaaggcagataccttctaatgggccgaaagttttcacagtgtttagcagcagaattccagacctgggcctgcctgtgaagagctggaggctgccttattgtagtgctgtttccttggaaactgtagttaagataactctggaatatggagtgcgttttgctgtatttacactcaatctgagcccacatgatgagcacagcgttgttaaattaactgtagcataaagctgcccccttacgtattttaagttccacctaaaggtttctcttacataatgagctgtgacctaactggatgtgtaaacagactgtaacctgcttttgtaacaagcagcaagtctcagccaatcacagcagccgtacttcaactaatcacaggcggccagctgttcaaaccatgttcaaacaaggcaaaggcccacttgtaaccaatccggctgtttctgtacctcacttctgttttctgtacatcattttccgtccataagtcctctttggccccagggctacactagtcgctctgaacctagtctggttccacagactgcccaattcatgagtcattcgttgctcagttaaactcttaaattaattcgtctaaagtttttcttttaacagtatcaaaggttggtggcaaattgaggctgcggtttccctgtgtcagggggctcttcactcgcatgcatggtatatgagtgatggggcaagagaagccgtgtgccagggtagccactgccaggccttatgatgagacgaggagggttcctgctgtatttcttgtcctgtacctcctctgatgctaaggattagaccagagcttgtttttgtcctgagtggacccaactggatctgtaactctgttaacacgtctatttttcagcagtctcatcagggcgttcaacatataaaagagattaaaggggtattttattagcataaaacattttatgtttacatattcaatatttatatattattttgtcagaccaacgaagctgttctgctaaacacaaacactggaagttagagtttatgggtgattgtctcatcgctttcagtattcagtttattactgtatttcattttgactggatgttaggaaaatcctgagttacagagataagttaaaaatatccatagtttttacgcaaaaattagctgggtgtggtaggcacctgtaatcccgctactcgggaatctgaggcaggagaatcgcttgaaccttggaggtggaggttacggtgagctgagattgtgccactgcactccaacctgggcaacagagtgacactccatttcaaaaaaaaaaagaccctatatttttaaaaacttgcttaaaatttcagattgcatttcatttatgatgaagcagaacaaaaatactttgtttctaggtcgactcactacagtgtgtaaaaacttctcacattctttggcctgaacatgaaagccagataaacagtattcagaactctctgctaaaactctctcttgcactgtatgacaagcttgcttccagttcatctattaccgccctattgattcggcgttaggctctgagagaagtaaagcttgagcggaaagcaggcacttgcttattgaaggtgctaacttgttggttttgtatgagtcagcacaaattaagaggagaggagaaccatgcagaacaaaggttttcctcaatagtgtttcaaatacaaggtaatatttatgcaaaattggaaggaaaagctttattttaaagtctagcaacaaatgttaatgagttgaggctctgatgagtcagaatttggtataggatacatttaaatatgtgcttaaataacataaacataaaatatatttaaaatagtgcgcatatacatgcatatgtgtatatatgtgtgtgtgtgtatgtgtataaatgtggaactctaatatctctgtaatccagcctcaaaaaaaggcactgccgtaggccacttgcatgaactcagctatttggtgacaataaatgtcacagccataaattcagatgtgcgtgaaatttcaagttaagagggaaaattggatatatccaaagatacattttgtggttgttccacagtcagtaactgagaaattgctagcagttggaatgaggcctgctctattggtagcttttgagacgaggatgctttgaaggccttcctcctggggtgctggagacattaggctcataaaaggcataaaggtcagaacatcatcttcttcaaatagtccagtgccttcagcctttgagtttgagccttgtgataattgtactttattgtgtaattacttcaggactcagtgggaaggtggcgtgatgagatgactttaggactcagtgggaaggtggcattcccaaaccagtttgcctggactcagaaaatgcacatacctgccatccatattgttagtttattttataactttctagtgattatgaaatacattaaatactcaaatacagttttcttgggattggaatcaagccagaataagccaaattttactcttatgtgatttacctttaaaatgtggtatggtttatacatctgtgtgtgtttataggtatggagatcagaagatggatttttaaaagctcttttaatttttaactttttatcttggcagtttttaacattataaaaagtagagagaatagtatagtgaccttccatgtaccctcacctagctaaatcactagcattttgccaatcttatttgaaatggaaagcaaaggtcatttcttctaagtcttatagtatttttggaactgaatagtgcagccaattgttattttaacacaaactgctctaactcactttctggaaataccagagaagttgtgtaattaggtagaatcttcgtatactctaagataagaatttttacgcaaattttttttaacttgaatgggaggaattattcatgctttgacacttgagttatctggatttgtcttgtattctgttttctcaaaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtaagtgaacttcacgcgtctcccccagttccccttttgctgtggatgttctttggttctattttaaagacttttggcatctaggatgtcttttattatatagccactttctaattaacctaattatagccatcaatataatgtggggcattttccatggcttttaaattgaccagcagtcttactagtctataaaatagctgagggttttaaaaataataatcccttttgtaggatgttcggtgcttttattacagttcactccttgtgttggataatcttgaccctgtgtgcccagatcttactcttccctagaaatgatctcacatgggttgctttccattcaatattctaccagctcctatttcttggtagatgtcccttatggcacttcaatgtcagaagtcaccagagcatggaaagattttgccaaatgagattctgttagaatatgttactatatcactatgcctttgcagatgacctgtcttgcagattcttgcctgcttggcaagttgtcataaattagcaagaaaatttgggatctcttcttccctaattaaataattggatgggagtcgttttgttcctgagaaatgtttgaatttagagttcactctataaataatgtagaatctaagaagttttagaatatactctgaagtgatgtgaaagctgatcacagtgcatttacctttctactacaagtttagagtttcattgttacgtttggtagcttttcagatgcatatactaaaagttatttgcatatagctggaatgactttttttaaattttccaaatttttgatgtgttcttatctgatggagtaattgtttttgcaagcatctgagagcattttatgattaaacatattaacttcacctattcaaatatagttggaaaaactatagaagaacacaatggtttatctagatcataaagggtacctctctgtccagaaattaaaaagcttgccttttgtcactgctccaaataaattggaagctctggctgctcatgatgctctggtggagctctgtggagccatgaacactgccacctgcagtctgatgaagatagcaaatgatattcattttctgagttctggtccttggccaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaaccgttggaggcggcaatggccattttgagttggatgttttcaagccaatgatgattaaaaatttatgttacactcaggctgctgggggatgcttcagtttccttcacagaaaactaaatagtgggaatccggaccaataaagaaaggatcaagaagctaatgaattagtcgctaatgctggtgacagctctcaaccctcatatagggtatgacaaaacagcagaattgctaagacaacaccccaaaatggatcaaccttaaaggaaactgccgttgaacttggctctctcacagcagagcagtttgatgaatgggtaaaacctaaggacatgctgggtccaaagtgacttaaataagttttaatgaaaataaacgtgtaaaattaaaaaaaaatactggacattttaaataatttaatgtgacaactcccaggactcctcaggatccctcagtcctgggcttgttattgttgctgtttgtttaatgattttcttaaattaaatctgtattctttggcatgtgcagccaccgaagtcagctgagttagcttcagctaatgattggacagaaatgtccttaaataccttttttttttgtttgcttgtttgttttaatctaggggacagggtctcactctgttgccaaggctggagtgcagtggtgtgatcatagccttgaactctgcagccttgaactctggggtaccagtgattctcctgcttcagtctcccaagtagctgggactataggcaaaattttttatttttggtcgaaatagaatcttgctattttgctgaggctgatcttgaactcctgacttcaagctatcctcctgcctcagcttcccaaagtactgggatttcaggcatgagccactgcgcctggcccttaaatgccttgaaccaataaatctcccatctttttctgaggcactatatgccttaacttcttgcttgtgaagagcctcaaggtcagccagaggtgagagacgagggcctttacagatctctcccaggcattcatactgccctgcgtgtgtacgtgtgcgttgccttctcaggagttgcaaaaaaaattctcaggaatatgttggagcttttcaaagtcccctatggatatcccattccccagtttattcttttgagttttttggtcagcatcttatgagctgcaataaataacaccacctaagacagctgcgataaaatattgccttttttttttattaaatcaacaatttagggctagagcaaagtgagctctgagtcagaaagacaagccctgagaatggagcctttcagggagctgccagacaggctaaataatgacagttctctggggatgggattttgggggaagctgcaaacttcttttcctcctctcggggctattctcctgctggttttcagaactgaccagagttgagaggaagttgtttttcaaggctaccacagggagagggttgaaattagcacaagttctaacaccacaaagctcactgctcttactgagattcagctgtttttcttgaataaatgctccttggcttgctgcaagcttttaatttccagaattatgaaaaagttaattctgacagttgttgttagtgttctcattgctttaatgccggtttttgaaggctgtcattctgccactctggagttaactcccttccttggtgtatcctgttattttaaaacatatacagtagtcctctcttatctgtgggggatgcattgcaagacccccagtgggtgcctgaaactgcagatagtactgaacctgattgcggtcaattggaagatgtttctgtttatgtcttccacccacaaagttaatgcgttttccatcttaattaagcacttatgcactatggctgtaacttttcagtctgagttgtgacagcaaaactagcatgaatttctttttccttctccccttcttcacaatctcatgaatataagattcattcttaacagtcgattttagcaaccttggcttatgagttttattcttcccttaagctgagagctttcaccttttcacttaagggaagcacgttaggcttctctttggcatatccacattgccagcatcacctttgcttacaacctttggggcccttaggaagtaaaataagggttacttgaacacaagcactgcaatactgcagcagtcaacctgacaacctagttggctgctaagtgactaatgggctgatagccccacagtgtggatgggatggacatggttcatgtccaaggcaggatggagcaggatgatgtgaggtttcatcatgcatcatgctactcagaacagcatgcaatttaaatttatgaattgtttatttctggaatttttcattcagtattttcagaccatggttgactgtgggtaactgaaaccacagaaagccaaacctcggatgaagaagcactgctgtatgtgtggagtgctcatttttcatatccacacttcacctcaatgaatgagccttcctggaaacactgaaaatgaaacaagacaacatttttctagcagggtcattgctccaaccccttaactcctgatcaccttctcctgggtattcttctgctgagtttaaactttgtaactcccctgatttttttacagccccctctttttgcatccatagccttttatgatatccttaaccctcatctcccttcatagtttacctaggatccttagctgacagatgacttgtgctataggagatagcatgttaaaccacctttcacctaatctacctagtccatgccaaaatgcctcagcattctctttcttttataatatttatttacaaaaatagtacttttactaatcacatatacatttcttctctctcaagtcctactggacaaacccccacatctgtagtaattttttgagggccaggtgcgatggctatgcctgtaatcccagcactttgggaggccgaggcaggtggatcacttgaggtcaagagttcaagaccagcctgggcaacatggtgaaaccccgtctctactaaagatacaaaaattagtcaggtatggtggcgcgtgtctgtaatcccagctgctcgggaggctgaggcacgagaatcacttgaaccgggaggcagaggtggcagtgcactgagatcgcatcactgccctccagcctgggtgacagagcgagactctgtctcaaaacaacaacaataatagtaataatttttgaggtagtactaattacatatctaatttactcccctttgtgttttagatctttgataccatactttaatctgtatcttcagtttctgaacataagtatgcaaaatctttttaaggtgcatactctgctgcgtccctgctattttctaggacaaaaataatctgaaaacactgagaattttatgacattttgagatagcaagtctcttatagtacaatcaggtaagcaatagataattttcaaaagctgttttatcagtagataattttcaaaagctgggtgatctctgtcacccaggctggagtgcagtggcatgatctcggctcactgtaacctctgcctcttggattcaagtgattctcctgcctcagcctcctgagtagctgggattacaggtgcccaccaccacgcccggctaatttttgtatttttagtagagacggagtttcaccatgttgaccaggctggtctcgaactcctgacctcaagtgatctgcccccacttagcctcccatagtgctgggattagaggagtgagccaccactcctggccttcaaactattatttctaaaaaatacaaaataacaagtgttggcaagggtgtaaggaaacgaaacacttgtgtattaccaatgagagtgtaaagtggtgtagccactgtcaaaaacagcgtgcatttcctcagaaaattagacatagaattgtatgatctagcaattccacttctaagtatataaccaaaagaattggaggcagtgactcaaacatatatttgtatatctgtgttcatagtgacattattcacaatagccaagaggtagaagcaactcaagtgtccatcaacagatgaatggatgaacaaaatgtggtacagacataaaatggaatgtgattcagcctgaaaaaaacaagaaaattccaacacgttacaacagagatgaatcttgaagacattatgctgagtgaaataagtcagtcaccaaagggctaatactgtatgattctactacatgaaatgtctaaagtggtcaagttcatagagacagaaagtagaatggtgcttgccagaggctgtggggaggtaggagcgggagttagtgtttactgggttcagagtttctgtttgaaaagttgaaaaagttcaggagttgtgtggtacagatggatggtggtgatagatgtaaagcagtatgagtgtacttaatgccctagtactgtacaccaaaaaatggctgaaatggtaaactttatgtatattttaccacaattttcaaaaatgaaataacaatttaaaattatatgtttgctaggaaaaaaaaaagcaatacggattttaaaaagtaagaagggaaaattttcctttgttcttacggtttgggaaaatatgggatgtggccttcaagaatttttattgtacacatacaaatgcacaattattctattctattttatttttttgagacaaggacttacactgttgcctaggcttgagtgcagtggcacaaacatggcttcctgcagtcttgacctcctgggcttaagcaatcctcctgcttcagcctctcgtgtagctgggaccacaggcctgtgccaccaggcctggctaactttttgatttttttgtagagacagggactttactaagttgcccaggttggtcttgaactcctgggctctagtgatcctcctgcctcagccttccaaagtgctgggattacaggcgtgagccactacacccagcaattattttctgttttacaatttataatttatatatataattatataaatttataatttatagctttttatacaacaatatagcaaagacattctttcttgtctgtacaaaagatcttcaccctcacccatttgatatagcagccatatcatatttttgatctgcctgtactaaaatttatataaccaattccctatgcaagttcatttacattttttccaattttgtattataaaaataatttttatggccgggtgtggtggctcacacctgtaatcccagcactttgggaggccgaggcgggcggatcacgagggcaggagttcgagaccagcccggccaacatagtgaaaccccatctctactaaaaaatacaaaaaatttgccgggcatggtggcaggcacctgcaatcgcagctactcgggaggctgaggcaggagaatctcttgaacctgggaggtggaggttgcagtgagccgagatcgtgccattgcactccagcccaggcaatagtgtgagactctgtcttaaataaataagtaaacaaataaataaaaatagggaggctgaggtggaagaatggcgtgaacctgggaggcagagcttggagtgagccgagatcacaccaccgcactccagcctgggtgacagagggagactccgtctcaaaaataataataataataataataataataaaatagtgtttacaattgccatcctggacatatatcattgaatacttacaacttgaattttgactgcttactatatacttaatattataaagcagtaaagtttatggcatgtacttaaaagaataagcattttgtgtaacgtgtgtgtgtgtgtgtatggtagttattttttggaatcaaaacatgctttcccaagttttaaatggtgtctgagtccccaggctagttcctgaaaatctgtttgacttaaaatgccagaaatttcatagtgattgtaccataacagctagccacaatctataactgtatttatacaattatggattctgagacttgggactggattccaagttccatattggagtgtcaggagcacagcaaacagctcaccttaaaccattggtgtttaatcctgtggccttggtcagggtcatgggcaggatgggagattgtgggctgtgaagggatggtagacaatgggagaattggggtgttagagttagggtaggatctgggggcttttgatttctagtatttttctagcatacaaactatgacctgtgtaatctcagctataaagttaaagagagaacacattggctctagctttacttagtgttatgattctgatcacattctgataaaaagaaactgttttaaaagcatgtgaagatcactactttttgctcaatgctcattttatgtgcctttcactcacagagttcagggcaatcaagaaagaacatcaagtgaaagacatcctgtagattatagtgataacctgaaactatggcctcatatccgtcctggtatttgaatgggactggtggttacagaagaaaatgtacttatatcccacaggaggctgtttacaaaaatctggaactgtgttagttcttcctatttcctcatagtcctcaaaaccttaagaagaggcttcagtatttatgtcttcttacctctatagggactttaccatcttcagagcaatttacaattagccttgattgtcaacatgctacagaaggaaggtattctataagtgaggattattcaattaacttggctaaacttacacacagtgtgatgcataaagaaagggcctttcattatcattcgacacttagccatgcacttttaaaagcccgcttatatggggaagaaaaaggacaatttacaccaactattgtaaagcagccctgctctttgggtataatttaatcagaactggagtttgggcatgtctgcaggggtagaaccacatagtcagtaaaggaaacgcagatggggtcaagagctagagaggccacctttcctgttaagtccccaggtagctgctgtcatgtcctctgcactgtggtcttgatgggcccttcaagtccctttcatgccggagaggaaagtctgcatgccccactgttgactggcggctaataagtttctgttttgtttattataggaacaatttgcttgagtctttggttaccttacaagtccttcatcctagtacaaagcccttttgggctcttttattttaaaaatgtatgtatgtttgtatggatggatggatgggtggatggatgatggatgatgggggtcttgctgtgttgctcaggctgggccttgaactcctgggctcaagcaatcctccagcctcagcctcccgagtagcttgcagtatactcgtgccatcactcctggccattccagctcttttattttaacaaaataaagataaatgaatgtatttaaaaaattgcaatcctgaattaaataatttgtcttcaggcttcttccttggaaactgagatggccaaatgtaaaattgtttatattttatttttttataaggtttgaatacattatagaaaatagggagttattttagctcagtatgactggtaataacaccctggggaaattttttttcaaaatctactcagaggtaggaaatcaatttctggaaaccagaccattgaaaacagactacttttgatgaaatgtgaataataaaatctcagtagtgacaagtctgactacctctgccctctctagcctttggctctaaccttaaactgattttacatttttttctcttgactcatttgagaagcccttatagaacatcttattttgcatagtacagtgggctcagcattcatttttattgattataattgctctgttcaaagcataataatttaggaaattgtatttttcctcaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaacttccaggcccacggctcaagtgaatttgaatactgcatttacagtgtagagtaacacataacattgtatgcatggaaacatggaggaacagtattacagtgtcctaccactctaatcaagaaaagaattacagactctgattctacagtgatgattgaattctaaaaatggttatcattagggcttttgatttataaaactttgggtacttatactaaattatggtagttattctgccttccagtttgcttgatatatttgttgatattaagattcttgacttatattttgaatgggttctagtgaaaaaggaatgatatattcttgaagacatcgatatacatttatttacactcttgattctacaatgtagaaaatgaggaaatgccacaaattgtatggtgataaaagtcacgtgaaacagagtgattggttgcatccaggccttttgtcttggtgttcatgatctccctctaagcacattccaaactttagcaacagttatcacactttgtaatttgcaaagaaaagtttcacctgtattgaatcagaatgccttcaactgaaaaaaacatatccaaaataatgaggaaatgtgttggctcactacgtagagtccagagggacagtcagttttagggttgcctgtatccagtaactcggggcctgtttccccgtgggtctctgggctgtcagctttcctttctccatgtgtttgatttctcctcaggctggtagcaagttctggatcttatacccaacacacagcaacatccagaaataaagatctcaggaccccccagcaagtcgttttgtgtctccttggactgagttaagttacaagcctttcttatacctgtctttgacaaagaagacgggattgtctttacataaaaccagcctgctcctggagcttccctggactcaacttcctaaaggcatgtgaggaaggggtagattccacaatctaatccgggtgccatcagagtagagggagtagagaatggatgttgggtaggccatcaataaggtccattctgcgcagtatctcaactgccgttcaacaatcgcaagaggaaggtggagcaggtttcttcatcttacagttgagaaaacagagactcagaagggcttcttagttcatgtttcccttagcgcctcagtgattttttcatggtggcttaggccaaaagaaatatctaaccattcaatttataaataattaggtccccaacgaattaaatattatgtcctaccaacttattagctgcttgaaaaatataatacacataaataaaaaaatatatttttcatttctatttcattgttaatcacaactacttactaaggagatgtatgcacctattggacactgtgcaacttctcacctggaatgagattggacactgctgccctcattttctgctccatgttggtgtccatatagtacttgattttttatcagatggcctggaaaacccagtctcacaaaaatatgaaattatcagaaggattatagtgcaatcttatgttgaaagaatgaactacctcactagtagttcacgtgatgtctgacagatgttgagtttcattgtgtttgtgtgttcaaatttttaaatattctgagatactcttgtgaggtcactctaatgccctgggtgccttggcacagttttagaaataccagttgaaaatatttgctcaggaatatgcaactaggaaggggcagaatcagaatttaagctttcatattctagccttcagtcttgttcttcaaccatttttaggaactttcccataaggttatgttttccagcccaggcatggaggatcacttgaggccaagagttcgagaccagcctggggaacttggctggacctccgtttctacgaaataaaaataaaaaaattatccagg

SEQ ID NO: 37235 - DNA, 20928 bp, Homo sapiens; identical to SEQ ID NO: 37234

SEQ ID NO: 37236 - DNA, 20928 bp, Homo sapiens; identical to SEQ ID NO: 37234

SEQ ID NO: 37237 - DNA, 23306 bp, Homo sapiens; identical to SEQ ID NO: 36914

SEQ ID NO: 37238 - DNA, 4688 bp, Homo sapiens
ggaagcgagggtgcggcgcaatccggagaggacgccaggacgacgcccgagttccctttcaggctagaactcttcctttttctagcttggggtagaaggcggagccggagccccggaacccccgccctcggggtgcgaggcggcagcagggccgtcccctacatttgcatagcccctgggacgtggcgctgcacccaagcctcttctcagttggagggaactccaagtcccacagtgccacggggtggggtgcgtcactttcgctgcgttggaggctgaggagaattgagcctgggaggcgggtccggagagggctatggaaagccgccggcggggaatcccggccgtagagggacagtggataggtgcccgaggcctacagctggcctggggctcgtgtctgggcttcggacgttggggcccggtggcccaccctttccgtagttgtcccaaatggagctggaattggatgctggtgaccaagacctgctggccttcctgctagaggaaagtggagatttggggacggcacccgatgaggccgtgagggccccactggactgggcgctgccgctttctgaggtaggttggggttctgactggggaaagcgtgggatgtccatgaagtcaggtgatggtgataaggtcaaggcctgttcattggaaccctgcgcaggtaccgagcgactgggaagtagatgatttgctgtgctccctgctgagtcccccagcgtcgttgaacattctcagctcctccaacccctgccttgtccaccatgaccacacctactccctcccacgggaaactgtctctatggatctaggtgagtctgaaataagtttgcggggaggacagggttcatgggcctggctattcatactttcccttttgcagagagtgagagctgtagaaaagaggggacccagatgactccacagcatatggaggagctggcagagcaggtacttgacttgattttcaggagattactctcacattccccaggtgggggcaggattccccattcctctctgacatccccatgcaactgccgtccactttcttgttaccctaggagattgctaggctagtactgacagatgaggagaagagtctattggagaaggaggggcttattctgcctgagacacttcctctcactaaggtaagactctcattggttgaacaaaggctgaaaagggattaaaagtcccaagtaggcaaattctgttaactttatatcaataactttaaaaaaggattgaggtgagaaacttagtagatttattgctaataggaagttgaggcaggtacacaatatgccagatgcaagggcagatcctcgtttttgttgggcttatacaaattttggtgttctgttaaaaaaataactcaaaattatcagtgcaacattagtattgggccttggaaaggactgtgtaagtgaagggccttgacacttcgttggcttcatagtaatccacctcttgctgaatggtagaactgtttagagagttcaacagggttggactaagcagtacatgaataaatgtaaaatccttagttttcagttttaagcaatgagtggcaacttcacaagcagagtactggggtactatgatgaaatcagtgctcattaatagaaaggttacaggaatatatatatattttttgacaaggtcttgctctgttgcccaggctggagtgcactgatgtgatcatggctcactgcagccttgactttctgggcttaggtgattctcccacctcagcctcccgagtagctgagactacaggtgcacactaccctgcccggcaattttttttttggtatttttagtagaaatggggttttgccttgttgccaggctggtctcgaactcctgggctcaagtgatctacccaccttggcctcccaaagtgaagaattttaatttcttcaaagtacaagatgagtcagcagtgtgatgtggctactaagaaagttcatgggatttggaaactgtagcaatagagttattgtctctacaagtcactctcttgctttccttgatactggctagagcacatctttgacagatactaagaggatgcagtctatcctgagaagatgagttaaaaattttgtctttttttttttctttaagctctgaggaaatgttaagtgccttaaaatagctaaacagggtttattctatttggccccagagatactaggtaagtccaacggatagaaattataaggaggcagctgttggttcaggataaggaagtttttatttgcttgtttgaagacaggttcttgctttattgcccaggttggagaatagtggcgagatcatggctcactacagcttcaacctctcaggctcaagtgatcctccttcctcagtctcctgagtagcagggaccacaggcatgtgccaccacacccggctaattttttatttttagtagagacaaggtctcactatgttgctcaggctggtctcaaactcctgggctcaaccggtcctcctgtcttagctccccaaagtgttgggattacaggcatgagccacgtcgcctgaatactgcccgaccagttttttttttaatagtttaaaatggtctggcttgttagggttaacacctggtccgtggaggcattcagaaagaatctgaatgcctgttggtcagggaagctgtagaagggatttctgtattggaaagagattgatctcagttgcgtttcaactcctttttctagagttcctctaatgatatccctttccctgtttcctttcagacagaggaacaaattctgaaacgtgtgcggaggaagattcgaaataaaagatctgctcaagagagccgcaggaaaaagaaggtgtatgttgggggtttagagagcaggtatgaaagggagagggactctgttgtaagtattaggtttttgaagggaggatacaggccatatccccgtatctttgttatttcccccagggtcttgaaatacacagcccagaatatggagcttcagaacaaagtacagcttctggaggaacagaatttgtaagtatccctccaaaccattcccttcctatgcccctcatttaatgctttctcactctttcccctgccctacacttgatttctaactgggcagctgccttcactaggtctctgattccaagaagctcccagtagtgaggaatacatttacaagtaactaagaataagttaagtaccaagaaaaagaaagggggtaagaaagacgtcatgggctttcatagtagttaggattctggggttgggttgggaaagcattctaggcagagagaaagcatcctaggcaagaggactagtccagcatagtcatcttgggctggaactcttaacacacatgagctgggacagaaggtagagaacatagaaaatgcctggtgaggattatgtgcatagctgatcagacagtggggaacgactgatgatattcgcaaaggaggttaagtcctggcagagtttttttgttttgttttgtttttgctttttgttgttgttgttgttttaatgaggaacttcaggcattttgtccagagaggaagaagtcgtttgcaaaaatagaatgaaaagtaagagagaggatccagtgcagagatggaggaggtggcctgaacaggagtttcactgtgtctcaggatgctaggccaggggatgctcactattggcccctctcttcctctaggtcccttctagatcaactgaggaaactccaggccatggtgattgagatatcaaacaaaaccagcagcagcagcacctgcatcttggtgaggatggtgatgaggggagaaatccttttctcagttggtggggacagggcaatccagagcccttcttcatctcctttttcctgtgctctaggtcctactagtctccttctgcctcctccttgtacctgctatgtactcctctgacacaagggggagcctgccagctgagcatggaggtaagaggcttaaggatagctctcagacagggcaaggggagaggtctgggttggcctctgaagattctttgtctcctcagtgttgtcccgccagcttcgtgccctccccagtgaggacccttaccagctggagctgcctgccctgcagtcagaagtgccgaaagacagcacacaccagtggttggacggctcagactgtgtactccaggcccctggcaacacttcctgcctgctgcattacatgcctcaggctcccagtgcagagcctcccctggagtggccattccctgacctcttctcagagcctctctgccgaggtcccatcctccccctgcaggcaaatctcacaaggaagggaggatggcttcctactggtagcccctctgtcattttgcaggacagatactcaggctagatatgaggatatgtggggggtctcagcaggagcctggggggctccccatctgtgtccaaataaaaagcggtgggcaagggctggccgcagctcctgtgccctgtcaggacgactgagggctcaaacacaccacacttaatggctttctgggtcttttatttgtacccatgtgtctgtcacaccatgaatgtacctggggaaatcaactgacctccctgaacatttcacgcagtcagggaacaggtgaggaaagaaataaataagtgattctaatgctgcct

SEQ ID NO: 37239 - DNA, 42315 bp, Homo sapiens
gactcggagggggaggagcagggctgagctggccacgccacctagggacagcgcgcgccgccgcagtagctggggccaccctcgggaaggaagagcctgtcgcgagcgcgagcttctgagctcgacgggccgagctggcagctggttggtgcttacaccttggccgcagcggcaggtccttccacgtgctttcggcggcgacatggagctggaggagttggggatccgagaggaatgtggcgtgttcgggtgcatcgcctcaggagagtggcccacgcagctggatgtaccgcatgtgatcactctgggactcgtggggctgcagcaccggtgagcaacagggtgggggtggcgggggcgtgcgtctccatctctcggagccgcttcccgcagtcggcgttctcatgagcgcccgagggcccgggaggaccgacctctccgacctaagccagtacctgcctgtggcgtcgaccgggttgcctaggcgtgcacgaggggcacctcgcttccatgaactttagcctgtcctgcccaccctcccagccacttatgccttttaggggctctctccctccccgccccccggtgtgtgcacccatccagaggctggccagcttgtaaaccgccggtttgcttggtctagctgggtcagggctcctccccgactgcaggcgggttctagtctcccggagcctgtggctgctcctgtaataggctagtgtggcgtggcggccagtccaggtccttcaacacctaaaggttttcgcgcggggcctccaaccaccacaagcttttgtttgcaagggcagagctattgagcagattatgggtttgaaagtagttatcgctatgggaacttgaggatgctagacttcagacccagggaaagatgactagttgatgttgagaatgactactggtagtagatctcacataaattaaatggaaataagccaaccatagggaacagtgcatctggaaaagattcattggtagacgtcttgcctaatgaatgaaaacgttggtaataacatgacaaaaattaactcccttcttcaaaagggggacaggggagtagtgtctctatgccaagatccatacacttgattttgaaaaattgggagatcctttcgagttaaaaaaaattactttgcttcggtgatctttccttttcttactacctgacttaactggaagttgatataaattattacactaggataagaaaaacaaacctgggtttgatattcttactgaaagtattacagtttccataaggcaatacagtggtaacaacttacactacagttaaggaacttggcaataacacgtaacagcaaaatgggtgcaacacgtataaacgcattccaaaagattagcttttcctccaccaaacttaaattagaagtattttttgctgttttcattgtcccaggtacttcaatttcagtttcacattttgtgtgttccttgtttactaaagagctgagaatgtgggaagcatcaaaaagaatatttttaacttgcgtagctccaatcttggataattgtgggttgaccataatagatttcttgttttttttaaaaaaagtttattgagaaaattagttacgtaatccaaggagaaagtaaactcttgattatgtggtagttgtgagcaacattagtttgtaacattcttagaaactatggccaggcgcggtggctcacgcctgtaatcccagcactttgggaggccgaggcgggcggatcacgaggttaagagatcgagaccatcctggccaacatggtgaaaccccatctctgctaaaaatacaattagctgggtgtggtgatgcgctcctgtagtcctagctactccggaggctgaggcaggagaatcgcttgaacccgggaggcttaggttccagagagcagagatcacgccactgcactccagcctgggcgacagagcgagactccgtctcaaaaaaaaaaaaacagttgttattttggatactctgtcatgggggtgagggagaatctagaggtctttagggttgcctggtggtctgtagaaaatatgtatgaactgtacttcactatatttactttttttgccaaagttattcaagaaattttcatccccctttctccttccctttaaatgtgtgcctgaagaaaaagaggcttttttttttttttaacttacatgttagcactggttggagttttagtacccagtttaggaaaatacttggtattcatggttataggttttttttttctttttttttttttttaatgaataccatttgattcctggttacatatatctgttttctatagttgcttttctgtgaaagaattgtaagattaaataataccagataagggcaataatgatgtgattatgtggttttgaggaacaaatgtattactgaaaaacaatttaacatttctcttgtgtaggcatagaatcattaaggtgcacaaagagggctggttctcacccataatcaattcaaaattttacatgagctaaagtgctcatcctttgggaggactgattctgcttggaagaacaatgacactcccttatgtcttggaaatacaattatctgctgctcgaaactgatagataagggccagaataaaactaagaactttttcttttagtttagttttatatatatatatataaaatacgtgtgtgtatgtatatatgtatatatatatcgtactctgagaagtggtggtctgttgcagaaagctctgttttcactttctcaccctcattcactcactggttagttttaaaacaactgcaaaaaggtttgattgtgtttttttcctttttgatgaaggaatttatttcttatatattatcttcttgattttttttttttttttgagacagagtctcgctgtctcccaggctggggtggagttcagtggcgcagtctcccctcactgcaagctccgcctcccgggttcacgccattctcctgcctcagcctcccgagtagctgggactacaggcgccccccaccacgcccggctaattttttgtatttttagtagaaacggggtttcactgtgttagccaggatggtctcgatctcctgacctcgtgatctgcccgccttggcctcccttttttttttttttttttgagacagggtctcactctgtcacctaggctggagtggagtggtatgatctgggctcattgcaacctccgtttcccaagttcaagtgattctcgtacctgtctcccgagtagctgggattacaggcgcccgccaccacactcaggtaatttttgtatttttagcagagacggggtttcaccatgttgaccaggctggtcttgaactcctggcctcaagtgatccaccctcttcggtctcccaaagtgctgagattacaggcgtgagccaccatgcctggccaaccttatctttaagaagatggaatctagaaggtgagatttctatcacttttgttttgtatttggtccagttttttgtcttgggtataatctaatctgaaacatttagtcctggggttaacagaatacctggaaggtatattagccatttcatataaaaataaatagagtatcaattagttaagccagtcatgcactggatatttaacccagatgggttcatccagatgtactccccgtttttagtagttctggctgtcttcagatttattccgtagctctgctttctgtaggggaattttcacatgtcctcttagctgtaaactgtgcatgcatgtgtgtgggtatgttcatgcctgatttatataatcaccaaatgctgttttggtcctgaaaacatcatttcagtagtttgcggagttctgaacaaaccagacaccccttcttagaataaacattttcatctttaaaacacagtcacattttatggagactagaatggcctggacatatttgaagattccataaaaggaattagtaaatgtctgtagatttatgccatgaatcagctaattagcctttccttgattaggagataaccatgcccttccattcaatgaattatcacttctcctggttaggaattgaaccttacaatgacaaacattttcatacttctaaaaatttataagatttacctgatgaagttgggttttctgtctgcagaaacattctgtagaatcttttggttctgttattacgctttgaggaaactgatttgtaatgatctcaggagcacttttcttaagagatttagacactggttctgcaaacagagtacagaacattaccactggaaaggcacttgtgagaatgagagatgcactcagtcagacttatatggatctagttcccagttaatcttcatttagttttgtggagaacacaggatttgattgtcagagaacttactttgggctgccaaattaaggcagggaatatcttacttaattttgattttcatatttgactgaaaatgatcaaatatgtaacattcctatagtgtttaacttttatactcccataatctataacctttatctgagtcaagtaaattttggtttgagggagtgacttattttaagtgtccttgcaaattgttccagtctttgattttagttattttataattcagtgattcttgctttaaaataagtgttttcaatccttccatttataacttttttttttagaacttagctttttgcattagtctgaagcagaatttacctgcccccaaaagtctccaagtaccactgcttggtcattctggtcaatattgggaagagctccttaacatacaaactgaaatctagccccaggttttccagtaacatcagtttaatcttgggcaagtcttctaacttctgagtctgtttcctcatctgttggcctagacttatatattgtaaggtctaatgttcaaattcagtgggttcagaatgatactcttgtgcggttaacccttagcagtttaacctgaaaggagaaactgctaagggttaaccgcacaagagttttatctgacttgcatttatatccagacatagaaaaatacacttttcagttcacttgagataaaaggttataaggggaaaaggaattcttgctatttgctaatactttattcaaaatgtatttgttgagcagaagctcaacaaataggaataatgtacatctaagtatattactaaggcactgtggtagacactgggaatactttaccatacagggcagatgtggtccctgccctcgcagagaccttattggttcaggagcgtagacttctctatgcctcagtttcctcatctgtacattgggtataataatagcacctaccttataggattgtgattgggactaaatatgttaatatatgtaaagtgcttagaacagtgcttggatatatgcatgccctatgaccctgccttccacttctgggtatgtattcaacagaaatgcatacatatgtccattgagagacatgcaatttttcaaaaaagccccaatctggaaacagctgaaatgtccaacagtgaaatagattttaaaaagtaatgggatatacgtttatttattaagtaaatattgagatggggggtttcactatgttgcccagactggtcttgaactcctgagttcaagtgatcctcctgccttggcctccaaggcagtgctggaattatagacctgagccactgcacctggctgggatgtatatttttacaatggactattctacagtaataaaaaataacagactactgttgtgagtaaagtcatgggtgaatctcataaacaatgttgaatgaaagaaaagtacatatagtatgaatcccaaactaatctatggtgatagaagtgagaatagtgataatgtttatgggggcggaaggatgattaatgactgggaggcttttagggtgctagtaagttttatgtcctgaatggtggatttggtgtgtctactttgtaaaattttgttttactcttcaattttttgtgttaactaaaaaacaatctcataaattataaatctataaggcattaaagctggattattttagagatccagagagatgcagtgatttgctctgtgtttaggaattagggtcaaagagagactggagctcaggttttcttattagtcttatgtgcattttctttcttctacatgctatattgcattatattatcttttctgatgtctgtgatgggtcattttggaattacagctcccattattaggttggcttctgagtttgactttcagacttattaaaatgttatattgattattgactacctttgaagaactgtggatttttttctttttacatctgataacaataattgcaacaatcactgtaaagtacaatttaaaggaccatgataaccaaacagttacctaactccgggcaagttttcatttactttcagtgttactctcactcttttttctttcttcttcttttaaaatataaactctagctcctgcaggaactttcactcagtgagctatgaaataaattatttctcagcattctctgctctaatacagttcataaacaatatatttagtctaatttatcaaggacaggaataaatatctctgttatcaggaaaaagcaacaagttgtttccactgtgtggaagaacttgttatttctctggctcttaccatcttcatgtgcttttctcttgaagctcaaagttccttggcttttgttgtgaccttcaaataattcttaaataaaaacacaggaaaagaatcattatgtgacatcatttgaaacacattaatggttttcaagcattcaggtatactaaaataagaaaacttaagcagatggacaaataaagaatgagttaagaattaggaatattttggtacaaggtttagaaaaaagttgaaactcttggcttaaattaggtacctatttttaatgatttttaagggtcatttgagcatacaatagtgtaaggatttcatttttaaagagtttttctcttgctaaatgaaaatgcaaagaggaatgtctagaattttttttgttaatgtcaattccaaagttaccatgtctccatttggcagttctgagagttggttttcttaggatgcagtcaacttcttcataaaatctcatttttcttggagggttgccattttttctttgtaaaatgctatattcatattttacatttttatatttcgtatgacattgtttccggtctctgtctatcccaaactgcattaattaatcttctggcaatttcctcaaatattttcttgtttcttgtggccccttcaagcattcgcttaattttttcatcagaccatatcaatgctctgacctcactgtcacaccagtattttccggcctctgtgttactcactgttataatctgtaaatgacttttagcatcttctaaaggattacctacaaatcaacatgatttataattattcaaacatagataaatcttgtatttgattatcattcacttaaagcaactgtgatggcataaagtaccaagaatacaataataacttcaatatgagtcaaaagaaattttgtgtccatattcaaacagtatattctaaaaattataagacagactgttctcattattagtgagaaaatttagctgcttttcatcataggtgatcttcactggatatttgtgaatatggaaagtcccagtgtttactaaatttcttttagtgagaagtgggcatagacattttccttctttctctactgtattctctaccaactcaggtataaggaagcattttaggtaatacacaatagagatcttctctgttagacttcatatatcaaaatgacatttaaaatttaccaatttagaccctgcagtggacccagtattattttggggtgatgatgtgcagcagggggtgacagggggaaggcatactccacaatgctttctaacagtgagttcctctcatcttaaattctcctaggttttaattctgaataatttttcagccttatgaattttttttttttttttttaagagacagggtctcactatgttgccgaggctggcgtggacctcctgagctcaagcgatcctcctgcctcagcctcccaagtagctggcactacaggtgcctaccaccatgcctagtgcctcatggaaatttgaaaatgtgtttaaatcactcttgttggatataatttttaaaagatggtgatagaaatgtaaaatggtgaagtcatggtggaaaacaggtagttcctcagaaactttcagcatatgccatatgaccaagcaattccactcctacatataaacccagaagaactgaaaacatgttcacataaaaacatatacatgctgtggaaaaacagtactgcaggtcctaaaaaaattaaacacaaattaccatatgatcaacaatttcgcttctgggtatatacccaaaagaattgaaagcagggactcaagcagatatttatacatccacattcatagcagagttattgataatagccgaaaggcagaaacaacccagataaccatcgatggatgaataaacaaaatggtgtatccatacaatggaatattaaaatgaaggaaattctgataaatgctacaacatggaggagccctaaagatattataagtgaaataagccaggcacaaatggacgaatattgtatgattccacttatatgaggtacctagaatagtcaaattcacaaagatggaaaggagaatagtggtcaccacaggctaaggagagttgggatggaggagttattgtttaatggctacagaagtttcagtttggaatgatgaaaaagctctggagatggagagtggtgatgtttgcacaacaacgtgaacgtacttatgggtataatggtaaatattttatgtatattttaccaaaatgggaaaaaaattgtaccagaatgttcatagcaacagtattcataggagccagaaaatggcagtgacccaaatgtctgtcagttgataagtgggaaaacaaaatatggtatatctgtaaattggaatattattcagccataaaaaggaatgaaatactgatatatgctacaacgtggatgaaccgtgaaacaaaagaagccagacacaaaaatgtatattggagggtaccactcatgtccagaataggcaaattcttagaaacagaaagttggttagtggttgtcaggggttacagaggtgtggtcaagcagttaaactactgatggatatggggtttctttcttttttttttttgagacagagtcttgctcagtcgcccaggctggagtgcagtggtgtgaccacggctcactgcaacctccgcctcctgggttcaagtgattctcctgcctcagcctcccgagtagctgagaccacaggtgcgcggccaccacgcccagctaatttttgtatttttagtagagatggggtttcaccatgttggccaggatggtcttgatctcttgacctcgtgttctgcctgccttggcctcccacagtgttgggattacaggcgttagccaccgtgcctggcagatacgggatttctttgtggggtgatcaaaatgttctaaaatgggatactggtgattattgtataactgtggatatactaaaaaccacagttatacgctttagttgggtgaatttgattgtatgtaaatcacatctcagaaaagttgctgaggtttgagaatagaaaagtaaagacaagtcaagtgtagaggttaatgcagtgatgtctgtgggaagttataaaggaactaaggaaacatgaactgcattgtacggagcttccaaatcttcctctaagccagagtttttatgatgtgattgattaagtcattggctgcaagatggaactcaacctccagccccactctccttcatggaggtcacactggcacaaagctccaaccctcatcacatggtcggtctttttcggtgactaccccctatcctgaagctatctgggaacccacctagagtagcctcattaacacaacaaagatgcctctgtctctggaagttccaaaggttgttgatgctttgtgccaggaacaggagaccaaaactagatatattctttattatgccacagcttcttaaaagtttattaaaatattaccaacagtacaaattagaaaaatcatgacttcataataaacaagttgcctgtatttaagattagcagcatacctatgtctgagctttcttttttcacatttgtaagtcttcggttttctgaagttttagtaataagttcttctctatctggatgtactattggattaaaatgaaaagttctcagtattgtgtttcatatgactaaagtgcattaatttatgtaataattttactgctaagattatacaaattataatgcatgtaaaatatacaaaagtgtttaaatattccaggtttaaggaaaattacttccaatttctttcttttggaagagataaatgaattagaagaaaacataattcttagcgtaccctttgagatggtaacagtagattccttaatgccccctgctggccatctcattgtgaactttttgaattttggaaatatgttttgctacaaccaaaagaaaaatgggcatttctagggttattcttagatgaacattgaggtatttcacttgtgatttttaggctgaagatcagcgtgacctcctctaataggatatattttactaccatgaaacttctatgcttatttaagtatgcttgactccacccctctgacctaaaataggtttaactgtgactgtcctataccagaaagcagtggcttgcgggaatacatagataataaggcataccagctcatataaatggcagctgatattggagcggaattaagtcaattttgtttctcctactcagaagagacaggtaggtgataagattgtcaaacacaaattttctcttttggcagagtcctttctcctttgataacttcttgattccttttatcctctctcgcttatgcttcagaccagggagaaaaataaaatatgttttagatccaaagatctagtttattcaattttcatgggccacttctttttacttaacataataggaatagcctgagcagtctatgattcttctccgtgattgatttccttcatattccattagtcattaatttttaagtgataatctatcggcattagcaaatttttcttccctgaatggaatcaaattgaaacttctgtgtgaatcagtcctctgctggtctgagcatgataacctagctacggtttccagtgctggctatgcttgagaaccgtctaaaaatacgggtgcctgaactgactccaacctgctagatcaaaaccttcagaagttccaaattgggaaccactctagatactcagaatccaaggggtctacagctgtagctggattttcatttgaagtaaagaaaagcttatggcttatagcatacatttaagataggaaagagaatacttttgggggactggttttttggccagatatcaaagttaacaatatggagctattattaataatagcaactccaatttcaaaaattcatcagtgaaatacaaaaaataaaaatgaagtgacctctgtttttacatgtaaatacccatcactttgttgttgttttaaagaaagactatttcatgtgaatttttttccctgaagataaataattcatatttttatacctcaatactacgttctattacattcttcctaagagcggagtggcaatttgtgaatcagtaggtatatattgcaggtgtacctaaaatccttgcctgtttaagtttttttcttacgtatttagctgctgagatccttgtgggtttatatctttgctttgaattttcatgtgacagtttaaaataatataatctctaggatgactatgcatttgtcctgtttcacattttctaaatatattccaaatatttcatatttggcatgcaaacatgccaaacaaaaaaaaaaacttgtacttttgacttaatctttttcttctacatgtaaaaaattatcttgaggttgtacttaagtaagttttccagaggactaacaagctaaaatcttctgaatactaaagctcttaactttttagatggaaatcttttttccttattaaacaatgcagtaatctgattttcttattttttaaaattttattttttatttttagagatgggttcttgctgtgttgcccaggctggattcaaactcctgggcttaagtcatgcttcaatcttagcatcccaagaagctgggattataggcatgtgccaactgcacctggcataatttgatttttaactcttaatgacaaaggccatagctgtgatgcctatggaaacctaagaatctgtcctgtctgataaaccagagaaataagtttgccaggagtataggaaatttgattaactagtttgttaaattaacattgagctttacactttgtgaagttatatgaagctttggactgacagactaggtacaaggtctttttaacagatatacttcagcttgggggcttggtgatctcctcctccccagttttggtttgtgtagaagaggcaaactatcaggtagcaagcacaaaatctcacctccaaacccttagtgccctataccagagggtaatgattctcaaacttgcttgcatcattataacctggaagacttgttaaaacagattgctaggccccaacaccagagtttctgattctggatggggcccaagaatttgcattttgagtaagttctcagttaatgctgatgctgctacacttggagaaaaacagcgatggggaacattgcttccattaattatttccacctttcatttatgtgttttgagttatgatccaacagtacttcatataatgttataacataatttcttaggtatggtagcgtctattaatatatagatataaaatctaaaacccattatgagggcaccactctcatgacctcatctaaagctagttatcattcaaaggccctgtctccaaatacatcacattgggggttaaggcttcaatatatgaatattggtgggaggaacacagttcaggccatagcagtgtcttataatagcattttatgtatatactttgtcacacacacacacacacacacacacacacacacacgtacaaaaaaaaaaaaccagaatattattttatgtgtgtcaagaccttgttttttatctgtatctcctatgtcttctgacttattactgactgaatcatcttcagctacatctccagcaatgactgtatgaacataaggggatatatattggctttttaaatttacttcaggatcgtgttttatttatttagattatttatttgtttttgaggcagagtctcactctgttgctcaggctgtggttcagtggtacgattttggcttactgcaacctctgcctcccaggttccaaggattctcattcctcagcctcccgagtagctgggattacaggcatgtgccaccacacctagctaattttttgtgtattttttagtagagatggggtttcaccatgttggccaggctggtctcaaactcctgcctcaagtgatccacccaccttggcttcccaaagtgctgggattagaggcatgagccacaacgcctggcccagaattgtgttttaaactctaatgcagtattttcctttttaaagggaccctaatattaaatatgattagttagattccctacccttaagcatctttttgtcactatagatattgggtatgtatctgagtctctaactaagtcttctgacataactaatggaatcatctttagctgcatctccagcaatgactgtatgaagatatcatgccactgctgttgggctgctttatctgtagtcatctaactgggggagatgtatagttctctagcataccagtttctttcttgtccaccagcgaaatattttgagatttctcaccaacatttccagtcttaactgtctgtggttcccctctcttccctagacgcagactgtcttacaattgggactcatcatttaagccagataataaaatccggagacactgtggttagtagaggtctttaagaccatcttgtccacaccccccaattttggagttaggtctacagcagcggtctccaaccttttggcaccagggactggtttcacggaagacaatttttccatggaccagggggtgagggggccatggttttgggaggattcaagtgcattacatttattgtgcactttatttctgttattattacgttgtaatatataatgaaataattaaacaactcaccataatctagaatcagtgggagcccggagcttgttttcctgcaactacatggtcccatctgggagtgatgggagacaatgacagatcatcaggcattagattctcataaggagcacacaacctagatcccttgcctgcacagttcacaacagtcttcgtgctccagtgttctaatctaatgtgagaatctaatgttgccgttgatctgacaggagtcgcggagctcaggtcataatgtgcatgatggggagtgtctgtaaatacagatgaagcttggctcgcccaccactcacctcctgctgtgcaacccagttcgtaacaggccacggaccagtaagggtccaggtgttggggacccctggtctagagaagacacttggttacttcaagcttccacagagccttacaactttgatttcctgaatcctggtctagaactcattcagtttatttcatgctatcatgtcttagtgtgtatgtactgtatctcaatcctttggtttaaatatactttaaagacatttatgatgggtctcagagaaatgtactacttctaagaaagtctcatgtattttatatttttctaagttcttcaatgccctttttctattttactcaattttaccacaattagtatgaaaatttactttaacttctgccatctggggttgcatatttgctttattaaaattgatctattttaaactttattctgggaatccagttttatttcctcctttttgtataactgtactgtttctattctggggaagatcaaatgtatactaaatctgtttcataataaattcagctagcttgtcaaatagcatgtaatgaaacctatttaacttacatatataatattcctcttatggtactgaacattctcaatacaggttgagcatccctaatatgaaatctgaaatgctacaaaatttgaaactttttgagcaccaacatgatgctacatgtggaaaattatacacttgacctcatgtgatgggtatagtcaaaactttgtttcatgcacaaaattattaagaatattgcataaaattagctttaagctatatatatgaaacacatatgaatttcatgtttggacttggctcccctttctaagatacctcactatgtatatgcaaatactctaaaatctgaaaaagtatctaaatctgaaacacttctgatcccaggcattttggaaaagggatccttgaacctgtgtgatgtaacatgatgttaagattatttttcttcaccttcctacctgtctggtcctctcccatttttacgttggcacattctgtgacatgttctccatcttgggattcctggtctcgtgatttttctgttttattgggtcccagaatagcatccaactcagtaaaaaatttcatactcttagtcatgcctagatcttgagctgttcttacgatcttgtattcgtgttttaggtttttgtattttgttctgcactgtttccagtctctgtctattccaaatttctgaagcttggctgcaatttgttgaaatatcctcttatttctcactgttccctctagttgtcgttgtatgcttttatcagaccagatgtctattagagccctgacttctggcacagtccagtgctttcctccttcatttgctacagttgggataaaagttgtattattagagggttccaatactgacgtagagatacctgcattaggtagagaggtaaaagatatatgcattatatacatcagacaaggtaaataattggatgcaacattattaaagaaagcagtttcctccataggagatggagtaacaaatcatagcttagcttttctcttaaacagtggggaaacaaaatacagaacctaaatctgtccattattatgccggttactggctttaataaagttgtgtttttttagtcatattttgatcatctttcctgtataccttttttttctcttccataccactcctttagtatgtagggtgtatgtcagtgtatagtggaagttcaatatataaatgtgtagcatttactatagaaaacagtaattacttaagaaaatggctcattgtagataatttgttttgaaataggataggtacaaacaatttaactcctttcttttttctttatcttacgatttcctttggctatatatcagtctactgggaagcatttaaaaaccaccactctggtacctgcctcatccctcatccccagactgtgaatctaatgtgtagtcagggttgagaactgaggctactcatgagctgagggcttggaagagtcacacagaacaatcagtgcttacgccttgcgaaaattacagaaagactaaagccattttaaatgaagtattttcttttaatggtagggaaatgtgtcagaaatttcataatgccttgttcctaggcagtatgtctccacttagttataaatcctttaatatgccatggtgtgtattaggtctctagaacagttttatacttcatttacattactgacagtacttgactttatattggttattttgacaaccaatcttgtgtttttctcagatttcattttcataaaagaagtaggttcattttctgaattataaacttacaagcacattaactttggtctttgtgttttttttgagacagggtttcaaattggatgtaatattattaaagaaaggaatttttggctgggcatggtggctcaggcctgtaatcccagtactttggggtgccaaggcaggtggattgcctgagctcaggagttggagaccagcctcccaacagggcaaaacctgtatctacaaaaaaatgcaaaaattagccaggcttggtggcatgtgcctgtggtctcaggtatttgggaggctgaggtgggaggattgcttgagtcggggaggtggaggttgcaatgggctgagaatacaccactgcactccagcttgggcaaaagagtgagaccctgtctcaaaataagataaaataaaataaaataagttttttaaaaaagaaagtaattttctttcaccaagctagagtgtagtggagagaccactgctcattgcagcctgaacctcccaggttcaagtgaacctccagagtagctgggaccacaggcacacgctaccatgcatgacattaacattttgtttgcattaaaaataatcttcagccaggtgcggtggctcacgcctgtaatcccagcactttgggtggccaaggtaggaggatcacgaggtcaggagatcaagaccatcctggccaacatggtgaaaccctgtatttactgaaaatacaaaaattagttgggtgtgtggtgcacacctgtaatcccagctactcaggaggctgaggcaggagaatcgcttgaacctgggaggcaggattgcagtgagccgagattgcaccactgcactctagcctggcaacagagcaatactctgtctcaaaaaaaaaaaaaaaaacaaaaaaccaaatcttcaaattataccgaagattaatcataatttattttgtttctttttcttttcgtagactctgttgcacaggctggagtgtgtagcacagtcatggctcactgcagccttgaacccctgggctcaagtgagccttcctgcctcagcctcacaagtagctgggactacaggcatgagccactgactgcacctggactatttttaataatttttttaggcatggggtctcactgtgttgcccaggctagtctcgaactcctggtctcaagtgatcccgcaccttggcctcccaaaatactggggttacaggtgtgagtcactgtgcctggccataatttaaaattaaatattacaattaatggttcagtaataattgagtttaggttttggcccctatcatacaaatgatattacaattaataacttttgtcaggttcatgagttttaagtcattaaaaaaactttatagcatttgtttgagatattttatggtgtatttaatgtctttgctttgaaatgcttttcagaattttttttcttatttaggttacaaatatttaatgtctttgctttgtaatgctttttcagaattttttttcttatttgggttacaaataagtttttctattatgtaagttagaagtaaggtttttgcttctagcttcaataagaaattagaagcggccgggtgcagtggctcacgcctgtaatcccagcaatttgggaggccgaggcgggtggatcaccagaggtcgagagttctagatcagcctggctaacatggtgaaaccctgtctctactaaatatacaaaattagctgggcgtgatggtgcgctcctgtaatcccagctagtcaggaggctgaggcaggagaattgcttgaaccccggaggcagaggttacagtgagctgggatcatgacactgcactccagcctgggcaacagagtgagactagaaaagaaaagaaaaatagaagcaaagaaggatttacactgaatttaattcattgggtgattcaaattatccttgacctggttgtggctctgatgtttactttcagatgtaaaattctgtttgtcttaattccttgcctcaacactaaagtgatcatgttcattactatgagtaagtttagccatcagatttcttataatatttaaagagtaaagttcggaaattagagaaccaatatttctaggaaacttaaatttcgtaaggaaatcatttgctttagaaataatttttttcagtgtgggttggcaaaaagggaaacataaatcaattctgagtgtttcttccaggaaaaattgtcaattttctcagattaggaaccagtctttccgtttgaaattagatcagtttcattctgtcccatccattatactatacctagttccattggtctgacatgagaaaccagaagtaaaggatttcctgagacatcttccttatctactgatgcaattgacattttacctgtaaatataacagaattccttttagaaacaacatgactgataattctaatagctttagctaaatgtggtcatattcttgaaaacagatttgtgatagacattttgtaataaagttgtataatatagtttaaatatttgtatatttaaagagaaatctaattttttccatcccattgacatggtccattttgaagttctgctagaattgtttgataattttttaagtttttagaaatggttgtagttagttttcaagttaaattactttttttttttttttgagacagagtcttactctgtcgcccaggctggagtgcagtggtgtgatctcggctcactgcaacctccgcctcccgggttcaagcaattctcctgcctcagccttatgagtagctgggattacaggcatctgccaccacgcccggctaatttttggatttttagtagacacgaggtttcaccatgttggccaggctggtctcgagctcctaacctcaggtgatcctcggcctcccaaagtgctgggattacaggtgtgagccactgtgcccagccttacaatttttaaatgtggtgttttatttataattgtatcttgggtgctctaacagagtaggcatttgctaaataataccagtaatgtaaaagagtaggtcctgcaatgagatagataattagaaaatgctgtttttttggcatgtatgatcaaatagcttagagtttttaagtatcttatataatttattgattgatacatattaaagtttccagaagttaaattatgtttaaatggactaaggaatatgtcatttaaaagaaacatgccaaccataaaaattgaattcctcctttgatttccttgttttatggtttggatgcttttatataggctttcataaaatgaggcataggctactttttaaagtgatcaaatgaggaggatgaagtacatcttagaaaggaatgcagtttacatgatttttaactcaattgacacatgaagatgaattataattacatgaaattgcagactaattgggaggcggataagtatcttttgattgctctttgtaatgtctcaattaaaaatttactcatctcattaatcatttcattgccaaatgtttttccacttctattttattgagtaacaaaagtagcattgtattttacattaatatatcaacttttaggtgtgattttaatggcataaatattcattttaaatcatgattcaccattatgtttacaggcattcccattgaagaaaaagaaaagatatgctctttatcatcttaaaaactctattagggtttctatgttaaaataggaaaacaaatgaaaaataaacataagtacaaaagcacatcactgctttcagatggcacagttgtatttttataaactctcaaggtaaaaattgtcaaaaattttaaatcaggttttataattgctttaggctaaaatgttgtcgaggaatgttttagatttggttgaaaacagggaaaataaaaatctggagttatgtaagaattacctttagagaaacagggcccaggttatttaacacctgagcttgagtatgagagcagtaaataaaggcagggtttctattctattacctggtttagagtccagatttacgtccatagaaaagagtctggaccaaacatacagatggtagtgaaacagaaaagctctctctccaacctcttcagataattttttcttaagttgctcattccacagcatgaatcctaaaactgtaggcagaggctctggagattttaaagtgaaagtcttaaatcattacttgcgatacatttgtataaaataagaggagtgaaatagaggggaaattgaccactgaaggaatgtggtttggcagccataggccaaaggaattctgaggctgaggatgatgagatttagcagaagatgaagcctcttagagttggtcaaaagtgtatttgggtcttttgccatggctctggtcctggctacttgctgcctaacaagtggcctatccttaccacttgcatgaggttgatcccaacagtggaaaaggcactttcgttttcttcccttcttccgtgtatcacacaccaataaaaattctgctggttccgccataggaaaaaccagaaaacattacataatgaatcaaacctggtgcaaggagggcttcctaagccctagggagaaaactttgattaccttaaaaatttttggattctgcagatcaaataaatcataaggcaagaaaatcatgcaaatttctaagaccccaattgacatgaatggtcagtttgtaaaattgtatagaaaagtgttctaccttactggtaattaaacaaatgcaaattaaaagttaccaatttgtatatcattataggccattgtttcttaaattagcctaagtcgttaattatttatttaatttatttattttgagatagagttttactcttgtcgcccaggctggagtgcagtggtgtgatcttggctcactgcaacttttgcttcctgggttcaagcgattctcctgtctcagcctcccaagtagctgggattacaggtgcccaccaccaagcccagcaaattttttgtatttttagtagagacggggtttcaccatgttggtcaggctggtcttgaactcctgacctcaggtgatccacctgcctcaacctcccaaagtgctgggattacaggcatgagccaccatgcctggcctaaatcattatttacttatcaaatttggaaagtcccttcttcccatcaatactccataattttgcatgacagtgattctacagaagggacgctatcatggctagtgaagtacagttattttggaaagcagttgttttagaaataatgtttcaaagtaatggccagacatggtgcctcaggcctgtaatgccagcactttgggaggccaaggtgggcagatcacttgaggacaggacttcgagaccagcctggtcaacatgatgaaaccctgtctctcctaaaaatacaaaaactagctgggcatggtggcgttgcgcctctaatcccagctcaggaggctgaggcaggagaatcgcttgaacctgggaagcagaggttgtgagctgagattgcaccactgcactccagcctgggtgacagagtgagactctgtcttaaaacaaaacaaaacaaaaccaaaaaccaaaaacaagacaaaaacaacaacaacaaaaaaccaaagtaattatatcctcctgaatcagtactttgtgtcttaaagtaataatactaaaaatggacaaaaggtattaattgcagtatcatttgcatgggggtggaagacccacactcagttaaatattatggaaccattaattgtaatatttaattttagaccatgattaatcttgggtataatttaaagattatttttaatgcaaccaaaatgttaatgtgcttataattttataatttaaaaatgtaaagaacaactagtggtattgtggaaagtatatgggaagagggtgaaaactagggagcccggtaaagaggttacattaatattccatatgagacatgatgaagttctggttagtcataatgagaatagagcagagagaaaattttatgcagtatgtcagcagattttttaaagacttagtgactgaccaaaaatcaaggatatctcaaatgtttctgtataagtgattggaaatatagtgatgctaaggtggaagcaatttgtaggaggatcaaattcaggctagatgtggtggatcgtgcctcacttcgggaagccgaagcaggagaatctcttgaacccaggagttcaagaccagccagggcaacatggtgggaaacccatcccacaaaaaattagccaggcatggtggctcacaccccatagtcccagctattcaggaggctgagttgggaggatcatttgagtcctggaagttgaggcagcaatgagccaagatcacaccactgcacttcagcttgggtgacaggagtgaaaccctctctctaaaaaaaaaaaaaaaggtgatgggagaatagagagtttgattttggaattgggagtttgaggtaactaaacgtgcatagttatgttgtaaggatagtccctctgtttatgagtgaaaacgaaggagtttggagccaagggagtacctgaaagcgctgaagatccctttaagaagttgagatattggcacccacatcttcatcagaccaactcctggttaaaatcggggactttcagaagctaagtgatttacttatttattaatcaatatttaaagcacttaaataatgaagagtcgaaggtgtttaattgaataaaataatgcgattgctgtttaatatggtaataactgcaaagctttctcagaatttggtgtcatctcagaaatggaaagaatgtaggcagggtggattcttcttttaatgaaatgatttgttactgagctgtaaacatgaaaaatagctaacttaagttaaccagttgtaatctttgtcctcttaaccccattcacatttggtacttttattatactatttactgttttctctcaggtgttaaatttatttgcagttctgtcctttttgaggtttcgcattactaaacgcatataacttagtgctttgcccatggtacacacagatagtgggtattacagatttttgaataattctgctcttgaaatagcatctataagatttagactatggtagacatctcattactgtcattgatttccctccctttgcctactaatgcttccacagacaatgagtagattctatgtaaatagtgttgggtttaacaacacagcacgtcaagaaacccctgtaaatcacttagtctcagatcatttcatgtactaaatcttcattatacttcattgttaaaatggagctgttcttcttcattgttaaaatggagctgttcttgtaaacaagtaatgaaatagtgtagaacagttattttaaatgtgcttttatttataaatttaggaaaacgcaaattaaataaaggagaaagttcttgtttggagctgtggaaaaacatcagttgagcaatgtttttgatatttttccccttatttaccactcttataaaattaaaacttaaactatttttagaactcaatccatatttcaaaaacatatcacatgcagttggcactagcagtcagtgccattgtaatgtgctttttctgtattttacagatttttttaaagtggtaatatttaacctctttttaaaaaaattcttaaccttgtgcaaaatagcataataaattggttatttttccacagtcttgatatttcagtctatatttatcatatggccacagaagtcctgaacttttacagttcataaaactgtaaaacaaaagaaaaacaagagtacttttctttttttttttttttttttttttttttttaccttcagtggtctctggggctgtacttgggctgagcgtttccaggtacctgccatttgcatcttcctctgtaaattgtgtggcaggttcatactgcaggattacatccaaatcatggaagaacttcatagttttagagctgtctccagagttatgggcatatttaactgttctatattcatatttgagatttttgtacttagcccagcactgtttccagtctctgtatactcctaatgattgcagccttttagcaatgtaaataaatattcctttatttcttagtgttccataaagttgttttcgtatatttttttctgcccagacacttagcaaagctttaacctcctcctcagtccagtgctttcctgctccactctccatgttgaaagtgacctggaaatgattcactatttccagccaaggttttgtttcctaggaaaccacatggctggttgtcaataagctccgaagagctgaaaggatgtagtttaactggttcaagctgcctgagggagtaacttgagaaactgccaaataagcaggctttgtgattaaagaagcctggatctaaatgattcttaactatatcatttcagcctgaaggaaaaacttcccttgagacaaaagggaaagaaaaccgttttttgtgtatttcttttcttacataatttactgttttaccaaatgattgttgatttttaaaaattgttttgaaaatggttggcagaggctttttccaagaggtctatagccaatgttaataatatatttcctctgacatgaatcacctagtcctctaacattggttaacttacagaccccacagcatttcactaaataaaagaaatcataagtcaatttatttagtcccatatggtatatagtattatgcatatctattttcagtatttaatgcatttaataaaatcatttcttgaggctgctgtgagctgtgatcatgccaagtttttttagagttttacttggcaacatatttaatgttgtcatttttctcgttaataaaacactgcaacaattgcaatatataattttgaaaaaggttcctttttaccaaataaatcaatgtattaacagctactaaagtctacaggcacatatggaagaggtttactttttgtttctatcctgatatatattctttggaacaaaaattggtcaataaacatctactatttatagcacttgttcagaactattaaaaatggcaaagcagttggaacctttatgagagtttatactgcacagtggtatggatgctcttagtctttactatgtcttgccctaccttcagtctagattttggcttttttctctgtatcaccacttaatcaacactaatgcaggaaatgagacacagacatgggaaagggtgcctggtcagcagagggttttcagaaacaaaatttttttttctaatagcaaaagtgctatttattggagaacatttggaaaatgcagaaaggcataaaaaatggttaccaactatgcattttgcctctattatatttggagattttaatttacatctacatactcatcctgttgaaaccctatttaggggttataaagagtagaggttagaagcataaattctgcagttggattgtctgcattggaatcctggctaccacctgctgtctgtgtgacaatgggaaagtaacttcctttctattgctttagtgtgtttatctgtaaaatgggcatggtaatcatagtacctacttcataggattgttgtgaaaaccaaattatatcacgcatgctatcgacctaaataattaaaaggatcagaatctaatttagagagagtttattcaagcaccaagtttgaggatgtctcacccagaaacaccaactccaaggaatggagtcagcattgcaaagtaggaaagttaaggtttcatttctataggcagacagaggagtttttagcagaatcacaacattttttatacaaggttagcgcgcccagttacagcagtttgattgttataggtggtggttcttctggggaagggtacatttaacatttttttacagaggatgttaatgggttttctttcatttggtctagcaaagcaggacaacaaaacaaaagctaactttttttttttttttttttgaaacggaatctcgctctgtcgcccaggccggagtgcagtggcgcgatctcagctcactgcaagctccgcctcctgggttcacgccgttctcctgcctcagcctccggagtagctgggacgacaggcgcccgccaccacgcccggctcattttttgtatttttagtagagacggggattcaccgtgttagccaggatggtctcgatctcctgacctcgtggtccacccgcctccacctaggagttaatctttaacaaagctcatcacttgagaaggcaggaggttattgtttctgatgtctttttttttttttttttttgagacggagtctccgctctgtcgcccaggctggagtgcagtggtgcgatcttggttcactgcaactccgcctcccgggttcaagcaattctcctgcctcagcctcctgagtagctgggactacaagcgtgtgctactatggccagctaatttttgtatttttagtagagacagggtttcaccatgttggccaggatggtctccagccttgaccttgtaatccgcccacgtcagcctcccaaagtgctgggattacaggcgtgagccaccgtacccggctgtctctgatgtcttttaattctctctagtcattgtatagaacaagaaaaataagaaagtgagttaatctataatctgagaaacagaagttgtaaccatatgtgacttggatcacagtcatatctctctcaaggcctaaagtatatttggggttccaatagcttttaaattatttatttttacaacgtaaaatgctaggacagactgcctggcatgttagttaatattagatgagatatctaattgttacattgtcatctgctgtgattgctaatcatcagcatcagcatcatcaatagaagtagtgctagtacaagtagcatttaatgtgttgtcacactaagttcatggatgcttgttgagaaagtatgcttgataaagttcttcaagaagctaatcaattggcagatttaacagctaatatctttttatattcacaggggtcaggagagtgctggtattgtgactagtgatgggagttcggtgccaacattcaaatcacacaaggtaaatttgaactttaagaaatgttgatgacagaccaagtgcggtggttcatgcctgtaatcccaggactttggcaggccaaggcaggaggatcacctgaggtcgggagttcaagaccagcctgaccaacatggagaaaccctgtctctactaaaaatacaaaattagccaggcgtggtggcgcatgcctgtaatcccagctacttgggaggctgaggtaagagaatcgtttgaacctgggaggcggaggttgtggtgagctgatattgcgccattgtactccagcctgggcaacaagagtgaaactccatctcaaaaaaaaaaaagaaagaaaaaagaaatgggatgacaaagataacaaagacagatgatcattaatatggggagggggatttgaataaataatttgcaatcaaaagtaatattctttggatcagccactttcaactttatatcctaacatttgtcaaattaggatgtatttcttccccagttatacttttttgcctaagaccaactcaaatagggggtcatttatttaaatgctttaagatgctttgatttttttaatgcaaattttagtttttatacttgacaaattttattgcttactacatctgttcttaaatgttttagtgaatagtatcttatgaaacacaagtgcttcaacattgtgaaggtattaaatgccactaaattgttctttttagaatggttaattttatggtatgtgacttttgcctcagtaaatttttttaagtaagtgcttcacagttcttacaattaggttatttgtttttgacttttttttagattagaattctgaaacacagagatattaaatgtacttctttgtcttatttggattggctgggcagagaagagaggcgtttattactagcagtactagtctgtttttttctaagttgcactttttgatttctcaagggaatgggtcttgtaaatcacgtctttactgaagacaatttgaaaaaattatatgtttcaaatcttggaattggacacaccaggtatgccaccacaggaaaatgtgaactagaaaattgtcagcccttcgttgttgaaacacttcatgggaagatagctgtggcacataatggcgaattggtaaatgctgctcgattaaggaaaaaggtacgtttgtttgtttgttttccctaggcctttttaaatgattaggatgggttaatgaataaaagttaaggatctttgtaaagggcattttctaattgttgctacctgttacctaactgcaacaaacaattgcatcagaatgatctggagtacttgttacaattccagattgtaagctatcccctagagttcgagacaagggtgagaatatgcattttagactcactttttgaatgcactgctttagagatttgggagagttgatttatggatggaagcatagagaaattagagtttatggacttgctatctctttaactctgttgctatgttcaaagcttgtatgagataagaaaaatcaagccatttttcctattctcagactcagcacacttctgtcaccaaataggggggtttcttataccagcagttttccagaggacaccaaatgggtatcctataattcaattgtattctgatagtacctggaggtaaagtcaggttccagaagttaagggctcagtcccagaagttaagggctcagtcccacaagattgtcccgcacttcagatgccagttgcaagtccaggcctttggtacatctgacaaccagttataaattgggagttcctgcaacagccctagcactacctttggtttcaaacatcacaaaactcaagaaagtgctttgtatacatttaccagtttattataaaggatattacaaaggctacagaagaacagtctggtgaaaagatggaaaaggcagggtatgtgggaacgagtgtggagcttccatgccctttccaggggcaccaccctccaggcatctccaagtgttcagctatccagaagctctctgaacctagtcattgtggatttttatggaggcttcatgaagtaggcacgaatgattaaatcatcagccactggtgatcagctcaacctttagcctttgtccccttccctgggggtccagggatgaagctggaagctccaaccctctggttgattcccctggcaactagccctcatactgatgctgtgcaggagcccctagctaccagtcatctcaacagcatacaaaaggacacctatcattttggcaattctaagggttttaggagctgtgtaccaggaaagaccaggataaaaataacatatataaatcttcttacatatcacaaaagcataaaaataaaatggagtataaacttgaagatgacatgaaaaaatgaattggaaacaatgacaggaaactagaatatgggaaaagggacggagactgtttacttaaactcttggttcacagcatgttgtttggagctttctgtgctaatgatgtcaaatttgtgcctatgctttcattcatcatttcatctttctttttttttttttttaactgcctgtctttatattcattcctagtagcttccttttatccattcaggcattcattaattaatgttgagtttcttcagtttattagctcccaataaccttgacttggtaacttcagaacctggtgatatttagtaatagatggttacatgcacaccccatcctataagcattctagagctgggcaattcacatatgatgaacagttacagaagcttaataataatgaactgctgggtcaaaaatatctagaacccaggcttttgtaccactcactgtcattccattttttagttctgtctttagacatttcctagagctttgtccagccctgttcataggcattataatgaccttattgtgcttttctgtccccaaatgaaaaaatacatagttcatttaaaaattcagacaatcatgaaagtataaatatggagtaaaaatttcttaaaaattcaccacttagagataaccactaactcactgtttcctgacataatgacttacctagatgctaaactttatctttacctttagctccctactgaaaatgttctgtagtgcccattcagactcaatctgtgcatgtccatggggctgcccttgtcttggtcagtcctgctcagaactttgtaattatcatagagtacactcaagcgatatttattacatctgctacatttcattgttcaatacagttgattactttcttctatcagtaataatcaatgaggatgggtagccaccattatgatcactaacaaacccagcttgaaagttatcactgtagtgtactacttttataggaatatacccagttcatcaagagtgttgagggtagaaaatgtcagacccacaaatcaaatttttgggaacccctacccactttcaggtctgcttgccttcagatttagtattcaaaagcttttctgtacatctcataaagcacatttttcctgcttgaaaatcttctagatttcctattgcctccagccatggtcatccgttattagtatatacatactattagcgcaggagtccccaacccctgtgctagggactagtaccagtctgtggcttgttaggaaccaggccacacagcaggaggtgagtggtaagtgaaacttcatctgtatttataggtgctccccatcgctcactattaccacctgagctctgtctcctgtccagatcagcagcagcattagattctcctaggagcatgaaccctgttgtgagctgtgcatgcaagggatccaggttgtgctctccttatgagaagctaatgtataatgcctgatgatctgttactgtctcccatcacccccagatgggactgtctagttgcaggaaaacaagctcagggctcccactgattctagattatggtgagttgtataattatttcattatatattacagtatagtaataatagaaataaagtgcacaataaatgtaattcgcttgaatcatccccaaatcatcccctgtccctggtccatggaaaaattgtcttccaccaaactggtccctggtgccaaaaaggttggggactgctgcattagtgggatgcaggatttttgtaactggacatccacagaatgccttattttcattatggttggctactgggtttggggtggggtggagcttcccctctgatgattaaacttctctttttttctatatagcttctgcgtcatggtattggtctgtctacaagttctgatagtgaaatgattacccagttactggcgtatacccctcctcaggaacaagatgacaccccagactgggtagccaggtaagcagagaactggactaaacttagagctctagtaaggagagttttgccttgcatatgtttataactgaagttattcattcaattatttaattaattccaggattaaaaacttgatgaaggaagcacccacagcatactccctgcttataatgcacagagatgttatttatgcagtacgagatccttatggaaatcgtcccttatgcattggtcgtcttattccagtgtctgatataaatgacaaaggtaataaactttagaaggaatatcatttcatagtgtttttccattattgtcctactgctatcaagccctgaaatctttaggtatagaaagttgatgggtgggagggagctaggtaagaaaaataaaaataaatgtattcttcctttttaaagtacgtttctttgagtactcctgaggatgagtccccccccttttttttttttttttttttttttttttggagaccgagtttcactcttgttgcccaggctgctggagtgcagtggtgcgatctcagctcactgcaacctccacctcccaggttcaagtgattctcctacctcagcctcccgagtagctgggattacaggcgcacaccaccatacccagctaattttgtatttttagtagagacagggtttctccatgttggtcaggctggtctcaaactcctgacctcaggtgatctgcccaccttagcctcccaaagtgctgggattacaggcgtgagccaccacgcctggctggatgaatcccttttaatgtttttaatagagattcctattttttcctgtcttaattggctattcatgtcctttgcctagctttttcatttctgcagtatgattttagtggtttcttttcacttttatcaagatatctttttctagccatgaaatcataatgttagaaggaatcttagaagatcatttattttatctttggctcaagtcaaatgaggatccatgtgctcttaaagtcatagaaatggctattctatgagttttatttacttatttatttagtgttagctgttccattgaaatagcctcttaaaatttctggaatccattaattgaattgatttgtgatttacagagaaaaaaacatcagaaacagaaggatgggtggtgtcttcagaatcttgtagcttcttatctattggtgcaaggtaagttttaccttgtttgacatattttattttcccatgttgaaaagaattttttttagacagtttcttatttatgtgaaagtttgaaagttttctttttgatgtctgcaagaaaatatttataaatggtttttcttatgcatgttatgctcagcagttgcactgagtttaatgttctagtaatagcttctaattctgaagctggcattctttcaagatactatgaaacttattttctttattttgtatatttttctctttttacagtacaatatgaaaatagagacttattttagaaaggaagaacttcctcaatgagagatagttatgacagaaaaatgtaagccaggagaaaatgttttctttatactttattcttttaaaattcaatacaacttagggcccttaattttttaattctatactagaacttagtgtttacagagagattataaagaaatcattgcaggagacataccactttaaaaagtcacttctagattttatattgaatgaatcaattgtttctctaagggaaggtactctgtgtgctttataattaatattttcatcagccttaaggactagtttattaaaagtcttctttctttaacattgtttcccaagatattaccgtgaagtcttgcctggagaaattgtggaaatatccagacacaatgtccaaactcttgatattatatcaaggtctgaaggaaacccagtggctttttgtatctttgaatatgtttattttgcaagaccagacagtatgttcgaaggtaagtagatttcttttctttgaacattcatataaatgttttagctatctccttgaaacatggcaattcttgcctcaaaggcttacctggctctttgaaggcatatagttatatgttgtggatataggactgagcccacaagtcataagatcactatttttcacttccttttgactcttggattttgttttttgttaggagtaaggattatgattttctagatctatatgaaggtcgattttttttttaaaaccacacagttgagttccccagtttgtgtattttcacattcatatttttgtatatattgcatttctttttatactcaatctgtagaattctagcactagttttttagaataacactgttatatcatgctaagtaaaaatactctctctccttttccaaacacaccagaccaaatggtttatacagtaagataccgttgtggccagcagctagcgattgaagcacctgtggatgcagatttggttagcactgttccagaatctgctacgcctgctgctcttgcttacgcaggaaaggtattttctcttaattaacatgcagtgaattgctctcccagctgtggaataagaaacccttgcctataaagagaaactcatcaacatttctaaggagaaaggaagctttggtggttaatgttggtttgtttacaagcgttttttattttccaggctttttatccaatggcactattttagtgaaaaccactaaaaggttcactgaaaagaaaaaaacgttcactaaagcgttcagaaattggcacccttctttttaaaaagataacatcatgaatatacagttgacccttgaacaatttgggagttaaaggtgccaaccctctgcacagtcaaatctgtgtatgcattttaatgcccccaaacttaaatactgataacctactgttgactggaagcctgaccaataacataaacagttgattaacatattttgtatatgtattatatgctgtattcttgcaataacgtaagctagagaaaagtaaatgctttgaagaaaatcataaggaggagaaaatatatttactattccttatgtgaaagtggatcttcataaaggtcttcatcctcattgttgtcttcacgttgagtaggctgaggagggaagaggaaaaggggctggacttgctgtcccaggggtggcagagatggaagaaaacccacctataagtagactcatgtacttcaaacccatggtgttcatcaactatatattcagtggaaaaatttacttaatattaaaataaacgtcttgaattatcttcacaagtcactggaatatttgcttgctactaagtatgggtaataataaagctgtttatgttcatttagcatgatgttgtcagtgttacgctttattttcataaccaggtagatggtgtaactgtagtaatcctggggtataacatccaatattcactaccttggatactttattaacttctaaaagaattaatatgcatacattttagaaaagattaccttgataaatgggttaattacttcctatccctaaaaagtatctcattggtctactggtttttatttatttattttaattcatttctttaaaaattatcattttgataatgaatttttctgacagtgatttaatctttgtcatgtcttcatatgcttactgttatctttcaaaacagaggaataatgtttaagacaaaaacattatgagtcctcacaaaatgaattggtttttccaccaagtatattttgtttagtggtttttctttttgccttttttccaaataataaaggaaaattattttgaaattttacttgaatattgtggcggcaacacaacctagagaaaatatttgcctattctgtatattactcctcattatcctttcatttcttctctatcagtgtggacttccatatgtggaggtgctgtgtaaaaaccggtatgtagggagaaccttcattcagccaaacatgaggttaagacaacttggtgttgcaaaaaaatttggagtattgtcagacaactttaaaggcaaaagaattgttcttgtagatgattcaattgtcagaggcaataccatctcacctataataaaactgctcaaagaatctggtgcaaaagaggtaagtaatattaaaacatatcctaaagcataagttaacaataagatactggcataaaattgcaattcagggtagtgaatcaaaatggatgttcaatataataaattaactttttttatcagtttggtttaggaataactgtgtagcaacttgaagaacatgtcacagccacacttacattaaatgtaatccttaatagattaaaaaagctcaatataaaagcttaaggctgggcgaggtagctcatgcctgtaatcccagtactttgggagcctgaggtaggaggttgcttgagcccaggagttcgagaacagcctgggcaatatagtgagaccctgtctctacaaaaataaaagataataataaaattaaattttaaaaaacctaaaatttttacaaaatttattcaaagactaactacacaaaataggctgggcacagtgactcatgcctataattccagcactttgggaggctgaggtgggcagattgcttgcatccaggagttcaagaccagcctggacgacatagtgaaactcacctctcctaaaattacaaaaaatgggtggggcgtggtggcacacacctgtaattccagctacttaggaggctgaggtgggaggatggcttgagcccaggaggtagagattgcagtgagccgaagtgatctcaaaaaaaaaaaagtcaaaaacacacaatagaatgctttttaaaatcaatggagtattgattgctttctctacttgaagacatgcagccaatcccagtgtaatacctttgacttattattttttaaaatgtatttgttaaagacagtgtctggctctgttgcccaggctggagtgctatggcaccatctcaactcactgcaacctctgcttctggggctcaagcaatcctcccacctcagccttctgaatagctgcaactataggcatgtgccattgcagccaggctaatttttgtatttttagcagagacggggtttcaccatgttgcccaggttggtcttgagctcctggactcaggtgatccacctgcctcggcctctcaaagtgttaggattacagacgtgagccatcgtgcccggccaagttatattttaatatcactttatgcctttttttcttttttccttgatactgggactcactgtgtcacctggttggaatgcagtggttcgatctcagcttactgcaacctccacctcctgggctcaagagatcctcccacttcagcctcccaaatagctgggaccataggcacacaccaccatgcccggctgatttttcgtatttttagtagaggcagggtttcaccatgttgcccatgctgatctcaaactcctgagctcaggccatctgcctgcctcagcctcccaaagtgcttgattacaggtgtgagccaccatacccggcctcactttatgtcttgaaaaaaatttttttttaatttttattttttaaattgacaaatgtatatatttattgtgtacatgtttttatatagatatattaagttattttaagatttcaaagcttattctatttcagtagctcatactacagaagtgagatgccatttacaactaatagttatgtaaatttaaaaataaagtctcagcctgggcaacatataccccatctctgaaaaatcaaaaataaaatctcactgtagaagaaagtgggatgaaaagcagcatgccagtttatttagaaagtttccaagataattgggattatgattttccagccttttttatacctgtgtttaggattatgatcatcttactctggaattctgtggaaattatgtaatagatacaagagtttaacataatttcatcatttattgcaatagtgaaaaagaataaagtcaaagaacctggaaatggcatatctccctgttggtgaatataatttagtaaattgatatatcagtgtgatgaaatatgatgcagccattaaatactaagaagactgcgtagcaaaaatgggaaaatctattctaataaagtttaaaaaggaaatgtggacactgagtatagccatgtaaacgtacctgatgaaaggcaaaaaaaacaataacagacaaaaacaactctgttgtagtagtaaggtttttgttataacctggtaaattgtatttttctttttaaaatggtaagataagggataagcagaagtacctggtattacaagagaaaagtggctctaggaatgtaaagacatcaaatgagaagtaggatatctagacaaagaaacttcctcatgattaggtgaaagaaaaaaaaaaccaagaagcagctttgtagaaagaataatttattacccatatgttgttactgaatattctgcaaaacaattttgtattgtatttgcacaatgaaagaattttgcatagtcttaaaaaccttgtgtgcaatgatttctttccaaggtacacattcgagtagcttcaccaccaattaaatatccatgcttcatgggaataaacattcctacaaaagaagagctcattgccaataaaccagaatttgatcaccttgcagaatatctaggtaagtattaaaatttctataaactttgattattaacagagaaaatccaaagcttgacagtctttacacctttagtaaaaaggagtattcagtgtttgttaaaagtagttatatatgttaaacagatattgaatactattctcaacagtgagagtagtgggcatgggcagacaccacagagtcttgtgttggagagctaagccaaggtgagatcagagaaggaagaggtggtttccaggtggagggaagtgcaatcataatcacttaaagcctcccaaaagtcagatcccaagaaaaacaaaaataatttaatcagattctaacagagtaatttggatgtggatacaaatcacaaggtaaaaagtttgtgtaggttcatattcaataatgagataaggagacttcgagatctaagttatcctgggtaagacatcttcctttcaaaatcaggtgatgtataaactgtggaaataacacatgatatttagtcattgtgccttggtacctccacaccatctgtttgtggctggtgtttcttttaacctgtcatgcatatgcctcactggttaaatatttttaaatatcaccctgatgggtgtcatacatgttataagcactcacactttgccagaaactatgctgcctatattatctatattatcataaaaactctacatttaggcaatgtttccaccatcttatatagatgaaaaaatagacttaggaaaactgagtgaacttgagcttaactttgagcctagatcttcctgactttaaattccattttttcaattaagaaaattactcccaaagccctctaattccattctagacttgaagcctcctctgctgttttaaattatgttatcccctagattccaattaaaatttttaaaaataaaggaactgagttttattgattttttttccttttttttttttttaaagaaaggctaaaggagaaatttatcctagcttaaattattctgtttgtaactattctctgttgacgcgtttcttcctttctaaaggaattcttattacatttttatttttccctctttctttaggagcaaacagtgttgtgtatctgtcagtagaaggactggtttcatctgtacaagaagggataaagtttaaaaaacagaaagagaaaaagcacgatattatgatccaagaaaatggaaatggtctggaatgttttgaaaagagtggtcattgtacagcttgtctcactggaaaatatcctgtagaattagaatggtagctggtagggttggatgtgtgtagtttcaagatagaaagttggtcaagaagttatagtggtcacacctcatctatttactgttactcagttggtacaatgtaaaatgccatgcttatgtttataagttttgagattttttttttttctgaaaaggataccaaagtgcgataactgaacatttccaattgcatataatacaacaatatgtggtgttcttttttttacacaagcattggctagcctttttaacctggtcagagaaggcaggtggtcactgacatttcccaagtccatgctttaaagggtttgcaagaagttagggttaaggagaggtgatgccaacaagacaggtgagttaaatataccatttcacacaaagtttgaatagaatacattatacctcataggtgtctagcctctacagttctggctgtagttatgaccttggcttccctgtctaactgtagacaaatctttaaaaaaaaataataataatctggtgcctcagtttccccacatgtgcaatgggatacttattaaataattaataagaatgtgaataagtgtcatacttttgtgatttgagccatcatttcacttctgattttaagacaactcatgattgttagctttcagaaagctaatgattgttaactttttgaaattagtttacaattaattaagatttcattatgatggaaggagacataattggcagatctttgccatctctctttgagatgtcctaaaaagggttgtaaaaatctgtgaaaaagtttttcctacatttgactagaaaatgtgatccatagtatttagtgccctgatactataagctcagcaagtaacctggtacatttgaaataaaaaccaaatttttagattcaaacaatccctttatccttaatttaattaattatcatatgctttttttaatgaagtgcttgatcacttgcaaacatatatacatgtagatgtacatatacatgtacacatacacataaatattattgcaattaagtgatcaagtacagacacaataggggccagttttgtttaaggatcaaagagacaaccactttggggaattagtatcaacttacaatccaagtccaagtatcatcttataatcacttttttctactatattaagatctaatgaatttgatttcttttttgaagttttttcttgtaacatctgagattagaagtttaagatgacttgaccccaaacctttgtttatgtaagaatttttaaacataaaagtgtttgtttctgttatgttaccataatttgatgtatatagtgtccagatccatttagaaatttaatatttattaataactgaaactgtttgtcttcctttggtatatagtctcgcatattatattatagcaggccaagataaaattttgacagctctttaagcccacatgcagcagtgggtcagataaccctgtggcagtgacacgggcaaattggcatttgaataaagccctgggaccacctcaacatgcgtagcctcttgtcttaaatgtactccccatggcagcatggaggaggcaagacctgtgggtcaattttgaactggccttactttgatttttaaaacaagagactcagggaaagtactaaaccaaaatctctgattttactttgcgttttctgtagtttttgttttactgagatgcttttgtaaaggaaaataatactgtgacagtttagtaattctacagattcttaatatttctccatcatggccttttacttcacaattttctgaagtctgaattcaattacaatttttttttaccaatttaatctcaaatgttgtttaactgctttaaattcatatacgtagagtattataaactgcagagatgaaaaatgtgttttcacgggatttatattgtgaactaaactaagcctactttttgtgacttatttgtgatgccttgttgataaatatgtgtaataagtatgttt

SEQ ID NO: 37240 - DNA, 305113 bp, Homo sapiens
gctgctctcgttcgcttggctcagctcagctcagctcagcgcagctccgcggccgccaagccgaggcgggcacggtctccgagtcgcggacgccagctccgagctccctctctccgccgcgcctccgccaggtcgcgccttcgtcgggaccacttcgggcaggagtcgcgtggcgaaggcctgcggccgcggcacaaagttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgcagccgtatcctgcgcgcccagggcacgcggcgcgagggctacaccgagttcagcctccgcgtggagggcgaccccgacttctacaagccgggaaccagctaccgcggtaagtggccgcccggcgtggcattaggagagcgggacccggtccccggagggcgccgacctcgcggtgccggaggagggcgcgcggtctccgggcgcgtggcgcgggtgcagcccggcaagggcccttctgtcctggctgccctcggcccttgcagtcgcgagctcggcgcggatcataatccagcgtcccgggccgtcgcgggggccgcagccaggagaggcaccccgcgtttccgacgcgcggttcccaggcggaggatgtaactgagccacacgtcacgccggcctgactgcaagggaggctcgcttctcccccggccgtctgcaggagggaagtaaaactgcctttctccaaatcggtctggaggggacccaggcttctcttggtcgggtcccgggcaaggcagccactccagctttccccgctcagtccctgaaggagagggtacccgattctcaaagactggccctgggcgggacagccactccggcttccctggataggtcccttcaggagaagggactttggcttctccctaaccggtcccggggtgcgggaaggaggggcagggacagcctaaagctcctcgaaagggtccttggaaagaaccccaaattattctctcgtggtcccagacgagatagagtatcttgggtttccagaacaggttcccagtggggacagggtcctcaaagagcttggggtaagctccgagctgcaaggggaattggatgaagatggaaagagaagccccgatgcccgaggcctgctccctggaggccggggaaccttggctccggcagctcggagtctccacgtcccagggatgtcgcgcctacgccgctcggctgagagtggggtttcgggagctcagggaggaggtgtccaagcaggtgagagcctcctaggcgggacaggcagttcgaccagcaccgatctgaagacgcctgactctgtccccacgcccgccacctcgctcctcagcagggtcatctccccagacatcgtttccccgtgcagcagcagccgctctccgggtgggggacaggtaaccaggaagggaagcgagcctgtctggcctcaccttagctcccgccagggagcgtgtcctctcaccctcgccccttcataagtcagctctggtgctaagcagggatgagcgggtcactggggcacctggtggggcaaatgggctcccagctgctgtactttcctcctcgccttcccagttccccagagagccttggacggaagcggtgggagcaacacaggagaaagtctggggcagcgtcagcgggcgccagggtcacgccggagaccaaagccaggggccacccttcttggagcgcttttccccctttcccgggtttgtgtccccgactttctccacccggagctacccaaagccggctccttggtgcccttggcaccttggcgtgctgagcactttgcgaggaacagtctgaccccggcgcgcagctccgcgggatcctgggtactccacgaagaaagattctgggcggagaacaccccgcccagcccgggagggagcgcgcggcttggcaccgcggctagagcgagccgcgccgacgggcggcgactgccactcggtgcagccgggaggcggccgatcctccctgtggaccgcagggaagcgggtatgacttcagtggcctattcggccctccccaaaactgaggacctgagttcacaggggaaactgtccccgctccacgtagcagagaaagaagtggctctggagtccaacagacttgggtttactcgctgtgtgaccttgtgcaagtcatttaatttctctgcacctatttcctagctggaaaaaaaaaaaagctgtttatccaccctctcttggtggtagggagtaaatgagtttacaaaggtgagtgtgcctgagctaaaagagattcctaataagcctaacagttgaatgtgaggcctttattggtttactaatggaggtaggttcttgatcagatttttgtttttgaagagtgttgtgcgtttgaaagcaggtttcctcagctctcctccagtcccattcatctaccagtggttatttgggtcctcatgaattaattgaatgaatgaatgaggtattttttcatatcaggagccttgcctaagactgttgctaatgcaagcccaggaagattttttcagtgacttagactagtctgaggttcaggccaagtgtacccagcgtctcttttcacactaatcctccgtgttttagttgagcattggcagctggtggccctagcactgggaaggagatacagctggtattcacggggccaaagaggtttcagaactacctaaacgtccagggccagcaggtggggaactgggactggatagggagtgtcctggactttcaccctacaggctactcctgcctaaacagccatctggactttgacaccccaactcaggctatagattgggcaatcatcttttctcccttcttatggctaaaagaccttggaagagatcttgcaggaaccatgctgaggttttccaagtaaatatcctgcaattagcaaacctgattctgccactcaaagtccgaaagaaaaggtactggcctagtttgtgacattttctgttggctccttctttcttagaataattatgttaaaagtaactcaaacacattctgctcattgtcctgacttaaggctgtgaagctggcattcccctggtgttctatttgctttttaattttttcatgaattaggattcctcacaatccttggaatcaatgacttgttttcctgcctcaaatctttgtccacagtattccagttcatccccaagcagcttctgttctttgtgcctgctgtctaagtacagtctttaggtactctagaccggaataaaatggtcactattaaaaaagactgaaacatggagtttcttccccaaaacctgaatccagttgagatcattattttgtcttttccaagttgttagtattatattgatttccttttctttcccaccacttctctctactctccctccctcttcccacagtcccccctccctccaacggcaataattgtgctttagaaagctctgaaaggcctgctctgtttctggccagggcctcctttgaaaaggagattacagtgattaaaaataacaagttgaggatcctcaaggggcttcccttatacaggaggacaattcgcaggaccagcctttcccagatcacaatttcaagccaaacagaagaaaatccactgaaatattcaagaattgattgaaaataaaagaggctcttttgtcttactggaggtctgtttattaggaaaataaagtcagactctggctaatgagagtggcttttcctagatgtattttaaagagacatttcaaggaacttgatgggaaaagaatgtccagtagaggtttcaaaagctggtccaacttcaagcataattgaggggtttatcctaaactgggaggtttggagacctccaaagctgcatggtttttcctttgtcccacactgagacacacactgaccacaggggtggacacctcagcctggtggaaagcgcacaggctttgatgttgggtgggttggtttcaggtcctccttggtcacatattcactgtgtgatctcaggaagccacttcacctctctgagccaatttctccatctgtaaaatgagggtgttttgattttttcccagcattcctgtgagaattagaaataattcatgtcaaaagaaattgtcacacagtggttgctaaaaaaatatgttatgagatgattattttggaaatagaaaaatacttagcagcaaagccctggataagatattgtgttaagttcttccgactcatctcacttattccttacagtactttgaggaagtttctgatcgttactgttttatggatgagaagactaaacctcagagaagtttattccttatccatggtcacacagctaataatcagcagaatcaggatacagtctcaggtctgtctgactcctaaatctgtgctcttaaccagtcttatgtgctgactcaatgaaattagttgggaatagaatgaaattcactcagctaccctcagccttctggatggtgagccttccttcaaggaaaacagaacaacaaatcaagatagtaactgacatctctcaggagaattactttatattactacaaagtaatataaagtgataaatccttattcacatttgctgttttctcttattggcttcagtgttgcatttccccataaactagaggattaatttagaaacatgaagaaccttgtcagcctttggccaattccttttgtttgtggggaaacaaaaacaaattggataggaaaaaaaaaacccagaaagaaaaaaaaaaaaagaaaaaacagatttgactgttgttttgtttttacatacagatgttatatgaccatgcctgtaaaattatatgtttggaaaggacatatttaggctctaagaaatttacacaagatgaggtcttttaaataaactatttcctggatggtggagtttttaaaaacttaagtgctgctgatgatattataattaagccacccctcctacctctcttcccttttttgcaccattccctgcttttttgttatgtaactatttctaaccattacttaagtatttagttcaaactgataataaaaattagaaaatgcaaacatagctaatgcttaatggttgtggagattgtttattgctctgagttttaggaaatgaaagaaataaaaacatacaaaaaagcatatcaaaatggaatttttcaaggtttaaaacttgagtactcccccatacacagataagctgtttcattacagctgactctttcagttgcatcaagaagctataatcactgatacgtttaccactatgggctggtatatcaggagcttttcactctcacactgtccatttgcttgttatacagactgtcacatatatataggtcaatatcaatttctgttgtgaggtggggggactcttaccatgttatattagtcatagtacaggctaagctcatgttactaacagaatccaaaacacagtgttttaaacaagaggtaaatgggagatccagcatgatgggaggctttgctccataaggccatccaggaaccaggctccttctaccttgttccctgacatcttcttgcactctgctgtgtagttggtggctacttagccgtgtgtagctatgaagtacttgaaatgtggctattctgaatggagatgtgctgtaagtataaaatacacaatgactgttgaaaatttagtatacaaagagtaaactcattaattgtgtattattacatattaaaattataattgtataaagtaaaatacactagttaaaactaattttgcctattttcacttatgttaatggatacctggtaacaaaattaatttcacccagcttgagcttatttctactaaacagcactgttttaagttgctgttctcctcagcaccgttacagccgaggagaacctctgcacacctgtattcagtcagcatgcagtggactggggggagaggaagtagaggacttcagttttcttttaataatgtgacccagaaactgcacccagcacttctaaacacactccgttggcaaaaattcagtcatgtggtcatacctagctgcaaggaaggctgggaaatatagcatttagctgggtagccacatgcccagctaaaacttgaagaatttatttttcaaaaagatgaaacaaagtaaatttctaaggatcatattaacggtctctgtcacatattttcatgcatagtcatgtaaaaacacaatatatcttactttctcagtgaaaggtcagctaggtgggtcaacttgacaacatataaactgatgttcctgctaagaatcagcagaggaagccagatgcagtggctcacacctgtaacctcaacactttgggaggctgagacaggtggattgcttaaccccaggagttcaaaatcagcctggacaatatggcaaaacccatctctacaaaaaaaaaaaaaaaaaaaaattagctggctgtggtgtctcatacctgtagacccagctactcaggaggctgaggcaggaggatctcttgagctggagaagttgaggctgcagtgagtgaagattgtgccagtgcacccagcctgggcgacaaagtgagaccctgtctcaaaagaagggaaaaagagcagaggcaggagtgctggggtgtgtatgtgcaagcttatgttgtggcttgttttgtctcattctcctttctcaataaaagaggaagcagcaaagaatgaaaggaatgagggtaaggtaaatcaagaaaacaaaggggtggtgtgggaagagaaaaagaaaaatgaaaacccactggggtatacattcagaatgaaaatgaaagaaaatatttgagtatggcagagtcccattaggatgggactacagggctagatacaagaagagccatggaaagcaaacatcacataagtcaaaattagtcctttgaaattatacgtaagatataacccagataccagcttcaacctagccttatctaaacaccctacccccaatattcctgtaagtgaggaatagaaacgaattggcatgtatcaataagtctagcccttctagtttccctccagcattggaagagagcaatgtttcctcagttgagtagcagataaacccttggtttgctctgacatgcaagtacaaaatcttcatcatgtgatggagtaagggagctgagaggctcatctcatgctcactcaggcacatgcatgcattgaatggagtagcaagtggcccaaatcatttaaagcattacattctctgttttttctcctccaatagtgtgcagttgtgtttgatttttaccaaatgcacctctcttggagcatctatggtgtcaggaagcttgctatatcacataaaaagctttttgtgatgcttgtcagctcctgctggtataaaatgccccacttttacagaatgttttggcagggatggagttggggtgcagataggacagggcaaggagttaagtgagaccactagaagtcctttgtgaggtctatgtagagcaggcttctacctttcgcagaatattcataaattccatgaaatgttcaggaaaacttaagggacctacccacatccactgattttcttgaggctaggagacccataggaaataacttgaaccctctctacagttgtggttgagatatttgccaatatgtctcatggactgggtgagagaaacagggaagagttccaagaacaagtcaccatctgtggggcaggagtgtgggcaggtgggcacagtcacagcaggatgaaccaaatggtgattctaggtgctacaggaagctcttttctcctcctcttcctcctcctcctccttgtcctccccccaactcctgccaacactatcctttgaattttccaaatacactaagctcattcgctccccagggccttcatccttgctcttcatgcctgggatggttgtcctcagatctttgcatggctgactccttgtcttttaagggaatctctttaaagaggctgctctcactaccaatttatgtttcccgtcactttcgcctgattttgttttcttcatagccttaaacactctctgaaattctctcgtttattgtctgcctcctacagctagaatacaagctttatgagagcaaagactttgtctttcttatttgccattttatcttcaattcccagaacagtgcctgggcatagcaggcattaaatcattatttgttgaaaaaaataaagtatcattgaagccccaagaaccctggtgtgagctctctaagagagctggatggaggaaggggaaggtatttctctctcagccagagagaaaggtgagcacccaagggatggcagacaggaggcaaggagctccaggtggtggcagcagagagaaaggatgccagtgccacaggggcgttggccagaggctgagggcagatggcctgtgtccagagtgcagaccactgggagggaagagagagcagttgcatcatggtggaagctgaaacgctgctgctgtggcatgaaaagcagagcaacagcaggcaaaagggcagaggcaaggggctgccaacctcagaaactggctctgagaaactggctctgagtatctggagaagtaggcctgaggggattattgagccatcaaacctagacatcaattattaaagtgacattccctagaaccagcacattgtggagtcatttgtagtactttccaaacctagctatgcctttggagagtgtaaaaactaaactaaaatttaatttaataaaaaaacttcctgggccccaccctaacaaaaggctggattccaggaatcttatattcttctttcttttttcactcttttaaaggaaaatgatgagacacaaagaaaaggtggcccttttcctatgagcatgcttccccatcaccacctctcctagccccagccccagcctcccacacactttagcacctggtcacatcattgccctatcctgttactatgggacacactcatttagtgaccagtggaatatcctcaaagccaacatgactgcaacatttcccgcttggcagtagggtgatggggagaagagaaccatgagttttccttaggtggccacaatcacagactggcgaagcttgagccagggctgacttgcttgtacttctctgccaccaaagtctgcctaccatgtaactttcacacatctgtccaaggttctgtcctttggaatcaaggaaaataaggtctcccctgggccatatgtcagcccttgagatgtttgtgaataaatagctgtcatggcttctcttctgactaaaatgccccatttctttaaccattctttgtgggttgcagttgcttgctcccttgtactttgtgccccagatgtggtctgttaggggcaggacatgatagaatgattatctccttgtcctggacattgtggttgtgtgaagcttgccaggtcttgtgtttgctattttggcagctgtgccgtagtctggaatcacactgagcttgcagccaactcaaattcttgcaattttctggaaggcctgcttccctctttaacctagactggtgaaaatggtccttgaacataaaatttgacatggtttatcgttagatttaatccagcatgtttggatccatccctgtagctgtcagccattcatgaatctgtatttggtccctgagtgatttattcacataatctaattttggattatgcacagtgttgataagaaggtcttgtaagtctttatcaatgaagttgataagaatattgagcaactcagagtctaggatagagccctctgacattccttagagtctttctctaaagctgatatttagctaaatagttttgaagtcaagagatctgctgtcatcccaatgacatttacataccaactgccacccccagcataagccacctcagtttagttctgaatactgtttcctgagcctgctggtgattcttgtagtttaggcagagtgttttctttctttgcttcaaaattagtcaggactctttccactgcaagtgataggaacaaagtcaacctaactaaagcagaaaagggaatgcactgattcccatatttgcaaagcccaggggtggctcttgcttcaggcataaatgggtctagtgactcaaatggggtcattccatctctctctctctctctgtcccccgttccctccttcgctctatctttttgtccctcgcttctaccttctctgtcttgctccttccatcctcaatctcttggctgtgttttgccctcattttttcttactacagataaactttctccaaatgacagggaggatagctgccagcaaccttcagtgaaaatcctcttagctcatcctgtgactaaaagaaaagcccctttccttctaactacaaactgaaacatcccagggaagattgtgattagtccagtatgggtcacatggccagggcaatggcatggagatagactggatctggatcacagtcacttttgtgacttgatatttgaggaaggaggatgaactgtgattggaagccccagtgaccacagggtcagagtaggggcagcagtgggggtcccccagagcttcctgccctcatccacattcccagctacgttctcttggctgacacatctctacctccccagaggcatccttcccattattcctcctgctatccacgtgttgttcagctcaggacccattcatctggctctgagctgttccacgacgaggtcacacaatggggaaaggattaacttttattgagctgctgcaatgtgcttcattgcattatctccttgaatcctcatgacaaatccacgagatgataattatgatccttatttcacagaggagactgatttatttttaatatattttattgatttagcaaatgtttttatatacttcctattaccaattcattaattgtcatgatgacaacaggaggtaaatactattaaatattactgctgttttacaggtaaggacatgtagacaaggagagcttgagtaacttgcccaaaattacacataataaacagggaaatttgaaccaagtctgttaactacgtctgttatagaaaaatgacccttacaaatttaagtatgcatgatcttcagtttgagtgggagaaacttcatctctgcctggggatgctgagagcactggctgaagaaggccatccaggggaacagcataatccaaccccaccatcctcacctgctcacttttggattctcagtcttgccttccagtcttccaggccatcaccagcaaatcttttcttgcctgacctggctaggtggcctgaattactgtgccaaatttttaaatagaaatatatgagttgcagctcctcagagctctggaagttgtgcagaatagaaaggggagcactgtgactaacttaatgtcccaacagtctttataactccatgttataagttaaagcagaagctgacgcgcattgtggttgaggtgtgtagcaagactggggcatttcagtaacacatagcaggtggatggcaggggctggccataggatggagctgggactcagggtcttctcattgaggttggagttctattaataattctgaaacccaagagacagagtgcggaggaagatggaactggacaagatccagtgagggtaataggcatagaagatgaatttgggtaatagtttattagagtttttgttagaaggttgacacaccaacatttgaaagacccagaaagctatttggtaattaggtagggtaagtgtacccaaggatggaaagaactctgccctgggtcgggatttgaggccaggctctagtgtgaaatatcagtcttcatataaataaggcaggcctttgttactgatgtggcttttagggcaaagctgtaattcaataattacacaacctccagcctgatcttcctaaaccataaatctgaatatgaaatgtcctagcgcaagcccttcagtactgcctcatcccccctccccagggtgatatccacacttcttatcaaggcattgaaggcctttgatcatcttccccctgcttatcttcctcaccaagccttttatcacacccttcctcccagaatgcaacttatgaaatacagaatcagttctggtttccagggccaagactggcccatcacacatttctgctacatgggatgctgttgattcccttgtccactggataaactcctattcttcattcaacttacaacacagatactacctcctccttgaagcctcttcgaattcacccagatagacgcagatgttctctcctctgcaaccccagaacacattgttcatacctccataacacactttacatgttataaaaaatatctgttgctatattttttcccccaggtactagactgtgtgctcctagagagcagacgccatgtcttttttactctgtgtctccagggatgtagcactgagctagtgtagaccaaatgctcagtaaagataaaaggatgagggaggttgatgtattgctcaaggtaacccatgggaactttggaaaagggaccagaataggaatgagaaaactatgcatttaagacaaataaaaccttttttgttcattcattcaacaagtatatattgagcatttactatgtgtaaagtggtatgctagatgctaaagatgcagtggagttcaagacaatttgtttctgcactcatggagagtacaggttattaggggagacaagcatttaacaaatagtttcataaacacgtatggaactgaaattgggtgagaggtattccagaaaaggggtattgtgtggaggtgaaaggggcagggaggtcctcacagggcactctgagtgtcatgggctgtaggaagccttgctttattataaggacttacccaaatctctccataacctgaacttgtaagaatcgtccccaaagccaattctctccattgcaatccttccagtggtccttcattggcacctactagagtttttctttggaggttcaatcattgttcctgaggaccagctctttgaaacacattgttgggtaatcagcctgatgagcattatgatcttttatcataatcacaaatttcatcataatcttcatccccaatatcaccatcaccactcaccaccatcaccatcaccatcataaatactaccaccatcattatcatcatcatcccttaaaattcttgaacagtttacatgttccaggcactgggataaatatttatttaactctacgttcctataagaaaggcgatatcatcaacctctttttaaaaataaggaaatagattaagtaatttaccagagatcacataagtggtagctctgggattctaatcctaaatgtttgctgttaatcagttccccggatgtactcacaagatggctctgaatggaattccttttttttaatccttcataagcatttttctttaatttcttggatctcttaatagcctctcaggggaggcaattgggaggagtcattagagagaagattctattatttactgccaagcagtcattttaggttattactgggactcagaacacactgcacatttgtacctttcagaaggaagttgtataatgaggttctctggaaagatagagtctcctctattccttcaaattatactgtgtaacaacatcatcaccagtgataattatggattaaaaccccacactgagttcagcttccagagccttcatctcatgtgttatatttaatagggttgtgtacaaccttagctttctagaacctacaggaatgcagtattatgggaagctgagtttatgattagccctttaagcacactgagcagatgtacaaaagttgggatatttatcattcagaaacattgtttaggaatcttttaatcaaaatataacttacataaggaaaagtttacaaatgatagagtgtggtgaattatcacatgttgaatatactcatgtaaccagcacccagatcaagaaacagatcatgactagctcttcagcagcatcccttgttctgcctccatgttgcactccctccctttcctgtacatgttactactgtcctgacctctagcaccatgaattactttgcctgtttttgagctttatgtaaatatatataaatgtaatcataccatttgtattctcttgtgcctgtcttctgtcacttgagattacgtttgtgagatttatccatgttgcatgtggcagtatgtgttcattttcctgcctgtgaggcatttggttatatgaatatgccacaatttatatacctattctagggctgaagggcatttgagtatttccacttggatgctactacaaataatgttactactaatattcttataggtatctttggtgcacatatatatgcatttctgttgatttaagatggtattgctgggtgatagggtaagagtatgttcagcttcagtaaacactgccaaagaatttagcagcaaaattgctaattttcacttctatcaacagtgtgtgaaagttctagttaacatcactggatattgttaattcttttaaatttagccaaactgttagatacgcagtactatttcattgtagatttaatttttatttccctattgactactgaggttgagagcctttgcatatgtttattggccattgggcaccttcttttgtgaagtattagtttgtgcatttgtctttcttatttttcttctgttgagttgtctgtctttttcttattgatctgaaatagttctttatgtattttagataaaagtcagtttctggttatatggttgcaaatatcttctttgacactgtgacttgcttcttcactcttaatggtatcttttgatgagcaaaagtttgatatcaccccatttatatatcttctcctttattgttagtgcttttttatgctctatgtaagaaatctttgttactccaaggtcattcgcattttatttcatgctgccttcttaaaattttgttttgcttttcacatttagctgtacaatctatgtggaatttactctgtgtatgatgtgagttaagggccaagatttacctttttctgcatggtcattcagttgtcctagcaccacttactgaaaagattatcttttctccattgctctgatgtattaggttggtgtgaaagtaattgtggtttttgccatggcaaaaccattaatggccaaaactgcaattacttttgcaccaacctaatacatcctttgtcataaaccaagcttctgtatatttgtggaactttcctggaccctaagctgatcaactggcccatttttcttaccttgctatagtccactggcttagtttctgtagctgtgtaagtcttgatatctgggagtataagcccttcaattttgcacttctttcattaagattgtcttggacaatcttggccctttgcatttccatataaattttagaaccagcttgtcaatatcacaaagagcatactgggattttaatttagattgatgaaacctatagatcaatttgaggataattgacatctttagcaatactgagccaaccagtctaggaacactcaagtaaatttaatagcacgtcaactccgcactggtcactgtgctgagcttagatgggttcttacccttgaacgtcttacaaatgtgtaaagaaacacataaacacaaaatataatctaattcgatactcttatcactgataataatgagttcatatttactaaggactttacacatattacttcatttatagcttgcactgatactttgaggtaagtgctgttactatgcctattatgtaggtatttttaatttcagtagggtccaagagaaaaggcatgcaggtctttatggggaaatcagaggaaacatcacacaaacggtggagatttggctgacttttgaagtttgcagaatggaggagcttgaccattccaagttatatgagtagctcatgaaaaaatacaacagggcgacatgacatggattttcaggaaacttctagagagtgaatccaaggattgaaatgtagtatggcaggggaatgggagcatggttagtgaagctggagaggcagagcctgagggcttcttggtctgcggagtttgagctttgtcctaaaggcagtggctgtggagcagggattatctgtcttggctggggttccccggaggctgattgtattcatttcctaggactgctgtacaaattactataaattgttggcttgaaacaacataaatttattctctcatatttctggaggctagacatctgaaatcaaggtatccgacggtgttttcttctggagggctctgagagaaagttggttccatgcctctcgcctggcttctggtggttgtcaacaggccttagctttctgcggcttgtaaatgcatggctctaatatctgcctctgtcatctcgtggcattcttccctgtgtgtctctgtgtcttttcttatagggacataagttgtatgggatttagggcccacctgaatccagcattacctcatcttaacaaactgcatctgcaaagaccctatttccaaatgagttcacattcccaagtatggattagaacttcaacatatcttaaaccgtaacacaagcctcagatgaggattcagatgaaagtgattcttttaaggaaatgctcccaggggaaactagtaagagagtaggggaagcaggacagcaactgggaaggtgtcctgccagcctgtgatcccaggcatggtcccttcaggtagtttcagtcagatcctgcggggccattttggagtgtaaagtgcctctaagaattgtcctcacctgatgcaaggcagctggacctttcatcttaggcagagtaggctccagtaacctgaggaccagggacacaagagccacaggggctggccacgggaagcagaaatatattagtgccagggtcacattaaaatgtaaaaaggtatttgaagaaatctggatgaagtatccttagtgtttgttactttgtcctctgttccctttcctccagaattgtgtataatggccttgaagaccacccaccctcaccctagagagtctaagactgctttttggctgtctgtctgtccttcagagattcccagctctgtcccctgacagcataaccaccattttttttgcttgacactgaacactacacttttcttactcttctttgctttattgtgctttttttcccctcattccttctttttttttttgacagagtcacgctctgttgcccaggctacagtgcagtggtgcaatctcggctcactgcaacctctgcctcctgggttccagcaattctcctgcctcagcctcgtgagtagctgggattacaggcatgtgccaccatgtccggctaattttttgtatttttagtagagatggggtttcaccatgttggccaggctggtcttgaaccctggcctcaagtgatccacccacctcggcctcccagagtgctgggattacaggcatgagctgccgcgcctagccccttctttctttttttctatctgatcttttacagacatcagtagctcctttacttttgtgggataaccggccaatcacagcatgtcatttaccttctttatgtcttagagttctttgctgtgtcattctgttggtggctcaagagcagccactacattatccaagacagtggttttatttgttggagttttagggtacttctttttattattattattatattttaagttttagggtacatgtgcacaacgtgcaggtttgttacatgtgtatacattagggcacttcattttcaagactaaaactagtttaaggaatttggaagactaaatgcccctctttaacaggaggctgcatatcatactcacaaatattatatgtcaaatgaattgattttttaaagtttaaaaacttaataatcagtcaatatttgtggaagatctataacatgatgaatatattcggtttgtgaagccttggatatagtgttaaactggggagtgggccttcaaatctgaccctaagttgcccactggatgattttatgatcttaggtgtgtctgttgacctttctatgttttactttcctatccgtgaaattggagagctgaattagaagatacttgagatcccttgaaggtctaatagtctgtaactccatatctaatgtccaggatcttagcacttttatgcaggcagtaaagtaatttaaatctcaatttacatcaatttaaagaaacttgaattgaacatctattagatgccaggctctgtgctaggttctggggataaaaagagaatgaaaacccagcccctctcctgtattagcacagcccagtggagaaggcaaatcaacaaagaattgcaattcagttcaaaaaaatactgcaataaaagatttccatctcaggagactgggggtccaatgggatggaggaccatgattgccatgttgagaagatccttgagctagattttttttgttgcttttgtttttgttttttgagatggagtctcactctgtcactcaggctggagtgcaatggcacaatcgcggcttactgcaagctccacctcccgggttcacaccattctcctgtctcagcctcccaagtagctgggactacaggtgcctaccaccacgcctggctaattgtttgtatttttagtagagacggggtttcaccgtgttagccaggatggtctcgaactcttgaccttgtgatccgcccacctcggcctcctaaagtgctgggattacaggcgtgagccaccgtgcccggccgagctagattttaacggaaaaatcgtttcctgggtagatgtaggaatgaagagtataacagacttataattccagctgctgtaacaggtggccctccacaacataagtttatttccagctcatgcgaagtacagtatggatgtttctggtcagtaggtgattttccgtggggttgtttaaaatccccagtttccttccctcttgtggttccacggccctgctcctgggacatcagagtcttctgctggaccctgcattaagcaggcaaaggcaagagagtgagagtgcagggtcatgtggaaagcttgtacaggtcaggcttggaagtagagtatagcagtactcccttatccgaggttttgctttctgtggtttcagttacctgcagtaaactgtggtccaaaactatcaattggaaaattccaaaaataaacaattcataagttttaaattgcatgctgttttgagtattgttatgattgtgtcttattagttattgttgatttcctactgtgcctaatttataaattaaactttatcatatgtatgtatgtatgtatgtatgtatgtatgtaaaggaaaaccatagtaagcatagggtttggtactatccatgatttcaggcatccatttggggtcttggcatgtgtcttggccttatctgcagggggctactgtatatcatgtctgtccatgacttccactggcagaacttggttataaagctgacttaactgcaaaggaggctgggaaatgcagtgtagctgtttccacaagaaaaatgaaatatgttttgaagaacacacagcagcctctgccacaaaggtcatcctacaggattttgtgctgtgaaggactagttttctcttgggccagtctaatggaagtgtaatgttagacaattgtgaagattgagtttctgaccagggactatctttatcaaattgtggttattgggagagagctcaccacacccctggttgggtcaagaatccccaagtaagatagcagctcagatatttaacaggttctgaaatgtaagagggagctgggtgaagagggtaagagttctcacctcaatggatgaaggcctcaacactgtccacggcctctgtaactcacaggtctgggatatcgatggagaactcaggtctatcccatttgacaaatggacaataattgattcttatacttaaaacctgcttttttctctctctgcagtaacactttcagctgctcctccctcctacttcagaggattcacattaattgccctcagagagaacagagagggtgataaggaagaagaccatgctgggaccttccaggtaagaccctgcctgggcttattcagtggccctccctgccctaggaggtagaggctggagaggtacaagtgtctcaggtggcttcccatgcagtcccttgaccgttggccaacgggggcaggtccatttgaaagggtcatcatggagcaagcagcaaatgccgcacacctatctgagcaaggttggccatggggcaggccttgttttgtctcagcagatcacggggctcttctctgggcccacagtgtccttcagcagccaagcgtggggagagcacttggagccctggctaggcctggctgttttgcctgcacaggcatttcgtgattgactggttaattctcaaatgtaaacggaacaagagctcgggaccgccaggctggagggagttcaaagcacaggagaaggactattaagggaatgtagagattgatttatgagggaagattaaaagaattaaacatgcttttcttggccaaatgaacagggccgagtttaagaggtggtaatggtctttaaatgtcagtcctcacagaacaacctcctcaaggggaagcttcatttgactttgcatgaaagggcacactaagacaaaagtgggtcaagaaaagaaagggaatcgcacagacaaggaccccgacagtgagtcatatttcactgtggaatattcttccaagggaagtggtaggaacgtcatcccctttcagaggtttagaaaagagccggcaagttgtcagaacacatcccagaaggactggagtgatcctaggaggaggcctggccaaatttgctgtaattacttctcatctcagatttccattgttctggaattcatttttatctggcatttgcaaattaagaagaaaaaaactcagagaatacttatacccatagctggctgctggagactctggtgcaatctgtgggctccgtggaggaccctgacccaaatacctcccttatccaaaggcatcttttaatccttgtggccaggttgtaatttttaatcctgtgatttaaattatttttctgctctctgggattctaggttttgggcctggtgagacttaattccacgctcaccgtaatgtccttctatggcaaagaacctcttggcatgtatctgaaagggtgacccaataataatactagcaacagccaatatttgttgggtacataccatatgccagacactatgctaagtgctttactttatcttagtttatcctgtctttgtttagtttatctttgtttaattctcaaaacaaccctagtatgtaggaactattatccccatttttggaccaggaaattgaaactagagagattaaatcacttgcctaagcttgcttattgcttgttttagtccattttgtgtttctctaacaaaacacctgacactagataatgtataaacaatagaagtttatttcacttacttgacatgagactgggaagtctcatatcaaggtacctgcatcttatgagggccttcttgctgcattatcccatggggaaaggcagaagggtaagagaaggtgagagcaagaggggtccaaactcacctttataacaaatccactctcaagataactaatccactcccacgacaaccacaatccattcacaaaggtagagccatcacgacttcatcacctcttattaggccctacctctcaacactgttgcattggggattaagtttccaacacataaactttgggggacacattcaaaccatagcagcactgttctggctaaattcagtaagttgatagtcttctctgactcacagttgtttctgcttagcttaatccttgttcttgcaactgattggtgaatacagggccctgctcatagtgggcagcgcataaatatttgctgaatgagtggataaacatttgactctttctgctagtgtccagacctcagtcctatttggaactgttgttgaactcctatctctgtatgcatcctcccttcttcctcctcttagagcttcagacatcctctcttgttacacagcagtggttctcagaatgcagtctcaggaccagcagcatcagcaacacctgggaacttgttagaaatgcaaaatctcaagcccatccagacttactgaatcagaaactctgagggcagggccctcacaacctgtgttttaacaagccttcagggtgaatctgatgcatgctcagatttgggacccattattctaatgagacatagaccagccctctaacaggatgtcgtccatcatcacgtcaacacatctgtctgttcctatctattctctcattgtttccaccagccctagagggatcaaagtgggataagaatatgaaaatgcctagcatatgataacgacaatagctaacacttaaacagtgcttgtgtgccagatactgttctgagtggtttatatttgttaactgagtttatcttcagagtgacatgatgaggtaagcattattatcctattttccacagaagagaaacttgtggcaaagaacaactaagtaactttcctaagatgcccagctctaagtgataaagctggggttcaaacccgggcagtctgtctctgggtacctgcctgtgaccactgtgtatgccatctctcagtgtatacctgttaaatgaaaaaataagggcccactatgacttttatgacagtctctgtgccaggtgctttatatgcattagccttttcttttttccccttaattcttgtagcaaccttgtgtggtcagtattgttatcttcatttttcagatgatgaaactgagtccccaaggagttcactaagttgactaagacagtccagcatctcaagggtccaaacactgtgccagtttcttatttctcaaaagttatctcctcacccctgccctgccctacccttgtgccatcaaaatgcacactccgcttgggttccaattgtctcagagatttgggggaaggaatcatagcccatgcccctcatcttacttcacctgctcctgtgatatgtggcccccatgctgtcccttccaaatctatcatgaaagtattttttctctgtaccaaagctgttatctttggagtccttgatttattcagcagcatttgttgagtgcctgctgggtgctaggcactgagttaggcattggggatagggtggtgagaaaaacagagatagtcctcatgaagcctaaggagtcctccttgtcatcatcccataaactgacctctgttgctgaaagtcaacaagtcacccattgaaacataagccaacaatcagaaagaacaaatgccattgtaattaaatatatatatatagtgatttaacaaatagataaagacttctgtttaacaccttcacttcaaatatgatgactttgagggcttaacaacaaccacaaaattctaatactcattcattgatacataatatttaacatatttgttggatacgtatgatattgttatatatatagaatgtgtaatgatcaagtcaaatatttcaggtatcccgtcactttgaatatttatcatttctatgtgttaggaacaattcaaatactctcttcttgctactttgaaatacacaatacattgttgttaactatagtcactctgaatattcttttttttttttttaagttctggggtacgtgtgcagttttgctacataggtatacatgtgccatggtggtttgctgcactcataaacccgtcacctacattagatatttctcctaatgttatctctcccctagcccccgaccccccgacagaccctggtatgtgatgttcccctccctatgtccacgtgttctcattgttcaactcccacttatgagtgtgaacatgcggtgtttggttttctgttcttgtgatagtttgctgagaatgatggtttccagcttcatccatgtccctgcaaaggacatgaactcatccttttttatggctgcatagtattccatggtgtatatgtgccacattttctttatccagtctattattgatggacatttgggttggttccaactttttgctattgtgaatagtgccacagtaaatatatgtgtgtatgtgtccttatagtataatgatttataatcctttggatgtatacccagtaatgggatcgctgggtcaaatggtatttctagatctagatctttgaggaatcactacactgtcttccacaatggttgaactaatttacactcccaccaacagtgtaaaagcgttcctatttctctacatcctctccagcatctgttgtttcctgactttttaatgatcaccattctaactggcgtgagatggtatctcattgtggttttgatttgcctttctctaatgaccagtgatgataagcatttttttcatatgtctgttggctgcataaatgtcttcttttgagaagtgtctgttaatatcctttgcccactttttgtttgtttttttcctgtaaacttaagttctttgtagattctggatataagccctttgtcagatggatagagtgcaaaaattttctcccattctgtaggttgcctgttcactctgatggtagtttcttttgctgtgcagaagctctttagtttaattagatcccatttgtcaattttggcttttgttacctttgctttggtgttttagacatgaagtctttgcccatgcttatgtcctgaatggtattgctcaggttttcttctaggattttcatggtcctaggtcttacatttaagtttctgatccaccttgagctgatttttgtataaggtgtaaggaagaggtccagtttcagttttctgcatatggctagccatttttcccaacaacatttattaaataagcaatggggaaaagattccctatttgtgtcaggtttgtcaaagatcagatggttgtagttgtgtggtattatttctgaaggctctgttctgttccattggtctatatatctgttttggtaccagtatcatgctgttttggttactgtagccttgtagtatagtttgaagtcaggtagcatgatgcctccagctttgtttttcttgcctaggattgtcttggctattgcgggctcttttttggctccatatgaagtttaaagtagttttttccaattctgtgagcaaagtcagtggtagcttgatggggatagcattgaatctataaattactttgggcagtatggccattttcatgatattgattcttcctatccatgagcatggaatgtttttccatttgtttgtgtcctctcttttgtccttgagcagtggtttgtagttctccttgaagaggtccttcacatcccttttaagttgtattcctaggtattttattctcttactagtaattgtgaatgggagttcactcatgatttggctctctgtttgtctgttattggcgtataggaatgcttgtgatttttgcacattgattttgtatcctgagactttgctgaagttgcttatcagcttaaggagattttgggctgagtggttttctaagtatacaatcatgtcatctacaaatagagacaatttgacttcctctcttcctatttgaataccctttatttctttctcttgtctgattgccctggctagaacttccaacactatgttgaataggagtggagagagaaagcatccttgtcctgtgccggttttcaaagggaatgcttccagtttttgcccattcagtatgatattggctgtgggtttgtcataaatagctcttattattttgagatatgttccattaatacctagtttattgagagtttttagcatgaaggggtgttgaattttattgaaggccttttctgtatctattgagataatcttgtgttttttgtcattggttctgtttatgtgatggattacgtttattgatttgcatatgttgaaccagccttgcatcccagggatgaagctgacttgatcgtggtggataagctttttgatgtgctgctggatttggtttaccagtattttattgaggattttcatatcgatgttcatcagagatattggcctgaaattttctttttttgttctgtctctgtgaggttttggtatcaggatgatgctggcctcataaaatgaattagggaggattccttctttttctattgttgggaataatttcagaaggaatggtaccagctcctctttgtacctctggtagaattcagctgtgaatccgtctggtcctgaacattttttggttgataggctattaattactgcttcaacttcagaacttgttattggtttattcagggattcagcttcttcatggtttcgacttgggagggtttatgtgtccaggaatttatccatttcttctagattttctagcttatttgcatagaggtgtttatagtgttctctgatggtagtttgtatttctgtgggatcagtagtgatatcccctatatcattttttattgcatctattgattctactctcttttctttattagtctggctagcagtctatctattttgttgatcttttcaaaaaaacagctcctggattcattgatttttttgaagggtttttcatgtctctatctccttcagttctgctttgatcttagttatttcttgtcttctgctagcttttgaatttgtttgctgttgcttctctagttcttttcattttgatgttagggtgtcaattttagatctttcctgctttctcttgtgggcatttagtgctataaatttccctctatacactgctttaaatgtgtcccagtgattctggtatgttgtgtcttcgttctcattggtttcaaagaacatctttatttctgccttcatttcgttatttacccagtagtcattcaggagcacgttgttcagtttccatgtagttgtgcagttttgagtgagtttcctaattgtgagttctagtttgattgcactgtggtctgagagacagtttgctatgatttctattattttgcatttgctgaggagtgttttacttccaattatatggtcaattttagagtaagtgtgatgaggtgctgagaagaatgtatattctgttgatttggggtggagacttctgtagatgtctgttaggtctgcttggttcagagctgagttcaagtcctgaatatccttgttaattttctatctcattgatctgtctaatattggcagtggggtgttaaagtctcccgctattactgtgtgggagtctaagtctctttgtggtctctaagaacttgctttatgaatctgagtgctcctgtattgggtgcacatatatttaggatagttagctcttcttgctgcattgatccctttaccattctgtaatgcccttctttgtctcttttgatctttgttggtttaaagtctgttttatcagagattaggattgcaactcctgcttttttttttttttttttttttttttttttttttgctttccatttgtttggtaaatattcctccatccctttattttgagcctatgtgtgtctttgcatgttagatgggtctcctgaatacagcacactgatgggtcttgaccatttatccaatttgtcagtctgtgtcttttaattggggcatttagcccatttacatttaagtttaatattattatgtgtcaatttgatcctgtcattatgatgctagctggttgtttttcccgttagttgatgcagtttcttcatagtgtcgatattctttaccatttggcatatttttgcggtggctgataccagttgttcctttccatgtttagtgcttctttcaggagctcttgtaaggcatgcctgttggtgacaaaatctctcagcatttgcttgtctgtaaaggattttatttctccttcacttatgaagcttagtttggctggatatgaaattctgggttgaaaattcttttctttaagaatgttaaatattggcccccactctcttctggcttatagggtttctgcagagagatctgctattagtctgatgggcttccctttgtgggtaacatgacctttctctctggctgcccttaacattttttccttcattttaaccttggtgaatctgacaattaatgtgtcttggggttgctcttctcgaggagtatctttgtggtgttctctgtatttcctgaatttgaatgttggcctgtcttgctaggttggagaagttctcctggataatatcctgaaaagtgttttccaacttggttccattctccccgtcactttcaggtacacccatcaaacatagatttggtcttttcacatagtcccatatttcttggaggctttgtttgttcctttttattctttttttctctaatcttgcctgctctctttatttcattaagttgatctttaatcacggatatcctttcttccacttgatcaatttggctattgaaacttgtgaatgcttcaggaagttctcgtactgtatttttcagctccatcaggtcatttatgttcttctctacactggttattctagtcagcaattcatctaaccttttttcaaggttcttagcttccttgcattgggttagaacatgctcctttagctcagaggagtttgttattacccgccttctgaagcctacttctgtcaattcatcaaacttattctctgtccagttttgttcccttgctggtgaggagttgcgatcctttgtaggataagcggcattctgatttttggaattttcaaactttttttgctggcttatccacatctttatggatttatctacctttggtctttgatgttggtgaccttctgatggggtctttgagtggacgtgctattcctttctgtttgttagttttccttctgacagccaggcccctgtgctgccagtctgctggagtttgctggaggtccactcctgaccctgtttgcctgggtatcaccagtggagactgcagaacacaaagattgttgcctgatctttcctctggaagcttcatcctagaggggcacctgccagatgccagccagagctctcctgtatgagatgtctgttggttcctactgggaggtgtctcccagtcagaatacacgggggtcagggacccacttgaggaggcagtctgacccttagcagaacttgaatgctgtgctgggaggtccactgctctcttcagagccatcaggcagggccttttaagtctgctgaagctgcaaccatagctacccctttccccaggtgctctgtcccaggaagatggggtttttatctataagtccctgactggggctgctgcctttttttcagagatgtcctgcccagagaagagaaatctggcagtctggccacagcagccttgctcagctgcagtgggccccacccagtttgaacttcccagtggctttgtttacactgtgaccataaaactgtctactcaagcctcaggaatggcggacgccccttcctccaccaagctcgagcgtcccaggtccatctcagactgctgctgtgctggcagcgagaatttcaagccagtggatcttagtttgctgggctccgtgggggtgggacctgccgagccagaccacttggctccctggcttcagcacccctttccggggggtgaacggttctgtctcgctgctgttccaggcaccaccggggtatggaagaaaagaactcctgcagctagttcagtatctgcccaaatggccacccggttttgtgcttgaaacccagggccctggttgggtaggcaccagaggaagtctcctggtttgtgggttgtgaaaaccgtgggacaagtgcagtatctgtgccggagttcctcaggctcagtccctcatggctccccttgtgtaggggagaaaattccctgaccccttgctcttcctgggtgaggtgacgctccatcctgctttggcttgctctctgtgggctgcacccactgtccaaccagtcccaatgagatgaaccaggtacctcagttggaaatgcagaaatcacctgctttctgtatcaatctcactgggagctgtagaccagagctgttcctattcagccatcttgccagcctcccctaaatattctttaaatttggttaaagattgcatttgtggctctaaaagtgactttgagagagggttactttgcttctttatgagtgaatccttatacagagaacacagactcacaaaatacaaacacaacaaaagcaaattttaatgctgtctttgcacctccctagacttagtggcgagggaatgggcttcctagtaccagggaaagtaagaattacagctctcacctctccaaagaaggccgaggagaagggggtggggctacctgctctggccccaacagcgggttccagcacaacagcattggcacacactagatgtcagaaaacacagagcctctctttgatgagatagctgattcggtgaaagtggcaaggaactcagggactcaattgcctgtacaaaagtaacccaccaatccttaaaaattatattaccaaaaactgctccctggaatgctgtggcccagccagctgcccagctcactctcttgtctccttcaggtctctgatcagcggtccctttccagggagccctgccctgatcgtcttatcaggcacttcattcctcctcccaccctgagcgaggctctttctctctctccccaacttagtgtttttccattgcagttattgccacctgccatgctattttacttattaacttgtgtgctatctgtcaccttccactgaactataagatctacagggcaggattttaatctatctcccttcagagtatccctggcagcaactatgaacaggacagagcaggcacatgaatatttagggacagaattttaagcacagcatttgcactaaaatttaagctgctaatttataatactattcattgccttgttttatttttaatttaagtccttcaggcatcaactagtttaggtaacactctgccaatcaaaggaaaaaagtctcaaaacaaaaggatatttgtctgagaagagcagatcaataccatgcaagcaagtatcttttaatagtcttttatattcataatcacctgtttttaaactatttttgtgatctctacattaacaataaatatttagtggcatttaatgggttctgagccacgttagaacctaaaagggcttttgacacacttttctaaaaataaaatgctattgcaagcttgttctcaggaattctctttgagttcataggaaaacctgctctcattacactaacctaagcttaatcagtccccttataagatgttaggatttttaaaactgccattcactattataaataatggagtagaaacagtttcttgcataaaactttttctcatttggtattgttcactaggacaggttcctagaagtataatcacaaatgcaaaggatatggacattttttatggttctaatatgtattgccaagatgatcccccatccccacacacacacacacaaaacctgcactcaacaaaatggaatatgggcattccatcatggaagtcatggccactgatgtgaagggaaacagacatatgagatcaggactgggaatcacaagatttgagcaggttaaatcgatagatcaaatttagcaagatgaaagctaatggaggaagagagaaacacagaaaaccacctacttggatccaaataaccaattgcacgagtacaagatgagagatttggatttatggcagcacatgaaacaaacaacaataacaagaaaaatactctagaactttcagttgccattaagtaagttaagaatgaatcatccatgagataggaccacagaaaactcatgaggtcttaggatgtatcataggagcatagtggccagaacacaggattttgattttcttatgagattcttatgccattctgagagagcccacaatattccctttctttctctatatagtataactttcagtgaatgaatattgaaatataaaatatacagtgttttctttctttcattcatttgttcattcaagtatttccatatcattcatagtacccagttctttttcttcagagtagttattgaaatttataattatttgtaggattatttgtttaatattactctgttctaccaaactgtagggcaaaatcatgtctatttaattcactgttgtatttctaaccactagcactgtgagtgttacatagtggacactcagtaaatatagtaagtatttgctgacatgaattaatgaatgcactaatgaccagctatgcaaaatgcaacatactaggctctgtgatatggagatgaataaataagacatggtatgttagtctgttttcacactgctataaagatactacctgagactgggtagtttataaacaaagaggtttaattgactcacagttctgcatagctggggaggcctcaggaaacttacaatcatggtagaaggcaaagggggagcagtcaccttcttcataaggtggctggagagagagagcaagacaacaaagtgccacactttaaaaccatcagctctcgtgagacctgactcacttatcacgagaacagcatggagaaaaccgcccccatgatccaatcacctcccaccaggtccctcccctacacatggggattaaaatttgagatgagatttgggtagggacacagagccaaaccatatcatggcccctggtattaggaggtcaaagtctacagaagaacttcccagttcagtattttatgtacactggtggatcacagataggttgaaggagaacccagatgtgtatttccctagatattagggtggcctcctctgtttaccctagggaaatattaccattttctatatgtgacatggagtcaagagacctgttagaaagaaccatattgcagcctgctagatgctaaaattgctgcatctgtgcaaataagaaaacaatcatttgcagaaagtgggtagtgagtgctgatttgggagcacagaaaggacatttacagagacaataacctttgagctatctcttagagtcgttgaaatttcaactggacaaggagtgaagagtgtgtgtgaagaccactctatttttgcctcacacctctattttaaaatttgccatattttaatgttttactatatcttctttaacaagcacctagagcctcacaagggcctagtaaaagttttttttttttaataagaaatgaaccaggggataaatgacattctgtcccttccccttcccttgaggagctcacttggtgtaaaatgcctctgcagagctataatgcacaaacaacacattttaaaagcgatgtcaacacctcttgcttaacacttagttttcttgcttaaaattgccgtgtgaaaagtcatttgtaagaagcacaagaagcaatgtgcactgtgagtgcctggaatggacattgggtcctcacacttctgcagccctggtctctagtgcctgctgccagaaaagatgaaaaatcattttccttcccagcaagaaagcctgagtctgggaaccagaggtattattaagacttaagcatcactcctctcaacagagcacacttgtgttttgtgttataaaatacagaaaaggataaatacagagaaagataaaaaagaaataaaaatatgtcattttataatctagagataatcattaacatttgggtatatttccttccaggttatatattatatagaaaacacacctatgtgtgtatatatatatatacacacacacctatatatataatttttgaacagaatattggaaccattctctatatagggttttatatcctgttttatttttatgggaacattatattgtgaacatatttcaatgaaattaaatgttccacatgatttttaatggctttgtaatactccatcatactgttgaattataatttattcgaagattcctctattattggcaagataggtggttctaattttcttttctttacttttatataaaacactgcagtgaacaccgtaacacataaatctttgcacctgtatttgcttatgataaaagcaaagttttatgcatctgtatttgcttatgataaatgaaattatagggtcaaagtaaagtttctctctctgtacatactcacatgtatgtatgcacacatgtatatgtatatatgagctctatttctggaggcagccgtttgggttttgacagtgtcagtggtgggcacacaggttagcatcacagtagaaagtattcctattttcaggctgctctaactactcagaaaggaccatgcatctagcttagctttgctatttaaaatatacagcgagtatgtggaaagactttgggttttggaatcattagatcattggactaggagtcaaattctgccctactagctaagtcaagaagtctctgaatttatctgaaacttacttagtcccttcatctacaaaataaaaatgatcaaaataaaataatgtatgtaaaatgcccaacacagtgcctggacataagggaccctcaatcaatgcctcctacttctgagccagcagcctagggtgcattttccacatttctgtttacagtgaatcataaactccattcctctgtagatttgggcatttgtggaccactaaggagcacatctgaatcttgtcaaaggtgtaactactagctatctttccaactccacaggtgaggagagagacagtcttctctagttcattctatctttattgtaataggattgggatcgctgtaaaataaaatgaaaaatttatgctatggatacatgatgcgcaaacaaaatctgttcaatgtgggtggttggctgggctctcaattgctggttttatgaactacttccatatagcagcttcaccaaaaatggaatttaaattataccttggcaaaaggctccgcaccagaggtatgaatggatagcggaaaccacactagatactattctagttgcttcgtatactttaactttcttcctcttggctggaagttccatgagagcagagacatctttctttcacaacaacacacacagtgctgggtgccatgctgaacacataatcaaagctgagtaaatattagtcacataaataaatgtattaacccctcttcaactcagattccactgcctgcccacatacacacccatgaagtaggcactcttattattattcccattcacaggaaagttaacactgagggaatcagagcattgatcgatggcacagagccagtaagtggcagtgaacaaagactaagccaccaaaggcctgtgtcattttctctattctgcatctcttacagctctggggagagatgtatgggagagacaagacagaaatttactgctaaacccctaaaatcctttctgggttattccaggggtcataccaggtttacagcttcacagatccaccaggtctcttccaggcctttgaaatgccatctcttctgtctttcctgacattcacattttcctttcatcccatttggaatctgtgcaccctgcctcctctctgagatctcaaacacttggcacatccctttgttctagttcttcgctcactgtgttaccctgatgagttaaattcccattcccctacaagattctgcaaagaggcagacaactgggccatgtctgtctctgtattcctgtggccacccctgtactcccctggcctcaccaaggcctggcacactggccaggtgataagtgctttccaaattgatggatatctgctgctggaattgctggccttacccacttgtttgcaaacgttaattggtctcctactttcttgcatggaactagcattgtttccacatctattttctaaaggtctagaaatcattttcaaatacatgatagacttctttaatagacaatacataacttttatgcaaaaaagaactttttcatgtatctattaagtagttttttaaaaagccaataagttcctgtggccttgcaatcctctcatctttaaaatgagagtgatgagcctccattccagatctaactactttatgggatagctcttaattctggttttgcaaacacttaaagccgttgtgtttgttttttaaaacaggtaaaatctaaagagtaaatgggtcatagtttactgaaacagtatcctattgtaggatatttagagaatttttaatactataaataatttagcagtatacattcgtataaagaaaaccctcttatttcatttatgagtatataaatgacactgtcgtgtgtaaggcatgttctaggctctgaggatatagctgacataacagacaaaaatccctacccctttggacattatacttctatattttagatcatttccatgagatacagtcccatgtttctggatcaaagagtttttaggctcttgatacacattgctgtatcattttctttcttttttttttttttgagatggcatcttgctggatgcagtggcatgatctcagctcactgcaacttccacctcccgtgttcaagcaattctcctgcctcagcctcctgagtagctgggactacaggcacccgccatcacacctggctaacttttgtatatttagtagagatgggggtttcgccatgttggccaagctggttttgaactcctgacctcaggtgatctgcccacctcagcctcccaaagtgctgggattacaggtgtgagccaccgcgcctggcctgctatatcactttctatcacacctgaccaagtaggagtttgagtaggaatctgactcagagcttgcttttagagagtatataacctttgccaagttactttgtcttggtttttcccttggacacaaactttctctccagttggcccccagctggtaccttatgtcctatagtcctttgtgttcaggaggactgggtgttggctggaggaagtaagtttggctggaggaagtaagttcccatccttctaccaggtggttactaaacagatcttgcaaatcctgttctcataaaattacctctttggaataaagttcaataccttagatttttgccctgacaaattaattattcaacatggttcatctctctagcattccaaggtttttctatgttagacatcttttatccgccatggttgatcactgtcttcacagcattatgtcatctgcagagtgaacaggtctgtctccctaggcatggatatatgcctcaaaaactctatttcctcatccctctacctgggatgctctcaggtagccacaaaactccctccctcacttctttccggtttctgctcaaatgtcacttttatcagagtccatttctgaccatattttataaagcaataccctcatcattctaaaccccatttgccttcctttattttattcatctgacttatcagccccagacatgttatatgcttgattgcttattagctattacccctactgcaatgtgaactccacaagggtattgctttgttcagcactgcatctgttcagcactataatagggcctggcacataataggtgtttaatatatagctgccaatttattgggtgtgcttttttgaaatcagcctaagaaacaagttgttttttcatcatgaaatgacactgacttatggtattgataaggattctggcccccaccctcagcccattttccccccaaagtcagctgacaccctcaggacttcttcacatggaccaatatgaagatacatgtgcatcacatgcacagccacacaccccctggcccctccaaaacagcttgtacttatgtggctgcctttctgggccctagcattgggttttacctgaatcccaattttaccattttagtgacaacatagccactccacccctcattaactatataagcttggccacttaatttaaacttgctgagtttgtttccttgcctgtcaaaattggagtaatactaagtcgaagagttgtataagaacttctaatgtctactgtgacatgtgaagagcttagaaatcatcactcctgtcctcatatgaaaaaaagctgaaaaactgaaaatcaacaactctaattacttccatcagagaactgaggtcatgaggcaaaccttcgccacctccttcctcctccaccccccaagaaatggagagacaagtgaatactgaaaatcacagattctcaggagctgctggaaacagtaaatggtaggaggacttaaaggctaactgatgactagctacaggctgagtgtagactgcttggagagttaaactcctgggagcccaatcctgaagggactcccacacttttgtgaattttaaccccaggagccctcatcaggttctcacggtgaaaatcagagaaatctcctccagcttgaggcatgggaagggaaaaagaacctttttgaaatctggccagatgcttctccctaacaaggtctgccctcaaggaaactactttaccagagtcttatctgatccgaagaaagaacaattagccaggtccagccctgtctagccttcctgtctcatataaaggaagtaaaaaaaggctaagaaacttttctgaagaccacacacaaagattctgccccaataaaatattgagatttaatcaaaagatagaccgttaccctttcccaatatgttaccattacatcaacaaggctcagtataacaacagtggattacaacagagagggctgcaaggcataacctctacttaagaaggagtttctagggaaaaccaaagacaaaaatgagaagaaagaatgacaaacaaacataataaccaagaactgcaggaaaattacaaaagatgtaacatacgtataatgggaatatcagacaaatagagaaaagaatagaagaaatatttgaagattagatgaaataataaaagggctattatggtaagtagttggttcatactaagtgatcaataaatggtagtcataattactattattaattgatcaacatatcagaggagggaagaagagttgaatcaaaggcaactgtttaaacaggacttagtcatgatcaggcacaggagggaggacatctttcttgacatggggaaaacaagcaaaactggtaaaaatatacaacaatttgatgaacaagaaggaaagtgagagtagataggattacacaggatgccctccatataattctgactttaatagtaatatcttccttatagaattactgagaaaattaaataatttataacaatggttttcaactggtaatgaacatcagaatctcctggatacttgtttgtaattcatctctctgggccccaagtcagagaatctgattctgtgcacctaagggggtgaggaactggggctgcggaccctgcatcttttataagcatcttatgtgaatctgacacaagtgccccaaagagcaccttaagaaacacataagcatgttgattagtgactgacctgaaacacagtcaacaaatgtttttcaagtagacagaggcaagctgatctgcagagggaaaggacagggctgaagactggggagatggagcaagtgcaggaggaatgtggtagggagtccatgagagatggatggaaggatcgtgtagcagcagagacccagtttagaaaacacatattcctagaggagactttgagattggatttgtaactttcttcatcaactcccaagagcctggtggcaggagccaagcagacagatggtacagttttcccagaactggaaaaccccaaacacagtagaagatagggggcacaggcatccaccaaggggagagagaatcagggaaccagggcactgttgagaaagctggtcaggggttcaagttggccaggaagatagtacctctactatctacctataatttttttaaaaaaccccaaagtcctaggaccccacatctcctccaaccactacctcatttctctgccccacctcgacagccaagcacttcaagagagttgtgcctacacatgttttacccacttctctgctgttgttcacttctcgacccccaccaaaatggctcttgagtcttgacagtttctgcaatggcctccgcgttgtccgtgcacactccatcatcttgcacacattcctcagtatcgcagagggagctgaccactccctgattcctagaatattctcttctcatgtctttctggttttatgtattttgccccaaaaagtggcagcaggggagttcccacacaagaaagtgcaacacactatcctgaagtggggctggttgggattccaaagaaaggagcactaagcaccagtgagatcagtccaaaacatttattaggggaacttacttacagaagtgctgcagtgatccctgcaccgaacagcgagagaaaagggatgttctgcccaggcacaaatgcagtgaggggtccagggtatggagtttttatgagggtttaaggagtttggctcagggatggggccagtttctttcagtgttttaggcaacaatctagatacctttgtcagtgtctgggaatgttcaaggccccagtttgggattaagcctgctgggaataacccacatttggctgggtcacagagtggtcaaggcactctgtgattttctatcaagacacagaaagaaagcgggagagctgaagggacctacataagcactattggcatttgggccatatttgaggtttacaacataatgttatgtatagatagtatacataatgatatatatatagatagtaaaatggttactgcagtgaagtaggttaacatccatcattgcacatagttactttttttgtgacaagggcaactaaaatctacttaaccaaaatccgtaatacaatttttcatcctcatgctatacattagatctctagacttgttcatcctatataactgttattttgtatcctttgacttacatcttcctattttttccttctctaccccctttgataatcactcccttatctatctctgcatatttgagctctttttttaaaaaaatgtttcacatataagagagatcatgcaatatttttctttctctttctggcttacttcacttagcataatgtcttccaggtccatctttgttgtggagaatggcaagatctctttctgttctaggctgaataatattccattacacacacagacacacacacacacatacacacacacacacgtgtacatgttctttccccatttgtacatttcctacattttcttttcccaaatgaacatggacatttaggtcgtttccatatcctggctattgttaataatgttgcaatgaacatgggtccacaggtgtctttatgaggtagtgagtttatctcctctaggtaaatacccagaagtcggattgctgtatcatatgatagtttatttttagttgaggaacctccataccattttccaccatggctataccaatctacgtttccatcaacagcatacagggttaccttttctccagacccttaccaacatttgctatctcttgtctttttgataatagctatccttatggatgtgagataatatcttatagtggttttaatttgcatttccctgatgattaatgatgttgaacaccttttcatatacctgttggccatttttatattgtctttggaaaaaatgtctgttcaggttatttgcccattttttagttgggtttttttgtttttctgctattgagttttaacagttatttacaaattttagatattaactccttatcagatatgtgaaatgcagttttttgtttgtttgttttttcagttcgtagttttccttttctttctttcttttttctgtgtgagacagggtctcactctgtcacccaggctggagtgcagtggcataataatagctcactgcagccccaaactcctgggctcaagtgatcctcctgcctgggtctcctgagtagttgggactacaggtgcatgccactatgtctggatgatttaaaaaaaatttttttagagatggagtctcactgtgttgcccaggctatgccttttcattttgttgtttgtttcctttgctgtgaagaaggtttttagtttcatgtagttccatttatttattttatttttgtagcatgaactgttggtgtgatatccaaaaaaattattacaaaggccaatgttgaggaggttttctgctattttctcttctaggagatttatgatttctgagccagataattctttgttgttggcagctgccctgtgtcctctgggatggttggcagcacccctggcccctggccccaccagttgtgataaccaaaaatgtttccagatattgtctgattctgatgtcccctagagaacaagatcatccccattgagatctgcttctctaaatgatgcactctccaaactctgtcctgtaaccttttctgtcctttctctgcacaattagactcatccgttccatggctttgagtaccatctgcgtgataatgactcccattcatgctccacgttgagatttgtggcccactttgatgttctagaccctgggctaaattaaggtaaattaagcctggggcttttcaaattagacagagggaatgtaagcccctgttctactcttgctgtgtaactttaactcttttaacctttgtttctctgtctgaaaaacaaataataaagatgtcaaagctgtaaagatgatcattagagtccttggcacatagtaagttgctaagtattattataacattcataattctgatctcaatgccttcaggctatgcacaaagggcttctggacttagggtcattcaatagaatgttatagactgttgaaagttcaactctagagcctgagagacctgggttcaaatcctgaatctacaattctgctctatgacctctctaaggctcggtttcttcctgcttggaaaaggggaataataatattacccactttggagggtgaatcaaatgagatcatcctaggaaaatcaattaacatgatgtctaacataccagtacttaataaacattagtaattattattagggtaacattagagaagctgatctttaactgaatctcaagggctatagaaagagcagtctcggcagagcatgaataatgggacagggtaaggaaaagtgagctataatctgggaatgacaaggagttctggattgctagtgcaaggttagggcttgagatgaaactaatgaattgtcatctaaatgcccttccacgccagtttgggactatgggctttatccttttagtacctgctagcagaaattgttttttggttttttttggcaaggggagagggacaccaaagagttttagattaggcaacaacatgatgattaaattttcaacttaggaagagagctctcatcaatatggaagagcttggagaagataagaacagaggcaggaaggctgggtaggagattgtggcatgaactccagtgagagatcaggaaggctgctcatcaggagatgaatgccacagacatcaaagagctaacaactgatgagttgaatgcagggggctgagtaggactctgaggctttttgcttggtcgcacgtggtggaccggtggtccattgaaccctctgctgtctcctcatcccaccactgccctctcctctctcctcttccctccttagctaagctcatcatctcagtaacacttctgccatagcccataacttctttgcctcttgtcctcacaccaatctagcaaaactccagccctgaatgaacacatcttttctcttctttgtgcttacacctgagccctgcacctggaaaaagtcacatttcagtgcagattggccagttcacatcatgctaatttcctagagctgctgtaacaaattgccacacatttggtggcttaaaacaacagaaatttaattatcttacaattctggggtccagaaattcaaaattcatctcactgggccaaaattaaggtgtcaacaggaccacactccctctgggggctctagggcagtggtcccaaacctttttggcaccagggactagtttcctggagaacagtttttccatgggctgcagtagggggaatggtttcaggataaaactgttctacctcagatcatcaggcattagattctcataaggagtacacaacctagatcccttgcatgtgcagttcaccatagggtttgcacttttatgagaattgaatgccgccacttacttgacaggaggtgtattagggttttctagagggacagaactgataggagatatatatgtgaatttattaagaattaactcacacaatcacagggtcccacaatcagctgtctgcaagctgaggagcaaggagagccagtccaagtcccaaaactgaagaacttggagtctgatgttcaaggataggaagaatccagcatgggagaaagatgtagtctgggaggctaggccagtctctccttttcacattttctgcctgctttatattcattgacagctaattagatggtgcccacacagctgattagatggtgcccacccagattaagggtgggtctgccttccccagtccactgactcaaatgttaatctcctttcgcaacaccctcacagacacacccagggtcaatactttgcatccttcaatccaatcaagttgacactcagtattaaccatcacaggaggtgaagctcaggcggtaatgctggctcaccccgatctcctgctgtgtggcccagctcctaacaggccacagactgggggctggggactcctgctctagggacgatttgttccttgcctcttgcggcttctggtgactgtcagcaggcttgtgtgtggctgcatcactctactctctgcctccatcctcacgtggccttctccttgtctctgtctcaaagctccctctgccactctcttttaaggatacatatgattgcatttaaggcttccagatagtctagaataaacatctcctctcaagatccttaaataaatcatatcttttgccatataaggtactattcacactttctggggattagaagtgaacatgcagtagtccctttgtatctgcaggttctgcatccactgattcagccaaaaatattggaaaaataaaaattaaaaattaatacagattttaaaaatacagtataacaactatttacaaagtattacatcacattagatattataagtaatctggagatgctttaaagtatacagaaggagtatatgggaggagtagctgtggattttgatattcacaggatgatgctggaaccaacccccgacaaataccaaggaatgattgtatttcgcggggacatttttcttcctaccatttacacttatgcaggaccactgaccttggagggcccttgacctgcctggcaatctgaccaaattactctggaaggcttgtcctcccactttccctaatgctgattcctttcattcctgacccacctatgggtcacatcacttttcccacatcattctcaacaagtgaccttgttgtgttctctatggggggaaaagaaaagaaagaaaaagaaatccctggacctggaccagaatttcttaacttgttgctaaagttaataaacctacctgcatctttcctcacttcttctcctactaaaataatggatctctccatccctgtcctgagaccatctctactcaggctctggataccactctctcctgcttcctcaggaaccttaaatggccaatcaccccacctttgttttgtagagtcagccttttcttcttgataaggtccttcccttcagctcaagttttaaaactcttccttcaggaattttccttcttaaaagaacaatttaaaaaccttacaacaaacaaaattccaccccctggccaatccatcactaagtcctgctgatggtaccttgtaagtctttctaattcaccaacttctccccttctcagcctgctatgagtccagtctgtcatcacatactcctggacgaccatagtaacctttctgcatccatttttggcacctcacaattgctctgttaagctgccttcagttgtgtgtgattggtatgtgagctccatgaggtcagggacttagttccattcatgtgttccctgtgtcctcatcatcttgaaaagggccagaaacacagtagctgttcaataaatgtttgttgaaggtattcacataatttatcactaatttcaggaggaagacaaagttccttaacagcccaaaaggcccagaaaggcctgacccctactcatctctccacctcatcttgtgtcatcttcccttgttccctgagctctagacacattggtcttctatgaacgctcccagttttctcctgccccagggtatgtgtagagaaatgtttcctcattgtttagaacattcccctctgccccaacccaacttttcctaataaataccactcagccttcagatctcagctcatatatagcaagttgcttccttggaaaatctttccttagcaccattatatgctctgttatgttctcgttgcacatatatctgtcatagaaatttcccagtaagaactgtgttcatatttggtgactatttgattcatgtctgtcttagtccattcagactgctataacaaaatatcttagactcagtgatttacaaacaacagaatttattgcttacaattctggaggctgagcagtccaagatcaaggcaccagcagatttgttgtctggtaagggcctgttccccatacatggcaccttcttgctgcatcttcatgtggaggaagggtaagagagctcactcaggtctcttttataaggacactaattccatttatgagggtggagccctcatcacttaatcacttcccaaaggttccaccacttaatactatcacattggctattagattcaacataagaacttgatggagggggctgtcaacattcagactgtatcaatgtctgtctttcccatcaaatgaggacaggggccactatattcccagtgcttagcatactgtctgacacacagagatgctcaataggtatgcactgcaggaacaaatgaagggataatggaataatggcaaggctgagatcagttgcaggaggagaaggtttagtggaagggtcacaactcagttttgcccatgttggagggccccacagctaattcagctggagaggtacactcttgtttgggaatctgggctgggagctaaggacagagggcaggctggatatctagacttaggtggttggcaaccctgtagtagatgcaaaagatgggccatataagaggattcatgtctagagatgagagggggatgggattaagggcagactgggagctcagaaaggaagacccacagattaaaaaaagatgagctaagtgtagagatgtaaaggagggacgaggttgaggggcacgtgaagcagcaggtgaggccaagtgaaggtgaaggacagactgggggtaaaatgagggattggggagaatcaggaaggtttagattttctgagaggaaaaaaatctcctgctggcctaggccaagcaggtgacctgcatgagtggagtgtgtttacctgtgtgcatgcttatacgtgtgtcatagggaacaccacaccactctcaatgtgacttcacttctcaatagattgcctggcatctttttacagcaacccaaactctctgaggcaagtaaggcaggtgtaatgatctttcttttctaggtgcaatattaagttggactcatatcctaggccaatgctctttccaccaaaccacactatttcactgggctctagccagcttgtccggagcttgaagacatattactgtcttatttcagcatttctgtctactgcagatgaaattggcctccagccagagaaaaataaaatgcccttgataaacggcaatatagtaggatcatagctttaggaaattgtgatgctccttgtaacattccccgctttttttctttaatggggagtccttaagaatcaattacattttcctaattagtgtgggtagtcaggacagaccagaaccaaaatattattaatggaatgtgcctcctatcctcggcagctgagtttgggtagcacatgcaaccccaaggaagagctcagccctctccactctgtgggtttgaattcagctacagaagctcagaagaaagagcactggactctactgaaaaccatgtttctacatgagttttcattcttcattcaaattttagcaaattttaggctttgtgacttctaggcatggcccactattgtgttggacaatttttcaggtaaccatataacaaggtactgcggttcttattcttagaatctaaggaaagctatgtactgtgtcatcagaaaaatgcactcacacacacaattttgcttgtatttcagggatttctccaaccttctgaggcctgtccatggctgactccccctatagtttagggggccttcagtccactcatgagtggattcctactgcagcctcccaataggtctctcctctttgctctctgactttccattcctctgctaaattaagaatttcctattgttctcaagtcagcccaaattcttctacatggcttatgaggcccttcatgatctggcaactagctcacatttccccactgtaggcacgtagagggaggggagtgagggaggtttgaggagaatgtaactcagtgaggatctgatggacaaataaaagttagagagtggatgaggatggaagaggaggagtgttgcttggagaggcctggaggtgagagggaaccctaaagaacaagaaaggaatatgacatgggctttggaatacaacatctcagatttgattcctggctctcctgcttattaaccaggtgaccttgcacaattcttcaaacctcagtttccctgtgtgtaaaatggcagtaatagtagcctcctcaaaggaagggtgtgagggctgcaatgcataatgtgtggaaagtgcttagcagagtcctggcaggtaaacagtggatgggtgggctgcagtgagataccaactcttgggatgggatgcctagccatgaaggccatgtaggtcataggagggagttcgttgacactttatctcctctttaccagttgggacttgctggccagccttccagaggtctaacactgaatgctgccagcctctcctgctggcttcagggcctccttgtgtcaaaagtgattgcagctccagacaactgagccccactgacagacacctcccatcctaacacccaccctaacctttcaccaaaggccacaggaccaagatgggaaggctgagactgtgccacagcagggcttcctatgaccccaaatgggggtcagcttttgactctggtgagatacattggagaaccagattaacaccagattcctcatagagcaacttagttatgccaagcatattctcagtggcgacgtgcaaaccgcatttatcctatgtggtagggaatgagacttttctccataaatgcatcatcacatactgcagccttctaagtgttaaccattttgtccaccgatttggcaaaaacagactcgtctttcaagattcagctcaaagtcacttcctctgtgaagccactcctgttcctcctcccccatcccaacacctagtagaagccaagcccttctgaggcttctgatgtctgccattggggagaatttcccttttatttctgcctctttgtctccctctgctagagtgcaagtcctttgaggacaaagcatgttttaatcatcttggactccccagggcccaggacaaaaattggctctcggtagttaataagtgtttgttgaacaaaaggatggctacattttttgcccttttccttcattattaaatattaaatgttcctatttacatattctgccttactgaagaggtgttgctggtccctacacaaaacggtccctgatgactgtactctgatatttcttacattctttccctgtgagtctgtttctaacggcaacctcatcttctaaatgtaatttcacacatgttactaaatcactttgcttcagcctgaacctaggatgttgcttctccttcagaataagatgccagctgggaatagagatccaggcagtcccagaagccccatgctaacaacttctgctaattcttaggctgattatgtggattattgaatagatcgtctttctgctttttatcctttaaactctctctgctcggccttgtctgtttcatcagtaaaggtgggcatggggaacatagagactgtgaaatctaaacctactctactccacttccatttggtcaggttttggaataaaaaaatctactctattagtaaagaattatagtcattttagagccattctctgagtaaaactgtcaattaataaacttggccattctgtttggggaataaaagaaaggaggagggagttaaggagcttatttcccccaattctctaactcaccaatgggtttgtggctgcaattgcctgaagtcccattgactgtgttgcctgcctattgagtaggatcttctggggtacatacaacttaaatgtagttttgaaagttgcttgtctttctctcaggtcatattgctaatattgtatacattgccaattgagcaatcagtttaccaactagaggaaatctggctcactagatttactgagcacctgctgtataccaggctctagactgggtgccctgtctccttgacctctaatcttcacaagcaatctaggaaaagtgttatgaacattttagagatgaaggaagagactcagagaggttatttacttcttgctcaagcccatacagcaatgatttcccaaacctgtagggtgtttcttccttgggtgttttgtagcggggaaaaagaaagtcaaagcctgtttccattatcgtggattttagggaaaggggagtattaaacatagtaatcagagaagcctggttcttctgaagcttctgactgtcatcaaattggaagttaatgctgggggagaagctctgtgtgaaggacccacatactcccgtctctggcccagcccaaactgccttggcttacctgaggctgccagtgacttctggctcctagatcttcatcttgcagctacgtggacaaggtgggtgcagcctggtgccttatgtctgtgctgtagcttcttaacagcaagtgagatggtagcaggcatggaaggccatcggtgggaagggaaaggaggggttgtcatagaccaaggagggtgaccacagcattccacagattcaaaaatgcccatttttaacattgtagcattttacaagtcagaatgcatcttacaattgatatgtacatgaaatgtaggattccttttccagataaactgttagtgcatcattgatacctcttatacgcaatggcatcctggattcaaggaactatggcaggtttcatcttatgtgtcaattctgatcaagtggtggagactatctggagtttgggaggagaaaggtctggtgctatgtccatggcagtggtgaacaacaataaactgagtggggcgtcactgtgcatgagagatggcatagaatcctactgtcgggcatttgcgccttcatccaatatctttggtattaaatggaggagcacctgccatatcttcaactgtaaactaaaggacacaaaacacaggaagcatttccaagggaccaggtcagaggcctgcctcttctcatgcagatttgtgactgtggcctttttaaatacttttttaaagtattaatttaattataaaaatagtacatgcatgctataatacaaagatacagaggtacatgaaattttaaatgtctcattgtatagatgttactattactggccttatagatttttacccttcttctattgtaaacaaatgtgtctttgtgtatgtctgtgcacgtacacacacacacttgtctgtctatggagaaaatcttaacagaattgtgggcaggcctcatttttaatgggcacaacatagtctacttaacctctccccattgaggtttggctcaaagcttatttcttgtttcttatgagtgtaaatgctcagaataacctgtatgaccagtgtcatagtccattcatgctgctataacaaaataccacagattgggttatttataaagaatagaaatgtatttctcacagtctggaagctgagaagtacaagatctaggtgccagcaagtttagtgtctggtgaggactgttttctgcttccaaatggtgccttgttgcatgctctggaggggacaagcactgtgtcctcaggtggtagaagggataatataagcagtttcatctcttaagacctttataaggtcactaatcccatttatgagggctctgccctcatgacttaatcacctcctaaagcctccacctcttaatagtatcacattgattattacttttcaacatatgaattttaggggacattcagaccatagccacaaggaatgctttacttacattttaaattagtttattaagatggtttcccagaaacataaacatgcttaaggtttctgataatttctgaattgatatgtcaaagatgtggttgattgacacttgttaactatgggtaaatttaaactcagtaacaaagcttttgtgtttccattaccaaagaacaagaaactattggaggtaagtcattgtatatttatgttggctgtttggcgatgtccttgttaggaatggagtgagtcatgctgcctgaatgcagtgtgtcagaggctcagggtctcagggacaatatccaggctctaggtcacctttgactttacctgccttatctgaccggctcatagcaggctggggtaagttcatgttgccacggattctaggagggatctctgaagtgtcaagtactgccttttcttctcatggttcagtgcagatggccgcagagggcaggatagttgatgacttattctctggagtcatccaatcttgggattaattcttttatattcatttgctgggaagggaaaggaagaaaaggggaagaagctctgatggcagttccctcttcctagattccctgctggtggtgcctcaggaacttcctttctttttgggtataccctcctttctttccttcctttctcagtgtttactatttgtgggagcatgtactaagtgctacgcactttacacatgtgatctcatttaactcaatccatttaactgaactgccaagaggctaagtggcttacaaaaccaattctatgatctttacatttttacttgtgcaaacgtgtgagaaagtttaactggtgaaacatctgtcaggtgaagactgatgtgctttctatgggtcagcaagaaggcagaagtatatccatctaagtatacatttatatcaaaataatttatttggacccatgtaactatagcattgattattgttttctaaatttgattagcagtcaactgaacatactattcgtttattgcaattgggtactttaaaacaagttctcagagtaagggttttttttctgttatatttttatactcacattaaaaaaagaaatatatacccaatcttgttcaaaaagaatttaggatagctcatatctggtttaatctaaaattaatactttaaaaatggaattttaaaatgataattttagtagtgttttggagactaaaattgggaaagtcaagaagctggctgttgactcacactattggtttcacattgcagaagataatgtgccatttttttcatttcaattcaggcaacgcttcctgatcacctactaagtgctgggcactgcatgtggccagtaagacctccatgtgttgcacagtagctgacagcagatcagcagacttttgctaccaggatgggcacagggcactctaactttgcaaagcagcctttagggcctcttttcaggtgcccagagattgctacggtgtaagggaaacttttgtatgttccagggctggtgtcaggcccattttcattggcaatgaccttcctggcatatgctgcattttcctatgttggtgagaaatttaattttactctccagaggtattagggaaaatattacaaaccacttttcaagttgaggttgaacaaatgaccaggtataactggttcaggaccccaaaataatgtcattgtttctttaagcattgtcattgagttgaaagccatggaggtcacaaataaaaagagttaggctcatattctaaagatccccagctctttaatttaaaaaaaaatcagtgtcaaaatgttttgttttaattacatcattgttttcagactatgctttaaagaattttaaaattagcttagttttttagtaatctatgaataaagcttctcttctcgtgtgcctgccttagagatggactgacttttttgcaaaatgcagcttttattcttagagaacttagtagtgcttaaactgtgttcatattcatcctgtcatttgagctctgtgacagccttgtgatggagacagaactggattcttacccaaattttacagatgaaaagttagaggttgaacaacttgcctaaggccaccttgcctaaagtagcagggccatttgagccctagttcaggcatatttcattgggcacactgtctttccaaatatttgcaaaattggacgcttgaatagaagaccttcaccaaaactctgcttactatttggctatttcaaaagttaattgttggatttgctgggactacctaagtgtcttgaaaaatatgtgcattctgataatggatgcaatacatcaactaagtatttttaggccccttgtgtttttacacttgttacatctttgtaatgtattgatcaaactaatgagtcggactatttggaatgagcagctcagtattatttaatgctgcatttcttgtattttattgatcacttgcctgattaattaacttatactatacttggttttaagaagactttgctggagctactgaacaattctttagctcacttttcttatgaaataaccatggaacaaggtactatttagagtctttgggtcttgttgcgaatttgtgggtagaaaatgtaagatatatttcaatacatggatataatccatttacaagtagctagacggcctttgttcaaatttgaccacctttcagacaatgagcttcacctctcaactctgcaggaagcccttagtaggtcccaaatggaaataggatctactctgtcataactatcaagcctgagatcttaaggcatccaggtagtcacttaggaatgaagaggcaaggatagattcaaacaacatttcagaggtagaaattggcttgttcagtttagaaatgacatggaaatttctagtttaatgatgccagtaactgagagaccaacggaggggcaggggctgaaggaaggggctggattgagtttgaaatattgtatccttctcctgaggaggttataacttggtttgggaatgtggagttgacatggatgagaaaagataagtaaacaaatgactaaactgcagtatgataaggccagagacagagatctgcagagcatgctgggagaacaatttgtggaggttgagaagtcagaaaaagcctcctagtgggcctgacacatgggctacattgtagaagaattaattagggagagtgtagcacagggcattcaatgcagtaaaggcagtctatacaaaggctccaacggtacaacaagagccagtagaccaggcaagttcagtgggctggaggttttaggatggttgaaagatttgaaaagaagcagcagcttagtcatgaagagcctggtaatagcagccagcacttgtaagcatttactgcaagccaggcatcgcagaatagttcagaatatgtttagaaggtagaattgtcagtatgtggtgaccagttggacatggggtagaaaagagaagtacaagtccaaagagagtcccaagtttctgccttgaccaagacagagtttgaatgaggagcctatttatgagggagaaggctgatgagctccatttgggacctgtacaattcaaggttcctttagtcatccatagtatttggatgtatggagtctgagaccagactgccccggtttgaatcctagctcagccacttaggagacttatgaccatgggtaagttacttaatccctctgtgcctcagttcagttttctcactaataagatgggaataatggcacttaaccttatagagtagttgtgatatttaaattttacataaaattatgtatattaattatatattatacgtaattttataatgtgtataattatataaatatacaatgtatataaaattgtatatgattatatatataatttaggttctagatcataacaggcacttgataacttattgttattaattattatcattatatagttctgagactcaaggacctgggttgacaccatcaaggtagagtattatatatgatcattatgtatgatcattatgtatctcttaggaggtatttggctataagaaacagaaaatccaatcatggcttttatcatgggttcttttattgtttagcaaggagtttggagataaatggcttccacattcttttagcagctcagtgacatcaggtccctggactagtagctctgtgattcactcagcctttctcttctattccataaaatggctgtgctagctcctccggttcataaattggccacactagctcaaagcatgtcaccctcaccaacagtgttctaaataggagagaaggaggatagtgggggaaaacactctcctcataggccactaccccttttgtcagagaggaaaatcccagaagcctcctggctgatgtttctgtacctctcattagccaaaagcaggtcacatggtcacctgaaactcaaggaaaggaacaggatagccataattggtttagaccagtcatgattcaatctctggggttggacactgtaaatcctaaacaaatagggtcttttagcaaaagagaaggagggaatggctgttgggccagtaattaagaatgtgcaccactctagggagggaggacatttagagaagaggacaagaggagaacccaggactccatgacattcataggtcttatagggaacaggggccagggaagagatttcaaatgccaaggaaataggagaagaaatccagagaagcaccccaaagggaagagctgggggagaggcaagtctacaggggtacatctggcagagctttgagcagaatgaggctgtaaaaagctgtcagagttggcagtgaggaggtcagagtgaccattgccagtgcagattcagtgatgccaagggttaagaagagaatggtgatctctatcatatgcagttggtaggcgtgcaaattaatccaaaatttgtattagtttggcactgtgtgccaaaatttaaaatgctcataccctttaactctgaaatttcacttctaggaattaattcaactggccaatttagacaagtggaggctgatgtaagtacgaggatgttgattgcagccttgtttgttatagcaaaacaaaaaaagaggggtgattgatctgatctgaaagcccatcatataggattaattataataaatggtagtacatcttggcagtggaataccaggaacagtagaaaagaactgaagttctggagtcccacagccagggtttaaattctggttctgccatttaccagctgtgtgacctcagctctctgtgaacatttctgggactcagtttctttagctgtaaaatgggataattataatactaactcatagagctatagtgaggaataaggatgcagatataagtgaaatacactgaatatttctggcacagattattatgcagtaatttaaaaagatttggcagatttacatgtatgtttaaaagattgtttataagatgttaagagaaagaaatgaggttacagaatatcacgatataatgatccaacaggtggttttatctgggaggtaaaatcctgggcacaattcactttctactttatacctatttgtattttttacctttaaaacaaggcatttaatgtcttattcacctggccaattataagccacaggagggaagctaccatttctgttttgttcaccacagtatatcataatatctggcatattacaagcagatgataaatatgtgttgaatgagtgtatgaaaaaatagtaagttgtgtttagaaggaaattccataggccaagagttcaaagatgcagtagttctgcaccaacaagtccccgggtagacctcagggacaaggctgcagaaatgaagcagaagtcagggctgagggttgtatattggtcttcagtatgaatgcctcagcttctgaaacagctcaggttgcaaaacctgaggaagaagagggaaaacaagccccaaagcaccaggatccagtccctggttttgttcagcacttcccaaacaggctgaatctgagagccaaatcacattttagaattgcagggcattttggtgccattgagtcatttcaacttcagaaaacccaaggccctggaaggaggagttctccaagttcctacaagacctgagacgaccctgccctgtgtttcccaattcctgctctagtgctggctccttcttccaaggactgaacattgtagatttctgatacacacgaagttgttttcagaggatgtccattcatttgactcctaagaaacccagttctcttaagcacaattcaatggcttgcgtctctaaagttcactgatcacccatcgctcttgctctttatttgtaaagaacaaagggaccagggatgtaattaactcacccacatttcccattgtccttaagtcttttgtgcaagcattgattgttgtttttattgttgaaagcagaattgttctcctggcaacacacatccagaaagagagcccagtgagggactcagcaggtgatgctgttgaagtttgaccttaccgtttggaagaataaaagaaaaagccaaaaaaagcaataattgagcagagggtcgttatgaattggttactattctatactattaaatgctttgggagaaaagacatttggttatttttaagtgcatttaggaattcagaatatcagccagctgagctcccaagtacaggtcctcaggggattcagtttaatgaatctttaagagcagcctgttgttaacatattacaattagcacaggtaaatggaggattcgaatgtgcttctggcaaataatctgttctcacttttatatcttagtcattacttactcatacattgatgtttactctgaggttgttttgctgggaagaaaggatacacttagcaaagcaagatgatatggcagaagagagcttgagatttgggatctaaatatgaccgggtggaatattggctctgttcattagtacagtcgtgtggtcctcaggaaattgctgaaatcctctgaatctgtttcctcctctataaaatggggattataaaacctgtttcagtggattgttcagctgattcaaccaaatcatgttaaaagggctgctgcatagctcaataaactttagcttctttccctcaaagttaagcttttcttccctgttcatctaaaaaatcaagcaatgaattactgaaaccttttcatagggaagagaaggcaatgttttgggttctttacccacattttgcccatacattcgactttatccaaagaacgctttgagttgctgcaaccacctgcacgctgagaagacaaaggtgaggagtagggttaaaagcaggttcatgtaggttcaactggaaaaccagctgccacggaagcctcaggcatatctaaatttgttcctccctcttttccttcctaactccttaaggtttgtgggcgggatcatgtaggatgacgacagccaaagggaaccatccaaggctctgaggtggagggagctctgcttgtttaaggaactggagctcggtgggtgagacaaatggtggcaggagatgatgcctgagaagttggcagggaccagattaggtggggaattgcaagctggcattataaagtttggattttaagtgtaatggaaagccactggaagtctttaaacagggaagtgacatgatttattattttaaatgtgcgctctggcttctgtgggaagattggattgtaggggctaagtatggaagcagagagataagttagaaggttgttgcagtggtttattgagtttgggtgctttagggtgctggagagaaatactgtgaaggtaaaactgacaggcagtcaaaggtgaggcttaaatgaaataacataaatgaagtgccaagtgtgtagtagataattaacaacacaagttccctctcttcgtgctacaactatatcaacaaagtgatgtttttctctggaattggatatagggagatgataaattaataaccacattttctcagctatggatttgttctttggaggtgggctgactgggagatggaggtcagcttttgcagatcacagcctgccaactgggaacacttgcgaaaggaagaaataatagaagcaggaagcaggaaaggagggaagagcagtatggaaaaaagactgggccaggtgcggtggctcacgcctgtaatcccagcactttgggaggctgaggtgggcagatcatgaggtcaagagtgcaagaccggcctgaccaacatggtgaaaccccatctctactaagaaaacaaaaattagctgggcgtagtggtgggcgcctgtaatcccagctacttgggaggctgaggcaggagaatcacttgaacccgggaggccgaggttggagtgagccaagattgggccactgcactccagcctcggtgacagtgcgagactccatctcaaagaaaaaaaaaaaagactggaaggagcaatttggggaccttatctccctcacaaggcatgtgacagtggtatggcttggctgcttcagtgccctagtactcaaacccctaaagggagaatgcagatggacaggtgcagaggtcatggggagcacttttgggcttcaaccccacggcagtatcttggggtgagtgcttacgactcttgaagccccagtgggtgtgtgttacagtgtgctctttctgctttgccatctgcaggtggcttgtgttaatcagctcaagtagaccctctgccttatcgcaagagcagagggctttctgtatcctgagttcttgcccagtgtaccagaaaaatttgatcacaggtgggcttggtgcaaggttctgttgagtggtggaggtggcgctcagcaagatggatggggggccagaagagggatggagtgggaaggtggtcttcccctggagtcaggctacccagtggcagactgtcctctgatggcccctggctgaactcccctcagagtccgcattgttccaccatcgctggtctgccagtgtctgctggtgtggtcctctgctcctccgatgtctagccgcttgtgtgtgtgcctgctaaggtctcgggtttatatgggcacaggatggggggcatggctggccagagtggtcttggaaaatgcaacatttgggcacaaaaacaagagtgcctgttctctcttaggtccatgggcacaggcccaagggtggagcccctgccagggaccccactcttctctacccagggcttccctgccctacttccgcatcactgagaaatgtgaggacattggtgtgtgtggaaggtgctggcataacagctggagttgcatccttcaagtgacaatataggtatatcagggcagtctgctatgattagaactgaaaagaatctggaggccatatcatctgaattcctcattttaggaaactgatctctagagagaaaaagtgacttgggcaaagccacagagataatggcagaggcagggctggtagcaaactagagtgggaagagattgagttttaaagtaagagactgggggtgcagtcatttattcagcaaacatgtaccaagctcctgttccatgtcagacccaagtctaggcaccgggaacacagtcaaataaaacagacaaggctcctgcccccatggagcttacattctcattcctcctcttacagactcttctgagactaccatggcagtccacctagtttgccttcatgaatcgatttcctcttctctaaaaagggagtagcaatacctctttaattttaattaattcatttattcattctacaaatattgatcaagtatatatgatgtgccaggcacaatgctaggtgctggtgacccaaaagtaagcaaggtagaaccagcccctgctttcagatatgacgaactagaggcaagatggttgtcatcttaaatgtccatcaaaatcacctgaagcccttaggaggtcactgctgccctggccccatgcctggagctgtcgattccactgctctggggtggggctaggcatcactattttcacaaaccttccaggtggttcttataggggtggggtgaagaagtgctggagaggcaaagataaagggtcatgcgggtggtggtttggcaggtggagggtgcagcctatcagacctgggttcttggggctgggaaatgcttcccagaggaagtgactcatcaggtgagaccatgagtaggactagtccaggaacaagaagtgggagcagtgtctgggaaggccagagcccccagaggttgctctgagggtaaaaggggtaacagaggtggaccatagtccgtggtcagagacaagaactatgccattgttcctttgcctgtttctctctctttgttctttccagccccactcccttcctgttatgttctttatcctacaatacaccatactgacagcacaacagctgattctccagctcctaataattatctgaaagagcttcctcctgtcatccatctcatgtccactgcttctctgcaaggcaggagccagcctccggctcccttcccacagcttccagctcaattgcctccctacagcagagggaaatgctctctttgctgcatgatttgatcagtgtattccccccaaccctccaccttcaggtgcacaaagacaaaatgcattctcttcagatatttgatttgttttgcaagtaagtgctcagtacccaccagctgataaccacattggatgtgtttgacaaatagtccttgagtgttaccataaatctataacttgatgagagattcttattgtcaaaatataattagatcaaagtttggtatttcccaagggtgtaaggaagttcatggatgtgtaccatattcagtaagatatacatctgtgcatgatgtctgccattgtcactctaaaacaagagggaaatctgacatgcttttacgtcctaaagaaggaagatattcagtgacttgtttaagtctcttctgaaataaccctcagcagagcctgagtttattctcaaggcgagggggtgggggaaacggggtgcacaaacagttttgatcccatgccgatgtctgctgacttacgcagagaatacaacaagcttcagggttaaggaaaggataacagggaggttgagaaagaaaaatcagtctgctggaaatgtcattgtcttaagcgagggtggaggagagttggagagtccttctcttctatgtataatcttctcaatgcattgtaaaatgttttaaagggattatattatttctcctgcctgtgaggttaccccaacttgtctcctcctctctccccatttttcccatttttggctcttttgacatgtaagtgagaccagaaacaaaggctgtcatctcatccaggcagccatttgtccacacttaccagtaaactgaatttgccaagaactcccactctgcagtctctgggagaggcaagatgataagcttgtgcctctgataaagcctgcagcctgggatgatctgggctgagtggggagactgaatccatgggaaactgcatcccttgaggagactcgtctggacttctctctgccgggaggcactggcgttgtaagaaatgaaggaatggggtcaggggtggggagcatccacaactcagatgtttaaagagccagagctgcaaacaaaatctggctaggaacagttttcttcgactgacctcactagatgcctctttccaaaattccaagccctcttggggcacacggggtctttctggaagttggtgatgtcgtggaaaggtcactaggtttggatccaaactgcctagtatgagtttaccatgagcttcaataatctgatcaagttccaacattcctctgagcttcagttgcttctgtgagatggaaaacaccatcccttctcaggactgtcagggactttaaatgagctgacatagttaatacaaataaaccaccagcacagtgactgggacacagaaggacctcagcaaactgagtttttgctcctttttcctttgctaaatgaaatcaaaccattgcaaaccccattagtgtataagagacattcatttgtccatccctgaaggtgtaagcacaatataaaaaggcttcccaaactactcaggcggagcaggatagagagatgtatgttttgctgagctgatcataaatctgaatgaagtaattatgtaaagtattcaagagcaattcagtaagaagatgcctcatctgccttgatgggcttttcaattactcatttttagtactgcattatactgttctctggcaataattattaaacatttcaactgtactgctatataaaacttaaaaggctgatttatttcctaggcattagactacattgaataaaatcccccaattacatggttctattttttaaaacctgtttatcagtgattttctagtattgagtcaaaactgacagcaggtcctcatgtgaaaaataagggtacagtgtgttaaatccagcggttattagctttggggtcatggaggatattaatacagaccccctacttgctagtcccagtttctgaatctgtaaaatggggataattcccacttcactggattattgtttgaaataatggatacaaagtgttagcaagaatgtagagtctgtgccaggtttggtggctcacacctgtaatctcagctctttgggaggctgaggcaggaggattgcttgaacccaggagtttgagaccaacctgggcaacatagacctcatctctacaaaatataaaaaataaaaaatattacctcggcatggtggcgtgtgcctgtggtcctagctactagataggattgcttgagtccaggagttcaaggttatagtgagctatgatcttgtcacttcactctagccggggcacagagtgagaccctgtctcaaaaataaataaaaataaaattttaaaaaagaatatagggtatttacttattaaacactagatattctgagattcactggcatttacatatagccagtgagaatcttcccacttattcagtgtatatgcatcaatcacctactaggctctaggcactcaagatgccaccagggcccattctctgattgtcacttcaatgactcaaagtcatggtcatcaagcatctagcagctccaggtccccttctgggctctgtacacaggacatctttcatcatgtgtagccattttccacataaggatgtgtactcacagagagttgggtgactttactcaaggtcattcagtagctaaggcagaaatcagacctatgtctgctggctccaaagtccacatcttctctccccactaccccatgctacctctcaggattccaggagcacatttcacctggtttgaaggataattcctcctcctcttcctggtttttctagaggagatagctcttttcttattgaggattacccacccctgaaaaattaccactttcccgaagtctgtctctacttttctcagcatcttccaattctcacctggaagatgaggctttctattctaactgaggactacaccatgattcaggcagtgacccctacacacacacacacacacacaagcatgtgtgtgcccagttctactggagcctgtccattgtacttgaggctcccaagccaaactggatttaggtgcaggccagctgggctggtaccctggataccagtctgtaaagagaactaaaatgctgctggaaatgtaatacagtggagaaaatggtctttaccagaattgttgagagcaagcgggacacgagaatgataataataatatttatcaatgcacagtgattataatatacactgatagttttgttgataaactttctccttagttcagccaaaaccgggctcttgtcacatgatcaggaaaagattaggcttgtggacacagaatggtgaggaaaacagaatttattgggtgaaaaggaaaaaggaaaagcaactctcagcaaagtgagagagtcctcctatcaggtttcccgcctcacacgttgaatcccaggtcaccacatagcaacgggagaggccaggctcctccccactgaacttcctgaggctccaccccattctcccagtgctcaggtgggcgttattcagaaagaatcagtcaggaaagggtggcttcatccaggaagtgtagtcaggtttttcagccttcaggctgttttaggtttaaatatggagttttgctggggacccttggctgcctcctgtctccactggttttgtgccagaagcttctctaacaactttgtatatgaattcatataaacacttctggcccattgaggtagatgctattatcagtccccattttacagataaggagaatcagtccagaaaagttaaggaacttgccagagtcacaccagtaataaataggctgctggactctcctaggactttgtattgtctcctggtagggggaaaacccccaagagcacttaagtgacaagagctggtatctcagtgaccttccaggcctcttagttgctgggtgaggtatgcaagtttagggcagcagttgaactactcaggttaatagagtgagcagtgctgagctggcagtctgcctgccctcctcccacgcagcactcagcctatcctccaaatgaatgttgggcaaatatttagagaatatcgttttgaaagggggccaggttattagcctgcccagggcgcctacgcatcttggcccagccttgctcccaagcctggcctgctgtctgtgctcctaatatgtgaaacaactcacatagcatggaggattaatctgcttttgggggagaaatgcaatctggtgtttctcaggactaaacttctgtggattggatgccacatgcccggtgccagagggtccgccaatggtgctcgtggccacgtcacctcccccacaatcccacgtgcttctcaagtctggaaagcacagggtacactcccgggaagagaaaataaagcaagtgagattttaaaagatgaataagatggaggtaagaatccgtttgaagagatgctaatgcaaaaagggatgctagttcagagacatgcaaatcaaaactacaacgaggcaccacctaacagcagtcagaatggctgttgttaaaaagacaaaaaataacagatgctagcaaggctgcggagaaaagggaacacttgtacactgtaggtgggaatgtaagttagtttgtccactgtggaaagcagtttggagatttctccaagaactaaaaacagaactaggatttgttccagcaatcccattactgggtatatatgcaaaggaaaataaattgttctacaaaaaagacataagcactcatatgttcattacagtactattcacaatagcaacgacatggcatcaacttaggtgtttgtcagtggtgaactggataaagaaaatgtggtacatatataccatggaatactacatagctataaataataaaatctatcctttgcagcaatatggatgcagctggaggccatcatccgaagcaaattaactcaggaacagaaaaccaataccacatgttctcacttgtaagtgggagcaaaacactggattcatatggacataaagatggaaatgatagacaccaggggctaccggagcaggaagagattaatggggaaaggtctgaaagactaccttttgtgtactgtgctcactacctgggtgatgggatcattcgtaacaaacctgtacatgtacaccctgaagttgaaattatatatttttaaaaaggatgctataacttttgtgaaagttaggctggaagatgggggtatttgtagggaaaagggacaggatttaagcctaaatctttacagtttagaagagaggccactgacaaaaagtacactgaataacgcagtcaatgcagccattcaaattatgtttctgttaagttcagaaaaacctggaaaaatattgaggctcctaggacaaatggaaaaagaaacaagacacattatataaacaaaatcagtaccgctattaacaaattttaaagaatacatggagaaaaggctagaaggaaacaaaccaaaattattcaaacagtggaggatttttttttttcctttacttttctgtcctggttaacgtttctatgataaacttactttttaaatcaataagggcaaaatctgaattttaaaaaatctatattgaaagccctttcataaaagacaaaagcaactgtctttccttccatggctttcagattgaaaaaatacacgtaggaaactagtaagaggtgattcaatgactgggattattttctttggattctctctcaggttttactgaagtagttagaaagcccttcctgggcagattcagcaataataaactacattaatttcatttccagaaaaaacttaagatgtcaaatttagctaagggggatcataatagccccaaattataaacaacaaaatgttcaacgtgctgaggtttgttaggtaaaatgtggaccaaataagatgaggtattatgctgccattaaaaattttattgggattgtacattaaatggaaaagaaatatgttcgtgatatggtgtgaaatgacgagttataacatgggaagcatactttaatcctgtcttttagaattacatttttatatgtatatgtatgcacaatctaaaatgatatacaccaaaatattaataactatcttggggtggtggaatgatcaggaacgtttgtttcatattttttgctcccctatgttttctgattttctacgatgaacaaatatctgtatggagtaattataagaagcttatttgtttcccctcttaaaagtgtcttcctcccatgttagccagcctgtggtgttaatgcttccctctggggatgtgggccacgaccagttaggagaggggtgcacggcacacaaggggaaccacaacataccgagggcctgttaacagctgctggctgcttcgtcaatactatctcatctattccttctgtccatcaagcaagatggatattatcatcctcattttgcagatgagaaaacagacccagagaggtcaagtagcttggtgtggtcaaagtcatctaattagaaagtggcagagccatgatttagtccaaatctacctgcctcaaacattcatctactttttactctatcacactacttctcatgacacctctagagaagaaatatttataaagtggtgtcatagcacatgtcttccctcattccccaccctggtccctaacttcagtgccccctatactccctgactcaacagtgcatatttagatgtcccaatgccctgttcttcaggcccagcccacccagtacccacatacccagaccagaagctgctgtcctcaattgggggttatcacaccactatccctgataggaaactttggtcgtggtgcctcagcattgaccactgagtcccctgagttgtttccttaatcacatctcacatcctccacagaagatgtcccttcttatcccaaggcccagtttctaagactagcctctcctgctcactctgctccaagcccatgttcatgggactagtttcctgctgtggatgctattccaagttcctgttctaattatctgacttctccttgattctcatgtgggaactggagccctgacctggccactagtcctgacctctgtgtctggggctctgcttcctgaagacaaatgtcccagatgccacttacgtggactttggaatcgtattctcctagatgtctcactgccatggcccacccacgtgttagaacgcttgcaacttcctctgggaccttgatgctgttcaggttcatctcttgaggcttgtgtctcttgaaccagaaagtgtgaggaggtgacgtatcaggggagataatccagatcagagttgaggaggggagtcaagattagatttagggaagaagggttgtatgttcagatctgaaaaagaaaagcccataaataggctgagggaagagtaggcaccctcagagtaaagatgggtcatgatgtaggtttcaaaatgggtatggcatgtgatttaggactaagactgcattcaatgaaaagttttagaagcctagaaaaatcattctattagcttaaaatgcccctgatatttgaaaaggcatattcatgaccagatacccaaccagttgctttaacaatagactgacaagtattggggaaatcaaaccttgtctacctgtctaaacttggtggatatctgggttgtctcacctggctggatgggaaccagtcacagattaagatttctccgtctcttgcaaggagtcaagcagctgccttatcagcaaatctctcccaaagtgactttaaacttaaacttaacccaagaaggtttatttaaacctatatataaaatagaaatgttatcattggaatgttgtaattaggtcctttaaaaatattaagctgggtgtggtggcatatacctatcatccaagctactcaggaggctgaagcgagaggattacttgaacccaggagttcacagccagcctgggcaacatagtaagatcctatttaaaaaaagaaaaatgtataacctcttcatctaaagtaatacatcatcattgttgaaaatttagaaaacacaaaaattatacaaaggaaataaaaatcacccataatactattactagacacaaccactccattgtaatatgttttaattttctgtcttaggtaaaaagaaatcacagattgaaatgaatgactgccatttagttggtagctaacacggtaggattctgagacccactctagatgacgagtgtggagacgtttgggattgccaggaggtttgagagcaggttctgatagtgcaaggcttttcagaagaagctgatattttctgagaagcaaacaatgtttggaggattctctggatcgagagaaataactccttctgttcaatgtttaattaccatctggcaactgaggttgtggataaacaaccgtatttacctgaggtagcttctatggattggagaacattcttctttgtttcacttctgggccaagggtcttagtcttatgtccccctgggatcttggtcagagttcacctggagagagcatggactttggcttcagacaaccctgggtctgaatccagacagatcactctgagctccagttcctcatctgtaaaatcttctgttcctatcaaaggtccagtgatatgaccatgctaggtacctggcagataataaatgttaactcgatatgagtgccttttggctttcccagtgtagtcacccagaaccttcccaaggattttaaagatttaggattaaaaattcctgccaaagttctctgcgaccatcagcaaacagggtcctcactggactcactattctgcaagtccaagaaaatcacattgtttggaaacctaccctcacgtcaacaaagctgcagaagagagtctaagaacctgttaagaaaatatgaagcaaaagtactattcacttttaccaagtacttatgtgtatgttggagtggagtggggtcttttgttgtgggttggtccagtgtatgtggtttcatgggactaggattggctagagagaaatttcctgcctatcataaaggatatggcactattaggagggactgtagcataggggaaagagcatggacattatggccaagtagggctgacctcaagccctagctctgccattctgggactttggacaggttgttgaacccatctgcattacagtagtttcctaaggggtgggtttaataatgcttatttttcagtgtttgagggaatggaaataatatatgtaaaggtcttcatcaagagaaagtgctgaaaaatgctattattattatcaaggctattaataaccatctagggaaacaaagtccaaattcagaaggaagtccagggaattatctaattaaaggagctgagacacatattgtggccaagtcatatagccaggaacctcacaacaaaagggaggaggcaagtacacttagttctttttttttttttttttttttaagacagggtctcactctgtcacccagactggagtgcagtggcacaatcacagttcactgtagcctcaacttcctgagtttaagcaatccttctacctcagcctcccaagtagctgagaccacaagtgtgcaccatcacagctggctaattttttatttttttatagagatggggcctcactacgttacccaggctgatctcgaactcctaagctcaagcaatcctcttgccttggcctcccaaagtgctggggttacaggcatgagccaccatgcccagcctactacacttcattcttacagtgcacacttattagtaccagctaccttgcaaagtggtgatgaaatgatgactatttttaaaaaggctttggaaataggaattgaccagggccttggcaggagaagacacctgaccagtgtacaaagtgcaggaagcaaggagggagatggcacaatgtgaggctagaggcagggaggcaggaactagcctctgtgtaggatttcagtcttgattctgaaagcaatgaaaagctgttgaaatactctgaggaaggagataattatattgtaatgatatttgtgtttttaaaaggcctgtggcttgcagtatagataacaaattggagaaagacgagagagtatataaagacagttagaatgatgttacattagttcagagaagaaatgatgtagcttagtccagggtaatagtaagaatggtggtagacattcaggagatatttggaaggtaagatggacaacatttaaatatggaggatgaaggcaaggaagagccaagggtgacctccagggtttccgacttgcacaattggagtaggaccaggttagaggaaagacggttaatggttaggttagttattaacagggtatatttgaggtgtttctgatatatcaaaaggtaaatgcaagtaaaagatagaaagttggagatacatgcctggaactcagagaagcagccaacactagaaatataaacgaatgaatcatctatacagaggtagtaattaaagccatgagttgaatgagatcacctacagataaagaatcaagtcagaacaggagagggtttacgactgaaccttgagcaagttcaaatttaaaggccagtagtggaagatgagtagccaaagaaagtggagagagtggatgggggaagttgggggagggcaccaagaaggagctatggcacagaaggcaagggaggagagtcagttgagaagaaggatgacataggatccattggattaagcattgcagaagcttagctagagttattttggtagtgcaatgtggcctgaaaatacacagaactgggttgatgaataagtgggaggtgaagggaagacagtaagtatagctaccttattcaagtaatttcattgtgatgaagagagagagaagaccgtaactggagggggatgaagagttaagtaaggtctcagctttttttttaattttattattattatactttaagttttagggtacatgtgcacaatgtgcaggtttgttacatatgtatacatatgccatgttggtgtgctgcacccattaactcgtctcagctttttaatgggagagatttgaatgtgcttaaaagacaatgacaacaattcagttggagcacaagttgaatccagagaagagtaaggagataattgttagagttgggaagaagggatgggaccaagacagtgtggtattagtaaaaaaatagtctaacagagcaatggagtataataaaaagcccagaaatagacccacacaaatatagtcaactgatctttgacaaaggagcaaaggtaatataatagagcaaagatagtcttttcaacaaatggtgctgaaacaactgcatatccacatgtagaaaaaaaaaaagaatctagacatagaccttacacccctcacaaaaattaactcaaaatggattacagacctaagtgtaaaatgcagaactataaaactcctagaagacaacacagaagaaaacctagatgacattggatatggcagtgattttttaagtacaacaccaaaagcattatccatgaaagaaataattgataagttggacttcattaaaatttaaaacttttgctgtgtgaaagacactgtcaagagaatgagaagacaagccacagatttgaagaaagtatttgcaaaagacatatctgataaagaactgctatccaaaatatgcaaaaaactcttaaaactcaacattaagggccaggcgcggtgggtcttaattccagcactttgggaggccaaggcaggcggatcacttgaggtcaggagttcgagaccagcctggccaacatgatgaaaccctgtctctactaaaaatacaaaaattagctgggtgtagtggcacacacctgtaatcccagctgcttgggaggctgaggcaggagaatcacttgaacccgggaggtaggggttgcagtgagccgagatcgtgccactgcactccagcctgggtgacagagtgggactctgtctcaaaaaataaataaataacgactgggcgtggcagctcatgcctttaatcctagcactttgggaggccaaggtgggcggaccacttgaggtcaggagttcaaaaccagcctggccaacatggtgaaaccccatctctactaaaaatacaaaaaagtttagtcagacgtggtggtgggcacctgtaatcctagctacttggaaggctgaggcaggaaaattgcctgaacgtgggaggcagaggttatagtgagctgagatggcaccactgcactccagcctgggcaatagaatgagactccatctcaaaaaaacaaaacaaaacaaaacaaacaactcaacattaagaaagtgaacaacccaaataaaaaatggtaaaagacccaaacagaaacctcaccaaagaaaatatacagatggcaagtaagcaaataaaaatatgttcaacatcatacgtcattagggtgttacaaattaaaacaataatgagataccactatacatctattagaatgaccaaaatccaacacaatgacaacatcaaatcctgtggaggatgtggaacaacaggaactctaattgttgctggtggaaatgcaaaatggtaaagctgctttggaagacagtttggcagttaaatctaaatatactattgccatatgatccagcaattgtgctctttggtatttacccaaatgaactaaaaattttatgtccacccaaaaacctgcacatggacgtttatagcagctttattcataattgccaaaactcagaagtaaccaagatatccttccgtaagtgagtggataaactgtggtactttcagacaatcagatgtcattcagtgctaaaaaagaaatgagctattaagtcatgaaaatacagagaggaaacttaaatgcatattactaagtgaaagaagccaatctggaaaagctacatactgtatgattccaattctatgacattcaggaaaaggcaaaactgtggagatagaaaagattagtggttgggaagaacaagggatgaataagaagagcacagaggatttctgggccagtgaaactatttcatatgatactacaatggtggatacatctcattatacatttgtcaaaacccataagatgtataataccaggagagcagcataatgtaaactgtggactttgcaggataatgatatgttaatataggctcattgattgtaacaaatgtatcattctgatataggatgttgatagtgagggagactgtgtgtgtgtatgtgtgtgtaggggtgaagggacagggaatatgtgggataaccctgtactttccactcagttttgctgtgaacctaaaagtgctctaagaaaataaaatttattaatgtttttttaaaaaatgaagttggatccctactctatcatattaaaaaataaactccaaatggattgaagacctaaatgtgaaagggaaaattataaagctaatgaaagaaaatattggagaatatctatatgatctcagtttctttaggcaagatcataaaagtgcaagccataggagataagttgatgaatttgactagaagaaagttatttctgctaaatgaagaattccaaaggtaagactaacctctgggtgccagaaaggaaaagatatttgtagatgttgaggtattcatgtctagaaaatcccccaaaacagcaagaaaaagacaatagaatccactggcaaagattttgaatagacaatttgcagaaaggcaaacctgataaatttgtgaagatgatcaaatgtagtaacattaaaataagatactacattataagcatcagattggaaacagttagaaaatccagtaataacaagtactggtgaggatatggaggaaattaggaacactagtacatggctgatagaataaaaggtatagctattctgcagtacttagtgaaattaatatgactatacccacaacttagcaatcctactacattatcaatcttgctgagaaactctgatcacaagtacagcagcatgaggttcttcattacatcaatatttgtggagacaaggaactggaagtcaactaagtgcccctcactggaagaatggttacataaaatgtgatctatgcatgcaatggaatactaggcaacagtcataaacaaattacatttacatgtagtaacaatgatatagctcaaaagtgtaaagttgaatgaaagaaccattaaaacacaaaacaattctaaataacacacacacactcagaacaacacaaatacttaggagtgaatgctaagtagaggaggaaaaatggaagtaggataaaaagtataaagataaaaagtaatagaaaatggtctttgctttgtccagtgataaaattatatgataaactatggagtttgaggtacttcattccttttgtctgttgtcctaaaaagaaaaggaatttttaaaagtaaaataaatacaatataggtataataatttaataagattgtgttttgaagattaagtcagataaagcacttaacttagtgcctagaacatattaaacactcaatgaatgttatctagtaatgctatcaacactattcatgatacagctactaccaatctattggagttggcacttaaaaccaattggatttagattactttctcccaaaagatcctttcaggtctaatatactatagttctgcaagagggatagggaaataccacaggaggcccagaagcaacaggcaggagaagagatggaacatccttggggaatgggaaaggctaccatcttgtttgtagcatcataggaaactttgatggttaatttgggagaatactgattagtaaatacaatgcacagattaaggaagtaggaactgcgctagtaaaaagtgctatgaagctgggatactttatatactttgctatacttcctccaaaagggtgttttaacattttaagttataaaattgtagctgagttatgaagttttgctatgcagtgtttgatttggattacccctcccccatcctccttcttccccaaagtgggacacaggtcgttctattgaaataagcaagatcatcacctagtggttaattcctcaaagtgctgacacaagatttggtcccagagagcaaagatgtgcccagtctgcgtcctcatacaatgttaattcattcaacaagcgttgactgggactttatgccaagcactattctggtgcctggggatacagagttgctaacataaaatgataagtttaaaaataaagttaaggaagtaccaacttagaagcttaagcgccctctcaaaatgatgttgcatgtatttatttcccactggttttccgtagatcatagacgaagaagaaactcagtttatgagcaattgccctgttgcagtcactgaaagcactccacggaggaggacccggatccaggtgttttggatagcaccaccagcgggaacaggctgcgtgattctgaagtaagtaaacatggaatccttccctgcagtttatcaaagactttgtggtgtgattgcagggaaaaaaaaaaaagttctttactgagcatcagaaagttgcatcatctctctgccctcccttatctgaattctcaatagcaccatagactatcattggtgaagtgttccataaagattcatttgctagaatctctattttcatcaaataggatgattctcctggccaccctgtcctaccagagataattatattagggctggttaagaaaaattacaaaccaggtgaagataatctttgactttttccacctggaatttaacactttttcttttctcggaacatacagcacctagaatccttaaacactgcttaggctgccccgagacccacatgtgacctccattagccctgagctccactttatgatgctatcttcttctttgcccatcaaaatggccctctggtgccacttcctatctggcctcctgacctcctttcagtgagttataataggtgataaaaggtattaaccagccaaaggagttttcctctggaaggtagcattatctcaaacctgtttctccaaacttatgtgccacagaatgatggtttgggaaatggaaatagatgggcaggaaaatgatttctgtggtcaaatgtttgcaaaatgctgtgtactagatacccttcttacagattcataatactagcataatgaaggttttgcaaagtcctggcgaaaaaaaaaaatctgtttaatttggtttcacccagtatttatggtgacatctattaacattcacagtttggtgaaacataggcataatctattttaaataggtttgaagtcctatatggaatgatgctgagaatgttaggatttcataccagcaaattagtcatgggtagatggagagggttccagtcctagcatccaagaagtcacttttttttaatggaagtaggcactgagaccttcccaacagcctttctcttttttaaatcctcgaaggtcttatttatgtatttggttcatttgtcaaatatagtcattttgacagacttaacaactgtggttaactccagcccacccctgaggagatcccgataagaaagcccacctaggcatcgcaatacctgcagttcttagacttccactgtgcttggcttatggaaaaaaccccacagaatctctgaagcatctgtccattgtccagactcacccgtcattgtctggcctccctttgccgccatctgtctggacattatttgtttctttcttagtttaatgcaagctgagcatccttcctcagattccttgagcagtttggctcttggcattaatctacactggtcattaagaaaaaatcagaattttaaaagatgaaatcatatctataaatgtcaatatataacatgtctatagtatctagttaaaatgtgggagatggccttgtggaaatgaacaaagacccctgaaatgagaacagagactgtgtgttcagagcctgttgtataacaagggagtcagctgccattactagcatttggcagagtctcaaagacaggcagaggactgggaaagccttctagtgaaaacaagagaagactgattggaggttccttggcatgaggaagctggaggcaggctaactacaagtggagcatcttatgtgattggtttggagggcatatttggcttcctctggttagttctgagttgaaagttggggaggtggtgagggcaaaaaatagagcagttgacagttccttggacaaatgctgattttctgtgtcaattgctggggcccagagactaggggtcagagtactatggtcactgtgataaataaccttgctattgtctgttagtattttcactcttagcccagagactgggttcccagcttggccctcagtgcccatcccactacccatgacagcccaatggctccacagagcctggagctctaaagaagatgggctgaaaatgtcagatctatgtgaggagccttcctgctctaaaagctctcatccctctggcccagatctctggttttctttgatttattgttcttacaacccagaagcattagatctttttggtggaagccagaaaggcatctcttgtttacccattaacaatcaacgttatgtgtacatatgtttatccattaacatgtatggcttattcatttgctcattcttccaacaaatgcaactgagcttctattagcccaggcatccaggatatacacaatggaggtatattcttgaccctggaggttcttacaagtcaaataagggagagagaaaaagtcaaccaatgctttctgtgtaccaagaactcagcacacatctagcaggctttgtctaatttgatcttcacagaaaacgactcccattttacagaggaggagacaggccctggggatattaggcaagttttttaaagtcatgaatccatgtaatattaaagtccatgttctgcctttcttttatttattttttctctgaaggaatcatatataagctacaactatttattaaataaatagtaattgtatgggcaggacataaatgcattcacctcgtaaaatttcaaacaatacaaaaagtagtaaaatacagaaaaatacagaataaagaaaaagttaaagatccatgacatcttggctggacacagtggctcatgcctataatcccagcactttgggaggctgaggcaagcagatcacttgaggtaaggagttcaagaccagcctggtcaacatggcaaaaccctgtctttactaaaaatacaaacattagctgggcgtggtggtgcgcacctgtagtcccagatactcgggaggctgaggcaggagaataacttgaatctgaggggtggcagttgcagtgagccgagactgtgccaccgcactccagcctgggtgacagagtgaaaccccatctcaaataaataaacaaacaaataaaatccatagcatctctctcaattccagttttctacacaaaggcaataatagaatcaatttggtttgtatgctttagacttatctctgcttttacattcacgaaggtaatcataaaagcacatagtttcattcctgtgggaatttaaggttacacaaatggtatcatgttatgtcctgaacttgaatggtttttcactaaataagatgtattagagatatgtctgggtcagtacatacaaagctacctctttttgttttttaactgctgcatgtctatggtatggatgttaattattccaaagttagtggacatttagattgtttctggtgtcttactatgacaaataatgttatgatgaatatcctgaaacttgcctattgagcaaatttccaagtttttatccacagtagatgccaagaaatgggatcataagggatgcacatttataattttattagatgctgccagatttttctccagaaagcttgccaacttaaacactctccctgactgtgaacaagagagcctaaatctttacttgctcaatggcacttggtattatcaatctttaagattcataaagattgtgtgaatggcccattcatattcttgtccattttttaataatctgtcttttaaaaattgatttacacggccgggcgtggtggctcttgcttgtaatcccagcactttgggaggccgagccgagaggggggcagatcgcctgaggtcgggagttcgagaccagcctggccaacatggtgaaacccccgtctcttctaaaaatacaaaaattagccaggtatggtggcatgcgcctgtaatcccagctactcaggaggccgaggcaggagaatcacttgaacccaggagatggaggttgcagttagctgagatcctgccactgccattcagtctgggggacagagtgagactccatctaaaaaataataataaaaatttaattatatatttaattttgttttaatatatatattatatttaaaatatagcttataaaatgtttttataaatatatgtaaatacatcttatatatttacatacatataaaataatttgatttatttagaacatatttatgtttaaaattgctctttaggtagtccagataatgacactttgttgtaaatttcaaatatttctctccacctttcttttaactttgcttgtgggtgtctaatcagtcaaaagtttgaaatttttatgtaatcaaatgtatccatcctttcctttatgaattttgattttatgtcttgttcaaaaataattttcctatgcctaaggctataaatatattcccatattttatagattttaaaataaatgtaggtctttaatcttcctggaatttaatgttgtgaatgatatgatattaataagctaccacagaaaatagatggcatgctcaaaatgaggtgccagaggaaagtttaataagggtctattcacaatggtgggggcaaaataacagtgaaggagggctatacaaggagggcctgaagaagcaaaaggaaaaggcagagaggatggggtagagaggaccacccctttacaggagctaagaccttcggttaagggaagcaactagcctcaggtaccccaaccctactcctttctctaattccttgtggactctccctttggtgtggctccaactacaggaacacagagcccattgatataatctttacggagtattctcagtctttaactagggagcagaagagtagagcaggtatccagaggaacaaatcaaagatatccaccatagatgggaaattgaaatctacctatttttccccaaatgggtagttgtcccccatccatttatcaaatagtttattctttccttgatgggctgagatgctacttcattaaatgcaaaatttttatacaggtctggtctgttctgttgatctttttatgtattcttgcatgaaacccacaccattttatagtgtaaaatggtttgaaatggttatgttttgatagcaagtcattgctcattagtcttctagttcaaactgttcatggtcattcaagcagatttctaattcctgacaaatcatagaataagtttgttgtgtttgataaaaaatcattttgggatttcgaatggctttgcactgaattaatagtttcccagaatacataagatgcattctcagtcaaaaacatggaatgttccatatttattttggtctttcgtatccttcttaaaattttgtaatttttcttcatttagattgcacattcttgagaggctttttccccacataggtaatttatagttttatttcttttgtgaatgggatctttgtcttgttgtgctttctaatcattgatcccttgtgtttagaaaagctatcaatttttgtaccttaagtttgaatttgggcactgctgaactctcttggtagttctactggcttattctttcattcttttgggattgtcgatgtaaatgatcatatcttaaaataatgaatatatatatataccttttgtttcttttttatgttttactttattatctagcacctctagtacagtattgcatagtagtattcatgcttattccagattttaatgggaacactattttacttttaagtgtaatattcagtattacagatttcaaatcagtgcctttaatcaagttgaggaagaccctttagctaagaaacttcccttctttatcatgttgaaggtgttatttgggaaaccaaccaaccagtattccatgtgtaagagtaaggcaagaagtgtaggcacccagagtataccagacattgagaaagattcagggtataaacaatgatcctgactttcaaaacactttcagcctagttgtgatgtatattaaaatatttatgcaaaagctagcaaaccgaagacagatattaatgggggacaaattaaacatggtaagagttcagagaggagatgaatgaggaatggaaaaatcagagcctcttggaaaggttagcagttacatcttgaagacagtgttagggtttggataaaaggacagaagggaagaggttattccaggtaaaaggggtggataaagtgaaaactgaagtgagagcaaacatggcagccctagaagacagtagacagacctttcaagattaaaaagcctttggggacaaaatctattgctaaatcatagagtccctccaatgtcaacaggaagagattgaacttgattctaaagtagttgagggagccattagtagttattaaacagtggactgacacactgggaggaatgttcattaaaaagttaataagggtgggccaggtgtggtggctcacgcctgtaatcccagcattttgggaggctgaggcgggcagatcacctgaggtcaggagtttgagaccagcctggccaacatggtgaaaccctgtctctactacaaatacaaaattagccaggtgtggaggtgcatgcctgtaatcccagctacttgggaggctgaggtaggagaatcgcttgaacccaggaggtggaggttgcattgagcggagatcatgccattgcactccagcctgggcaacaagagtgaaacctcatctcaaaacaaacaaacaggttagtaaggatacttaaatctggcagcaaagttcaggacagataaagagggggataccaactgtgctgcagagccctcacttgtaaaaaggagcatttgtgttgtggtgtttgagtaatattcctgggagaaggcagcctagtagataagctgcacagactgatgaatgtctatagatgacagctctgaagcccacgtagctggttgtgttcctttgcccaggagtgccgggaaggaaaatacatagcaattatgactttccttttggcacaaacctgacaccatttccattttccatttggatgcaaagctttgaacatttctaaattacagactttccaggcagccctccttatagacttctccctacaaatgagcgacccagcacttaaagtttccctggcatatgctacaatgctgcaagaatgctgcaaaccatcatagacaagtagcgattgattaaaagaaaaagccgccatgagtagaataaatgtttacagaccccaccagaaggaagttccgtacccttcagtctgacaaaagttttatctcatgaagtgatcctctgtttccatggatttgttacctttggatagatttccaacacttacttgtcccttcctggaagggtctgagatgtagatcatccgtctcctgagaacacactcatttggtaaaccattaggaaattcattcttaggaaacagtggttggtaaaaggcagacgtaagagacaagagccaggcactgttctgggtgcactacaaatacttatttcatcctcatagcaaccctatgaagtagatatgaaggaggaagctgaggcacagagaggttcagtaatgttcccaaggtcacagagtaagtgacagagttgggattcaaacagaagcatctgggctcccaagtctgtgatcttcatactgtactctgccatctcagtctgatgccacagggtcaggttgaactctgactcttctctccctccaacatcattagagccagatcttggctctttttttatcactgctctacattcattgcctaattcacagacacttcttgcattactcttacagaaacctcctgactgatcactctagttccttaccctctggtcctcctcacgctggtataagacttgctgtcctcaggcccatctgagtcacaccacttacctaacacttgaacagggctccccagcaccttcagataaagtccaaatcctgatcagagcatataagggtgcctatgaccttcaccaggttcctcaccagccttccactgcatctctctctctgaactctgaatcctccctagcctttcttgtctgtccattcctttggtagcacttactgaacacctcctgcttgcaggcagtaaggacacagaggctgcctttgaggttggcacagtctagggaaaatcatgaacatacaaattgggtccacagcccttcatccacaaactgaaatccagaaagctctaaaatccaaaagatttttcataactcatttagggccaaaacctgccctaaactgcctcaaagttacgtatggtctttttgtgtacatattaatgtgtttgatggtgagatgctgtcccagaccctgatgggggcattacaagatacatggaatgtgtactatattattcaaaatattcttaatttcaaaacatatctggcctcaggtctatcagagaaaggaccttggccctgtcgatgcaatccagggtgggaaattcagtaatggaagcatcactcagggtgcttaggcagccctctggcaggactgggtttcatgtaaatgttaaaaagaagcaactcatttcttgctagtgaaataacctattcccagctgcagctgctacaagatatgagaactcattcaatgtttctcaccaccaaagaataaagtcaaaattccttaacatgatgtctaactctgtatatttctagccacctttacaaccttatttgtaggaactcctccccacacaggactctgagcttcataaaggcatagatcaatttcattcttctttgtggtcataatgtaggtcagcaaatcacagcccatgggccaaaactggtccattgcctgtttttgtaaataaagttttattggaacacagttacgttaattcatttgtgtactgttagagctctatcaagctatagtagcagaacttaaaagttgcagtggagaccatatgtcctgcaaagcctgaaatatttatctggccctttatagaaaaagtttactgactcctgttctaatgtacactccagcatcaggaactcgaaaattattgattcttgtcctaggttcttctaaaagcccagctgagacctaagtttataagcaggtagtttatttgggaaatgatcccagggatcaagagtgaagggtgggggtggtgatttggtcaagtgttattgacttggccaccactgcaggccactggtgtttgaccccagttggggcctttggagaaggcttatgacatgtgtctcagaacagtgtgcccagggtaaaccggggaagccactatccattggcctccatccttcactaatcaaaggtggccccatagcattaactctcctccacttctgagatgcatacatgtgagtattcttaagattctgaacacttgctgcagcatcagagaagctctgggacaggaatcaagtggtacaccatgcaggcaagacgtgcatcatcccattgcagtgggggcagagatggtcaagtctgtacagagttggtcactgcaacagtggttggagtcagagttgtgctgagaggatgtgaagaggggtgtagagttgcctattatggtctgaatattttgtgtccaccccaaaatccatttgttgaagtttaatccccatcgtgatggtatttggaggtgggacctttgtgctataattagatcaagagggtgaagccctcaaaaatgggattagtgcccttataaaaagacacacagggagagatgtggtggctcacacctgtagtcccaacactttgagaagccaaggtgggaggatcgtttgagtccaggactttgagaccagcctgggaaacatagtgagaccttgtctctacaaaaaataaacaaaattagcctggtgtgctggtgagagcctatagtcccagctactcaggagactaaggtgggaggattgctggagcccaggagattgaggcttcaatgagctgagatggcaccactgcactccagtctgggagacatagtgagagcctgtctcaaaaaaaaaaaaaagagagacagggcttccttcctctctctgtcattcactatgtgaggacaggaggagatggccatctttaaaccatgaagagggcctttacagggcactgaatatggtggcaccttgatcttagactttccagcccccaggactgtgagaaataaattctgttgtttataagctactcagtttatgatattgtattttgttataacagcctgaacagactaagacagtgcccaatacattgattaatcaaataataagtagcttatatttattgctaaccactatgctaaatgcattgcatgtcttatatatgtcttatgtaattctcataaaagccctatagaattttcactatattattcccattttgttcataagagagctgatgtttagacagttgatgtaaagtaatgaggcctgggacttcaactcacttctgcctgactccaaagccctaatcaccactaagctacactgactaagcttgactcccctccccacagctcctgcccaccttctgcctcagtaggtctgtcaggagtaggacagagctcttcctataaccaggggttggaggtctacctgtgaggtgagatattgttccccaagtgaggaaactaaatgtcacttagaaaatggaaaacaagcccagggaaactggcaagagaaagacttgttagtgggaagagaggatgagtattaagaagcaattagctagcactcataatactttgtaatttcgtagggctcactaactctttttatcttcaaagaaagtaacagaaaaccacatgcaatgactccgtgtgtgatttagaggaaaatggcagggttaggaggatctgatgtggctggggcgaagcttaccccacagtttttctggcattaggtagcaagaggaactacaggctcctttgttgtaagtcagggtggttttacttcaggcagcctagaacctcaggaaccctgaccagggaggaagcaaggagtcaacagaaaagggactaggaaacccctgaaccagctaaagtgtcagattcttgggagagcagttggaaagaccaatgccatggctaaatgaaaacatgtgcctgattaggaagactcagataccccagaatctgccatccaacaggtggaatccagatgccagaggttctcgggatgccagtgggagcatggctccaggggatcagtccaatggcagcagagtttcattcaacagctgggatcccaggtgcaggatccagcccccaggggagaaaactggaaagaattaaataggaagtacaggctgccgaggaacaggccctagacagagctctaggcacagcagtaaactgaagcttggtgggaagactaaagcactgccagattgcaccaacatcgtggggatcctgggattgactgcaactttgttggcatgcaagaacacatggcccgccctatttgtgagctagcaccaggtctatggcagcaagactagttccaatcctcttccactgatggagtgggagttgccaatatattccctgccctggtcaagttgggatcaaaacggaatgtttcaaccctatgaacatttttataattgaggttaaattcacataacataaaatcaaccattttaaagtgatcaattcagtggcatctggtacatttataatgtgcaaccaccatctctacctagttctaaaacatttccatcatttcaaagtaaaaccccttattcattgagcagtttctccccattctcctctccccaccccagcccctggcaatcaccaatctacattccggctctatggacttacctattcttgatatttcatataaatggaagcatacaatgtgtgaccttttgtgtctagctttttttcacttaacataatgtttttgaggttcatccatgttgtagctttatcactactttattcctttatatagctgaataattccccattgtatggatataccacaatctgtttatccctgtgaacatttttaacatgagatgatcaaaggataaaaatgagaactttgggcaacagtgaaaaagtatcatggtattattcctacattaacttttcagtccctatttttttaaccaggagataattggcatgttgcctcacacctaagtcccacaccatccataggaaggacagtaatgactccaaacaagagtagaaaaggacaaagaaatggttttacacctactttgtctttcagggtcacaaagtatgaaacagcctgtcccaaaaatgggttgattagatctttggacacccagtgtgtgaccacagtgcaacaaagtcatatacttgggcatttgttccttcatctggaagaagcgagggcagaagccacctgaaggtcctcagtgctgtggaagatggcattcctctatagatgctctcctgctctaccactgttcattctcaattactaatcaaataagtgcacctgagttatttacctccctgcaagcctgctcacaacaaagaatacccaacctaaagtcagtgaacaataagattgcataagaagaaagaatgtaccacactccctccataattaattattgtgggctgatttcagctacatttttccttgggcattttcctaacagttcatatttaacagtccctggaagccaggaaaacagaggagaaaaagctcctttatgtcttagttctatgctattcataaatgaaaatcattgttaatttagagtttgacagctgtggtgcacttgtaagtccagggcagctgtcatcagcactccagtttatttttcaagcacatgtttaatttgactttagcgctattgccagttcttaaggagaaagagggggaagcagaaacagaaataatcattatcttcatcatttggtttcctttcaaaatgtaaatcggcatgattaacaatgatatcagaattgctctaattgcagttttgggtgcagaactagttagctatcatctcctacatggtccaaagtctagttttcttttctttttttttttcctcctaaagtcagagggtgttttgtggtaattacacgcagactctgaacaacagtcccagctccacagaaaagccttccaaagtgcagaagaaaatcaaaaatcaaggaatggggaatgatgggggtgactaggccacaatcccagatgaaagccacaggctgagtcttgtcttgtggctctggaatcaggaaaccagcgagagcaatcagagcccttggaacagcagccaggatctcccgctcttacatatctaccatgcttctgcggccaggcagctggctttgtacaggctcacagtgtgcaaatcggtctcaaagtataaaattaaacacatctgtagctccacgtagaaatctgatgagtcagtatgtacttgatcgggcccactgttccagtccacgttgcttggaggaatcttccttcgcaccagctgtgatgctagctaaacccacttcctggatctttcttcaccctcatttttatatgtgtggcttccggaggtctcacttggcctttattttttgccatctgtcatgtgtccaatcacaatgtcccaaagaacctctttgacattgcctctgtagtggggacagtagatgcaataacacactcctatctttctatttgtttctttgtacattgagatgaaagactgccttgccttcttcatcagtcaacatctcgatatgtgctatgctaaaaaagatcccacccaaaggaaaactttggcaaatgtcctggaccccagctctgaaattaaagtttgatagaggaacaatctacaacttcacccttctagtgccggaggatcctctagacagaactaaagatgtagaccctgaggggcaagtctgactcctaaaagggtagtcttccgtctttttaaatggaaagtattatttgtagattatgagatcagaactaattcttccttaacgatagaaagaccaggcttctgccaggttaacgtcccaagaatctgtgagaatccttagggaattataaacatgtaccaaaaactactggctgttgcttgttgcttgccaccttggccatccacctggggctaggctctggatctgttccgtgggcagctcctctccctgcctttgcctcaagcttggactccaggctgtccattagtacccacattatggttagggccaaacagcaatggttaataagatgttgaggacttggggagtgccccaaagtcctcacagagatcctacataactggactaagggttggctgctcttaggcccacgagcccaagctcatccttagaggttccctgctctcagctcctggcctgtctcacacaaggtgggcaccaggctgcctgcctaaccccagtggcctctttacttctccttcaaagattacccctgtacaagtcccaggttgccccaatttccagacctaactcccctccacactagtttgcttagcattgtagttaagaaggtggacttccaggtcaagtgatctgagattgaagtctggcattaccacttactaatgacgttaggcaagtcattttagacacccagtgcctcaggtgcctcccccataacatgggggtggtaatattaatagtatgtacctacctcatagagttgctgagaagactaaatgagttagtgcatgtaaaattcttagaacacttcctggcacagaataagctctaaacaaggctatattattaatgttgctgttattactattgctttacatttgcaataaaacaaagatcatcatgtagatgtttcctaagacaaagaagtggtctacccaagaagtgaatttcagtttctggtacttaggacaaaaactgtacattttaaaggtcgtttttcaagcttcaaaaactgtttagtcacactggatctccatttcttttacttgcttgctccttgccacttcccataaagaatatgaagtggcattaagaaaaatataaaacaaagtggtcgtgttaaattaaaaaaaatcaagaccagggaaaatcaacattaaaatataacatcggctgggcacggtggctcatgtaatcccagcactttgggaggctgaggcaggtggatcacgaggtcaggagattgagaccatcctggcaaacacggtgaaaccccgtctctacttaaaaatacaaaaaaattagccaggcgtggtggcgggcatctgtagtcccagctacttgggaggctgaggcaggagaatggtgtgaacctgggaagcggagcttgcagtaagcggagatcgcgccactgcactccagcctgggtgacagagcgagactccatctcaaaaaataaattaattaatcaattaaataaaatataacatcaagacaggaggaagatctaaagcatgctaagggctctaaattctcatacacttataagagcactggattacaacccattaaataaaatggaaataaactaaataatataaataatataaataaacacatataccagttaaacaagtggatggataattggaaagtttgataaggaacaggaggtttctataatctcaaagtacttgcccttgaaatacttaatcactaaaaagggagaaaagcaagaactttagaatggagaaatctggcagccacctgtaatgtgtgccacctgataggatgcaatgagaagaaaacgacacagtgccacttctgtgatattcctgctagagatgcataacctgaatctaattatgaggaaacatcagacaagctcaaatattttacagaataaataacatgtaatcttcaagtttcaaagtcaaagactgaggaagattctagattgaaggaaactaaagtgacatgaaatctaaatgcaacactgtgattctaaactagatatattatctgcaacagaacaattgttgaaatgtgaatagggttcgaggattagatatatcaatgttatctaatctcatggttatattgtggttaaatgggagaatatctttgcaagaattacacaaaaaaagtacttgagctgatcagcatcatgtcaaccacttactctcaaatgcttcagggtaaataagttttttataccgctcttgtaagttttctttaaggttgaaatggtttcaaattaaaaagattcagggttgccagacacagtggctcatctgtaatcccaacaatttgggaagctgaggctggaagattgcttgaacccaggagttcaagaccagcctggaaaacgtagtgagaccttgtctctacaaaaaaaaaaaacaaaacaaaaacttaaaaataaaattagctgggcatggtgatgcatgcctgtggtcccagctactaaggaggctgaggtaagaggatcactggagccaggaagatagaggctgcagagagccatgattgtgccactgcactccagtctgggggacagagtgagaccctgtctcaaaaacaaaaaaaggactcggcaaaatcagggggtgttggggtggagaggaaaaaagagctatattgacatctttccttccttcctttttttcttttctccctggcttttttctctcagaaggttgggccaagattttgatgagaagacactgggttcaatcaggaaggcaggcaaggacttgccagacctgaggggctgagctgagttggttcgttcagtgatccttcctgtagtgtgtgtatactaagcaccttcatcacatcccaagtgccataccagacagcaaggatacagagctgagcaggatgcagcctgtgtgaccggagactcgcagagtggtgggaaatgagccagtcaacaggcagcaacctcatggtgtgaaagggcctccccgagagaagcacagggcggagttgggcaggtacccatcctggttgagggtggtgaggaaggtccagacagcagtggcaaaaggcaacagatgaagggaagcagcggaaacagtgtgggattgtccctagaccagagaaggcaaggaacattaggggacctgcaagcaggtggagcaaggaggactgtgattggggcgaaggtgaggccatggtaaggagtgggtgctcaatgaatgttcctctttttctgtactttccttctcttctttatcgcttcctttgccaaaacatcccttctttgagcattcagctgggtattgctctaattttttaatgacagtaacaattgctaaaatatgtgcccacaatcctataatgcagatactattatttcctccattttacagagaagaaaattgaagcacagcttgctcaacatgatatagctcataagtagcagagctgagatttgaaccctggacagtctaactgtgtagcccaagcttttgatctaccacaatgccagagtacatctttaacaaggctgaatcctcaggggattatgtcttttataaagtgtcttgagggcctcaatagttctataactagaggggtaaagggagtggggatcttacaagctgtgtctgttggtgcatcttacccattccagccacctcccctcatcccactcactgccttttcatgcctgccctgttatcagttgtgtgggacctgcaatgggtccagggacacaggcagcctgggctggaccagtgagggttttacccagggtggctgcagagtcagcacagctcatagtggaggagggaaacaaagggtcaaatcaaagaaggatcaggtccaaagggccctcagggggaaaggctgtgcccagcaagaaactgggcacaaagttgggtcaaggtgagctgttcgggatggaaactgaataaagcaaagtcaaaatgtaaaaggtgaaaaaggctcttttgcatgtggtctcaggcaggagggaatgggaaacatactttccaccaccgtagaccccccactaccccctcagggctcaattatttattggacaaatatttagtgagcacctactatgtgccaggctaatgctaggaactggggaggaaaggagaaaaaacaaggcagagagaccagaggggctggcacatgaatattcatctgagaacctgaaatgccaagctttctttggaaccaggctgcatttccattttccctttagcccctggaacaaagccaggaagtgacagagttactggctggggaagagtgtgggagggagggaagagcaagttccccccagcagccgctgccacagtcatttctaaaacaggtttttacagaaaagcctggttattccattattcctctgcagccaggaaaaatccccctttccacacctgcctggtgatcaatacagatgcttctgctaattgtgttgtcaagaaggtccttgactggttctaagcattctgttaggcaaagcttcccccttgcaggtgggttttagggtcagacaggtcaaggttggaatcctggctctacccagtctgagcctgttttcctccttataaaatgggaatcaggagcaaaggcataggaagtacccctttacatttttaaaagtaatttagggtttgcagagcaccttccgctctacccccccaactacttttgctaggtcaacatcataataattgtgagaaattgaagctcagagaggtaatgtgatttgaattggatcacacagaccctgagtataaatgtcaagatatagaaactcggccttcacttttaaaatagaaatgatttgctaggcttttgtacattttcttttgtgatggtcaaaatctactgcctaataccaaggatacctacatactatctaatacccagtagttttagctgggaatttccttgacaaatggaaggcaggagagcccagtggagaagggtatgggttgtggagtcaaagttgttgggctcctaatcctggactacctcttaacagctgaacttgagcaaggtacttgatccctctatacctcagcttcatttatttgcaaaaggagtactacctacctcataggcaggagaattaaacgagataaccagggattcttggccctggctgcatattggaatcacctgagcagcttttaaaacttacctgtcctttggccccacctctggaaattctgatctcatctgtctggggtggaattagggcacccaaatgattctaatgagcaaccagggctgcaaaccctggaactaaataaaatgtctactacagagtgcctagcacatcacaagcactcagtagatgctagttatcactgtcatactggttggtgataaaaccaaggcatgtgggccaacactgatccattggtaccaacatccagtaggtcccagttactgtgccatgcactgtgggtagatacaacggtgaacaagagtgagtctctaccttataagggtttcattaattctctagtttggtaaaaaaaaaggcataaatatgagaagttataataaatagtgacacaaggtttaaaggagaaggaagaaggaaagataaaatttttcaagctcctatctcatgctaggcactttctacaccaacgtagttcattaatgcacacaggagccctataaagtagatattaagctcaatttgtgggacagaaaactgatgctcagggaagaaattcacctacacacaaaacagctagatccagaataaaattttatctgcctgactacagaggtctttctattgtaccatgtctttagcacactgatttcatggtgattataagaacaagtaataagctggtaagaattagaatgtagaaggttcaagtccttatgtgtgtgtgaatgtacacaactatcatctatctgtcattctatgtatctatcattctatccaattatccatccatccacctatccagtcatctaattctgttatccatcattggttgtaaaattagattttcagcttaatcaaatatttcagttaataggtcaagcttttaaattactcttaattaattctccattttcctgcataaaattaaaatattagcattaagccaaacaatatatcacttccagtaaatcatggaggaataggattgctgatgttattctttaaagtgtgctaatggtatcagactatttaatgtagattaactaccaggcctaaacagtaatacaaatagaggaaaacaaaattaacgtgattaaatacacttggaggctatttagtcaacagtcagattgcagacatttgcagctgcagctccaaaagctggttctcttctcagctgtcactaattaatgcgattttcctaataacagttttctgatagacagacagcatcaaatcaaaacaacttcatttttatgctgatgaggcctaactactgcaacaagagcccaacagatgcaaatggcaatgttgctaactgcaggcttgcatgtggtcttaatcacacacaagttgaccatcagtgctggaagtttattgcacaaatacatgggatgtgggagagcttggctagttacatcgtcacatcagccttggtagtactgggtcacagtgggatataccacagctctaggagaaaagtgctctagacaattgtccattgctccggacctacacctgtgtaagtgactcatcttcccttaatttgactgacacttatttttcccaaaagacagaattcaagcaggccggttcacatcattcaatattcagaacccttgctgggcagggtcagcaggaaggcaaccccaaaatggccagcatccctcaagtctaatatggatgactttggctcaggcattgatccctggtgtaatcaattgcagttaatcggtttctccaaagcatgttacataaatcataaatatttatggatcaagaaactggtttacatttcctaagaagggtactagacacatggaaggccaggatttactaccttttctactgacaaccagtacaatagcatcgcaaactgggccaatcagtggcatttgacctctggccatgaggaacttctggtcatctctaggggagcttgaacagagaagaatccaaattggcaggagagtgaattgtagattttcaagaccatgtcagcccagagaaacactgtacatattgatgcctttggatggagaggcattaaatacagtgcaaaatgttattaccaaaagattgttgccaaatatcctccgaggataagaattctgctagttgactttcttgaaatgcatctcactttataatagaaacatccttcacatggagatatccagaaagctagggaaatgtacatcttaatctcatggcccagactcatccatttacaaacaaagcagtgaccaggacaaagaccctggaaaaagtttgggcccaccacactgtgagggtccagctccagggaggtctgttgtgctgcaccatggaggtggcaactacctggttttgctcttgttcccttacacagatgaggagatagagacttccccctccttccctctttttttcctctcttctcggtgatttctacctatcctactttgtaaaggttttaagtgttttcaagggacacattctctgaagttcaactccctcatgtctcccagatgtgcaacatggaaatgtacatgttacattgtcaaccttaggatatagatttttacttatgtattgggttttaatttattccttgccaacttgaaaacaatttgcagtaccttgtttcacacagacgctccagaatgattcccaagtctcccaacataaacatgagtggtttaccattaaaataaaaaaaattcatcatttacattctgctctgcattaaaatgggatcacattaatttcttttccacattattcactaagaaaactagagttcttggtttccttccttccctcccttcctcccttccttttttcttcccttctcccactcttcctttcttccttcctttcttgtagctgaaaatatttctgtgagaaagattaggaaacaggacagatcatgtccggattttgtagcttacatatggtctcatgctgttgccccagaactctgtgagggtccaagatgactgtggcttacgtctgatgagcttatgccacataaggatgaggtcagatgctacaagaggggcacagacattgaaaagaagaaacatggggcaactcaatggatgagcaaagttgaatgcgttgtgcagtcagcaagtgtcttttttataagaaagctctgtgcttggtttcacctcctggtgctggacataccatcatcctgctgattcccaacattgtgaagggattttgagttcagcctccgtggttccttttgagaacaatggttgccatcagccaaactgcctagcttggtcaaaacacagaaggcataaacagcctttatgcagtgggaaatgtttcatgattcagaccagtcactgtttgctgatcacacagcactctgggtggcactgctaatacagaggagtttgtgcttcttgccagattgtggacatatggcagacactcaaaattatgtgttgaatataaaagagttgaattatggggaaagtcagtgtattgaaaatgtatcacatcagcacacctgcaatgtttcctgtaggaaagctcagtgccaaatgttagagggtccaccagggaataacaaggttcctaccctcaaaaagcttggaattcaggcagaaatgcaaaatataaacatgcaataaatcaaaggataatacaagatattaaataaagttcaagcaaacatcaagagtacccaatgcctgaatgccaaatgaacagtaacaacaaactgtgttctagaagtctggtggagggacaggtcacttctgatggtcctggttaatgcggctctgaggaggaagtgagatggtgacagatgattgggatctgacgaggcagagaggagggtagaagtgaggaggagacatgtgacacacatccacacagtaaagctgaattcaggtacttggggaggggggtatcagacctgaaaggtggcttgcaccccagtgttcagaattgtggatgtttagccaagacttcggactataacctgtaagcgagagaggagcctttgtttagagaggacctactgtgtgccacaccctgtgctggggtgtggtagaggttgggggtgggataattaggatgtggtgccatcgttgctaacaatgtgtgaaagaaagtgataatgaagaggtgatgatcagtcccctggcagagcataggtaaatgggatgggttggcaaggacaggagaccattaggaggttactgcagtaattaaccagaaaatccttcacttaatcttctgtgtgtgtccttccttagggtgaggtagaggggagtcaggtgggtactagcaggcatgaaaatcaaggcttctactttagacagctgctcttatagaatctctccccaaagcaatgcacatgcttacaattttgcatatactttccatacagttttttcaggggttcaaagatcctctggaaccaatcatggtctatgaggtcctagctgagaacagtgacccccctcccacacctccaaccccacctaaagagcaagcatctcccaacagccagttctactactctacaggatgctcccatttccacagcagaaaacctgagtgagaggaaacagaaagaaggcaggtggcccgccctcaaggaccttgctctgtcacctggattgtttccttacacctgagaggacagtgctcttgcagtcagccctagtttgcaggaacccacagaagcgggaggaggctgaagccaaggcaaagtgggacgaactgcggagagtaatgacttgcatgaacccagccaagagggagcttgcaatgtggcagcatttcctcttccttagaggctggggcgattatatgattacacccacgcccagccacggagcagcaaggactcagcacagaacaccggagaaacccaagagcaacacttcactttctatttcttgttttccagctgagacaggttctattttggatcagagcatagtctggagagaaagcagttgaagtcttgggtgcttggaataaaaatttgaccttaatctttaggaaaaaagtgtatatcttagttggaatattttattaaatggaatgacattcatgcccttctgcgtatctactgtcatatatttcagacctaatggtgattcttaagctttgtggggtcaggaacccctttgagaagcagatgaaagctatgaattctgactcagaaaaatgcacttgtgcacatcaaacaaaatttcatcatcctaaaacctgtctgcaaaccctatgttaagaactccaggtttgataagccttggccagatcctctgttaggtcctaggaatgcaatgatgaataagacactagtccctggactcaaggggctctgagtttaaggaagtgttgtttatagatgtgaagaggttggcagggagagccagggaggtcaccgaatagcaagtgaactgtaagaggcattaatagtcaccagctaaacaatgtcatagagacagcctgccagttgtcccttgactagtaataccccaggtaccactaatcaattgcaaaatgctaagtaatgtgctaaggctgattgaaaaataaaagtaattttttagtaacatcaaactgaaaaataaaagtaatttttcagtaacatcaaaccccttgttcatgtgttattaagagaaaagattttttggcttaatgatgtatgtgagatactgccttcaccccaggctcagggattagacaaatatctctttgcaaggttaagaaataccatggataatttcaaccagaggaagaaaaccattaagggtcaaaagacgctggaaaaaaaaattgatagtttggtttaaaacaattatagaaaatgagaaatagtcctgttaactatctagaattgcctgcctgtcagagcttccacaaccgggactacctcctgcagcctatttatttcattcatatgagttgaagagttttccaacagctgacaaatttccagccagtgatccagcaggtacccctaaggatttccgctctttcctgagcttcaccttacaggcatgtgaaagcttcctccagagagaaaaaaagtatttcccttgcttgtgttttcctgtcaaactcctactcacaacccccaccccacctttcctttacagccacatctctgggatgtaaacttgaaggcctgacccagcacagggaccctctggttcccaaatccaaggccttcttataaggccttgtccacagctgtccctcttctccctcttctcagtctcttctgatgaagggcatccctgcccctcactcccaccaaaaaccgtcagtgtgggagcaatagctcacacctgtaatcccagcactttgaggggcctaggcaagcggatcacttgccaggaattcgagaccagcctggacagcatagcaagaccccatctataccaaaaaaaaatgtaaaaagcagccaagcatagtggcaggcaccagttgtcccagctactcaggaagctgagccaggaggatcacttgagtccaagagattgaggctgcagtaagctgtgttcatgccactgcattccagcctgggcgagacagtgagactctgcctcaaaaaaaacaaaacaacaataaaagacctccaacagctccccagtggtgcaaccttgtggcctacatatgggaccagacagagcctgactcctcctttcctctgaactgccctccctatatcccaccatgcctctttccatcagttaggcacacatttaagagcagcattcattacaaaggttggctgatgatggcttcaacaaatagaggtttatttttcccataccacaagaagccccagggtaagtgactgctggtattctttcagcagctaaatgatgtcaaggccagtgtctttgtgattcttcttggcctttcttcatggtagcaaaatggcttgccttgttccacacattgtgtttgtaagggaaagtccatggtgggtcatttgtttttcttacctgggaagcaaaacttcctcagaaggatctcttttaggtgtgcagctctactgcgaagttcctgtccctggttttacagacttagtctcttccatcttgcaaacttcccgttatgttactgaggccacatgtgggtcacatgtcctaccaccagcagcaaggaaggctgggaaagcaggaacaggactatcatgactggcatgtctgatattaccccaaacaaaatgacagctctgcaagtggggaagatggagggaatggatgctgggtagacgccaggacttgctgtgcagtgttctgattcaacagattacgtcactctcctgtcaggtgggcaactatttggtatcacacaaacaatagcttattcatctttgtatctctaagtcctaacacagctttgtggcacttactctgttagacaaacttatgagtaaatgaatgtctgtctggttttaatacctctcacatctaaagtagttctttttaaaacacaatccagttttattcttgtctttttatatctcttatatgaaaatcaattcatcattagttttccattggatttgggcagacgggtaagttgtaaagtgctagagtaatggtattgacaagttatatgatgaagttgaacaatatgagagaaaatgggatcatggtaaccttgttatccctaggtcagtttaactattgaagaggaaataaactgagcactaaaactagctttcctttagtttttattaaaatcagaaccagggctttgtagtgtaactttgtgcaatgcgaattgagagcttgagaaatccaatgaccacacaagtttgggaatgggttgtagtcttgttaagagcctaaccgacctcttacccaaattctggtaataatcaaagctgcacatgggtgtgcagcaccatgtggagctgatatctctgattcaggtcgagatgtctgctcagagcagagaacgttgtttccaagggccacagatggtgggcctgccaagggtctcttttaggtgtgcagctctactgcaaagttcccgtccctggttttaaaaacttagtctctaggactccaagtccaactcctgtgccatttttccaagaagttacacctggtcaacctcatttctaccaacactttccccaactccacctcactccagccagaaatggccaccctccgctgagttgtagcacttgtagatgattgtttgattgggattctaacagatttgtgttgtgagagtcattcgggtatgttccatcatagagagtgccagagtttctttagaatggcatgatctagctttcatctaaccttattgcaccatttggtacccagactcaagcccagtgaattgtatcaatgtcaatatcatggttgtacaattatacttaagttttgcaaagtgtcaccattgggagaaaccaggcagagtacaatcactttgtattcttttttacaaccatatatgaatctacaatatctcaataaaaattttaaaaataaaaatatttctttctaatccccctgtcttttgtgtcaatcctagcattactatgtctccctctagtcattggtgttcgtacctaggagtcagttcccttacctccctctatctcagttttctcatctgtaaaatagggatgatagtaatgcctacctcttggttggggggattaaatgagttaatatttgtgaagcacataggaaggtgcttaactgttaaataaacaataaataaataaaatatcttatgcttaactttctctttctgccttagatccaatatgctataagtcctgatgaattttcctaccatgtgtctcatagagtctctatttcccatgcccctttctcagttctgaccttcagagccgccgccatcatctcctcctcttgaagccttgccattgtgaagttagtcacttcacctctgcctcccatggctcctccattatcatgttccacattgatttccagtttcctttttctgtttatctcttttcacccactagcataggagctccttgctggaagtcatcgtttcttattcctctttgaagtttcagctcctaacatagtgcctggcacaaaatgagtgttcagcatatgtttttgagtgagtgataattaatcaggaataatctcatttcagctactggaattgcttttttgcagtcatggtagatgacctctgaatctatagctttgtgaccccaagcagagactgcagccttaccctttaactctatctacaagtcatggagtcttgtagatagagtcttgtagatagagtcctgcagataagttttcacttttcttctcccatgggcccactgtcttgggcttcctggatacttgttaactcttgaacatacctccatttcttgagacccacctaaagccatatacaagattggtgagtgtgcatcctggcatgtacacagcctttggataaatatgcggccatcgttcagttagcccttggcatccttgtgaagtaaaataagggagacggcctcagcatctgatattatcattgcagtgacttcaatatttgattcctgggtcatcccacagttaattttttcattggtagatgggaataaatattgctggttataaactggaccaactctatggaaaacattactgagatcatagagaaattttataaagtatttcaagaaatattcagtaataaggattttactggaattgggaagaaggctggcaaaaatagtctagagaccacaaacccaaccttcattttggcaatttattgtctctgtctgaagcagctgactaaggtaatactctcactcctccttccacaagcaaagaaacagacctgacatcaatcataaaaacaactactgtttattaagtacttattacgtgccaggtactttttgttaggggctggtgacttaacagcagcaatgataatgaccaccacatactggatatttaccgtgtgcaacacaccacagtaggaacttacatgaattgtctctatatggctgtgacacattccctgaggatccaggtatattttttaagtcatttcatgacctgatttctcccaagtacttcagtttctgagatctctctctcccgggagcagggaccccagccccttttagcactagacagcaaacccacaacttcacaaactctaacttcaccccaacaggcagattccctcaggaaaaagagtggtaaatgaataaaccctccaaacagaaaagggctgagcacctaagagattcaggatggcatttttggaaatgttcacttcaggttgaaaagaaaacttttgaaatgattagtgagttatttagaacctcaatattctaaagtttgagaagataacatactgaggaatttaatttagatttccttaacatgctctcttatgataagagagcattcagtatataaatgctatgcaacagtactgccaaattgcaacacagtatgggagaaatttgtcattttgaaatgctaagggagttcttactaacagctttctcatcttgtaaagctattatttttctgaatgataatatgatttataaacctcagctgagttttatagttttgatgggaatagactcaaaatgcattttctcagaatataaaattctctcaggagttgaccaaatgaggaataaatagaaacttccgcaaccaagtgtaccaaagtcttggtctccactagcatctctgtaggtgaatgttggtcttcctcagggttctgggctcagtttgactctcactctcaactctgcacgctttccctgggtgacatcagccactccaaatcctttgactcttacctaggccagcaactcccacgtccacactcccattccctcccagctttccagagttacaatgccctatgtctaacgacccactagactgcccaccatcacaacctaagccacattagcctcagattctctcctgtccccaaaccctgttccttctcctagaacattggtagtagaatgatactaacatttggaggaataaggtacgaatcttggaatctagcacaggagactgaaaagtgaataggtaacaacagaactcagggaggataaatgaaattcatacataatctaacctttttttttgagacggagtctccctctgtcatccaggctggagttcagtggtgcaatctcagctcactgcaacctccacctcctgggttcaagcgattctcctgcctcagtctcccaagcagcatgggccacctcgcccggctaatttttgtatttttggtagagatgaggttttagcatgttggccaggctggtcgcaaactcctgacctcaagtgatccatctatctcagcctcccaaagtgctgggattactggtgtgagccacagcacctggccccataatcgaacattttactgcagaatattgatgtgtttgattatagaggtattagtggtatatgtacaatcttaactttctgatatctaaaagtttctgaattccaaaacatattccagaccacgggttttgggtgaagaatttgaggacctgtcatatataaagcataagttatataaggtaataatgtatattaagtgcctccttagtgcagactagcacatagtaagggctcagaaatgacaacaattattaaaaagaggaaatgggttgccttagactttatagaatattgaggaagctgagacatcttataggaaatacatgtttttcatctctagtcccccaaaatttttataatcatatatttcaaaaatttgagggcaattacttttctatgcactatcatgcttttaaatgataggctttgccattgtccccctatttacagtaggaggaagaagattcagagtatttattacagaggcaagcaaaggcaggcatgggtgattccggagaggaggcagcacaggcagaggcctggtcgagttgaagaggtgttcacacaagaataaacatcgaaagtctgcaacccgggaagcttggcccaaagtgatgacagctgaagccaggacatgtctggggaaaattataaagacccttgaatattataagtttgtattttatcctgtagatgactgatttttaaatgtttttagcaagagagctttatggaaacaaaacttgatttgcatgggagctctgtccactgcagccacacaccaactggtttttactacatcctgagtgctcttttaaaagagcagatctgatcatcttagtcctctgggcacactcttcaaagatatctcattaaacttggagtgaaatgccatctccctgcaggctctgggtaatgtggccctacccatcttcccagctcatctcatacaggtcgagtattccttatccaaaatgactgggaccagaaatgttttagatttgtgattttttttttcagattttggaatatttgcatatacacaatgaggtatcttgggatgggacccaagtctaaacacaaaattcatgcacgtttcaaacatatacatgaatagacccttatatatatagcctgagattaatgttatacattattcttaataattttgtgcctaaaacaagtttgtgttttacacaaacattgagccatcagaaagcaaaggtatcaccaccacagcctgccatgtggacagtttgtggttgtttggcatcaccatcattcctaaccctaaatttatgtgctgccaataaatgttttaactgtgacctgatacatgaggtcagacgtggaattttccactgtagtgtcatgtcagcacccaaaaagttttggattttggagcatttcagattttagattttcagattaggcttgtataatctgtactacctccctgacttaccactcgtaggtcctcccatgagcccatgtccctcccctcctgaagaactttataagggatgccctctccctgtctcctcccttccacttgcctaattagctcctagtttgctctttcaaacctcagctctgccaccttttttcaggggagcctttcccagcatggttaggatgccctattctatgctctcctgcactccgtggacttccttgtaaactttaatcaaggttgtgttaaatgatcagctgcaggtttggttatttgatactttctcctactatgctgtaaactttgagaatgggtagtgtggccccatctggcttgtttatgacagtgtcctggaacctccctcaggcccctaagcagacccccaactatttgttgaaaatacaccagtaaatataatgggaagacaaatgggggaagaggctgttgtggttgaaattaggatggagcctttggctgaagcaggaatgtggggcctgggatacttcccactaagcctgccccttcccctccacagaggtcctggaggcacagagtggaaaacactctgaaaagcactgttggagatgatgggatgatctgactaacaaaaggctttgttatttggctttggggtgaagactgttattctcttggcctgaggaaactttcttttgcttcatagtcaaaagaatgatcaaagtagctttgcgtagacaggaagcatatttcattcatttatttcaacatcttgtctctcttgggtaaggaatgactgtaaaagacatctgtaggatggtcagaattgtattattttgtgcaagactagatgtagagtagatatttctttggaaagtcatcctggcctaggcccagaccatcaggaagattgcctctgtactctgtggatccatgcacacatggccccattcctgggtctgggatcatgtgacacatgcagatcatgtgactctaatactccttcagtgtggtcagctataatacagtcaaggaatccctatatctgttaaacagggtgaatggaagtgaaaattaccgtttgactgagtagcattgctgaagaaaatcagtagaagtggtccaagatcctttcgcattgtctcagttctaaatgttgtaaactttcaaattactgaaactctgggtttcagtatccaaccccttcaaggccagctgaaaatcaacaacagagtgggttaaaataaaagaagcatgtctgtgcaatcccaaattaaagcgaaaatatgtgctggccaaaagtaagtcatttttcagcctcaaaatattttttccaaattctaagatcctgcatttgacatgtttaagagggagatataacagctgaagttgtctttgttcagaatgtaggagacagttttgtctagactttcaggaaagatatagaatgacattttcagaacaaatcaaaatatatttttaaattcctttttccccttcacaaagaggatctgacatgcttctgtgatttgaatttggctgatctataaatggcctcaatagtttaacatgaaaagtagagtaaaataaaccattgagaaaagttattaaaatactgttagttcactttcttaccttcacaataaccttaccaccaaaaacaatttagtaactaatattgagtggagtggtttctaggtatgtgttaatctcttgacatacattttctgacttagttctcaccacaaccccataaagcaggtattgctgttatgttaattttctcatgaagacagagagagttggggtgactcactcaaagccacaaagccaagcagggactatgtctgactgatctcccaaacctgccttcctgccctcctcaccactgtgcttgggtcttctttcttcacagggccagcatcgtacaaaaacgcattatttattttcaagatgagggctctctgaccaagaaactttgtgaacaaggtaagaccctgtgggtggggagggggaggggcagagacatggaaggcagctcctcctgcacgatcctcctgctgcaagaattaaggcccctgggcttcgtgagttcctctgggttctgcttcctcacgtagctccgatttttaatctggctgtgtgctgtgggtaattggatccgccttaagctctaattactcagcttgattccctgggtagaagataatgtaccttatattggtgtcgtcttcttatttttgtgaaacagtgattattctgaagaggttccttggaataattcacaggacttaattaaggaatgcacaattgtgtacctttaaaaagtctgtaatggttctttggaaaaaaatcaccagcaagatcttgtgtggcacccagacaatatgggaggattttctccagagaagcccagcaggggatggggatgccaagggggtgttgaccttgtgatatcaccacattcaaggatctagtccttagatttgcaaacttatcaaccttctctccttaggttgaaggtattgtaacaaagctcatggaggctaactagactcgggggataaagcagagacctgagtttagatcaggcccaggttcggatctgcctctgccccttctagccatgtgacttaaatagataaaatagtacagtacctccttgacacatagtaaatgctgtctatagaatagatagctcttgttatctatatctgaaagcttattcattaatctactgcaaaaaaaattgaccttaaacatcggaatgtttttaaaagttattggataactaaataaaaataaaaaatgctctatatttatacagcataacaatctcatttctatttaattttgcagaatttttatttgcatttagagcaattagtgtttggagaagaaataatcctctccaactatagcaaagtataagctactaagaaaaagaaaggttgataaaggtcttcggggaaaacaataataataggtaatatgtttggggtgctttgctacgtgccaataactattttaagcacttcatatgcattaattttataatctgcacagcagccctatatggtaaagattattattatatttttattttatggatgaggggcctgacacaaaaaatttaaatagctttcttagcatcatatactcatggtggaaggctgggtttgaagtcaggagccaatgcccttaaccattgctttctagcaaagcaactgcttcccagttcagtagttcttatcattgcctttgacagatcaatgcattgtcctcctgtagatgagctgagcagaaactaggtcccctgtttggaattgtttagagaacatggcaatagcaaaggagagagagagttggataccttgcattaggatcatacctcccagaggggctggagagctggaatctgcagtccagagaaccctggccagcttccacatggacaccaccacacgtgtcttctgaggcttttcttttttgtgttcaactgcctgcaagttcactcagcctttctctacacagggagcatctccacttattaagctcttggttcctcaatgacaatcccatccctgctgtatcttcatgtgatgagatccaggtgctgtggtggacttgtgggtgttttggatcacacatttccaagacacctcttgtaaatgccttagacaagtcttcacataacatcaggattgagactttgggaagtgcacattagttaatgattgatggcagtacatgagggtgtcagtgaagtatctcctaagaaccctcagctcctgaaaataaggctgtcctccgacagtcaaactgacaaaaccacaccacagtgcctggggagaagacctagagctgcacagatgaaaagcaaaggcaaacaatagttttaaaaagcaagataaacaataggttacttccaattaagaacagagaaacaaaatattcaaaaaagtgacctataacaaacatatgcatacacatactttatttttttttttttagtttttttgagacagagtttcactctgtcacccaggctggaatgcagtggcacgatctcggctcactgcaacctccaacccccgggttcaggcgattctcctgcctcagcctcccgagtagttgggattacaggaacacaccaccatgcccatttttgtatttttagtagagatggggtttcatctctactaaatatgaaaagatctctgtctcacaagtaagatctaaatagagatttgccatgttggccaggctggtctcgaactcctgacctcaagtgatccgctcatctctgcctcctaaagtgctggaattacaggcatgagctaccgtgcccggccctgcatacacatactttaataccatgtcacaagcaattaaatgaaagagacaaaaaaaaaaggaaaaaggaagggaaacgcagaaaaaagagaaaaatgtcaacagaaacaggataatgagaaaaggaagaaaaagggaagaggaacaaagaatacaggaagagagttgcaaaggaagtcagtggatttcaagtagaaatggggagagagggcggctctggagatgctccatagcctgaaattacccatggttggcagaccctgcctgctgtggttagaagaggagtaagtggacgattcttatcactgccctttgaaagcctgattcattttcaataggcttttccttagtaggaaaacagtatgtctgtttttattttcaaactgaaaaatttatttttcaaatgggagcttaaaaatgtatttttcaaatggaagcttattttcctttgaaaatccaaaaggtttattatgcattcctttgaaccctcagaaatatcgttaagtttaccacctatatccgaaagcccttttgataaggcaaagctaccagttggccttcttttggtttttgtagagactattgctgcctcatttaatagcccctagtagctacaattgaaacctcagcatgtatctctgatttagaaatcgtagagctatgtagggaggcaattttttttttagcgcatctttcttcattgaaaaaagcaatacagaaacaataaaaaagttttctctctttcctatctatgcagacctatccagatgaggtctttcctggagtaatgtagtgcagagattaagggtatgagtcctggacccaaaaagacctggcctccagttctgcctgccctgttcactaaccctgtgaccttgaacaggttacctaatctgcttcaatttactgacctgtaaaatggggatagcaaaagtacttacctcctagcattgttaggattaaacgagacaatatatggaaagaaatcagcaaataaaaggactcagtattttgtagttattattatgatgtctcatcctttcatctccaccctagaacctagaattcacttctatccatcatggattttatatatttaaaccaaatcaacccagtaaattccaaaaggaagtcttgtaaaatgctcttcctaacactcacaatgattttaacattctttgccactactctttgtataatatttaagaataaatgtccaactgcaaagaaaaaaaaattatgttaatactactagaggaagtgaaaaaaagcaactgaagcaagttacatctgtagtcattgttttcatcttgcaggaagcagaacagactaaaagcaacaacgtgcagctagagatgtgggtttgacaatcggaaatactgaatttattcatgtaatctctctttccccacttatcagctattcacagctaaaaatgagggccgagagggaatcttaagtttttcctggctacttctatacccagaagtacagtaaacctgagcttatgaacacatttccaccccctactcctcccagtgaagtctctgaaagcatgataagaagtgacgtgattatatatgcatgcctcttttttttctcccttcagtaattctttatctctctccatttattttcactgctctgcttcaaagtcattccttctggtcctgtcattttggtcccagagaatatttcctagagaaagcacacatgtgtattcctcctaaaatttgttagagaaatcctgttgtgggaggggtggggaaggagaccaggatccggaaaggatgattgagtgaattttacccctgatttttcaacatagcccccatcttaaatattctcgaatagcctatgggttattgctcccacagatcttctcaatttattagggaaaaagctctctttttttttttcaaaatattaccatacttagaggcatacaaaatcctttattgcccaagtactgatctggctctaagtcttattaactaatgaaagctgcatcttcttttcctaagggttaaggataaaatgagaccatgatagcaccaccttatatacaacccacgtttactttctaacttggtgacttttctgactgtttcagattccacatttgatggggtgactgacaaacccatcttagactgctgtgctgcggaactgccaagtacagactcacattttatgggaattggtccgagaagacacacccaaaggattaccctcgtgagtagagtggctactctgtggtttggggaaaagcacattgtcaaagttctgtctggttatagggcacactagctgcagcatgtcagatctgctccctagtattggctggttcatgaaatgcacaatccaagtatgtatattaatcaagacaggcagacattatatgggtatgctttcagcttctttgcatagcattgtgctattttttttctttttttttttgagatggagtctcgctctgttgccgaggctggagtgcagtggcacaatctcggctcactgcaacctccgcctcccgggttcaagcagttctcctgcctcagcctcctgagtagctgggattacaggtatgggccaccatgcccagctaatttttgtatttttagtagagatggggttttgccatgttgcctgggctggtcttgaacacctgacctcaggtgctccacccaccttggcctcccgaagtgctgggattacaggtgtgagccactgtgcccagccccagcattgtgctttcttatctgtgatttttaaaaatattcccaaagtcatgctgcttatattcaggtgaggcatttggtaacctcaatccccctgcaatgaccctgtccatgaattccatgacagacctgctggaaatagcggcaaaagggacctgctcttgactctataggtcaaggtcaacaaatactctgctatcataggtgttagtaattagtcagcatgccttttttttactgacttcagatgccaccttgaaatcccttcatgaggggccaagcatggtggctcaagcctgtactcccagtgctttgggaggctgatgtgggaggatcctttgaggccaggagttagagacctgcctaggcaacatagcaaaattctaaaattagctgggcatggtggcacatgcctgtagtcctgtagtcttgcctgtagtcctagctactcaagaggctaaggcaggaggatcttaagcccaggagttcaaggctgcagtgagccatgaccacaccactacactccagcctgggcagcagagcaagactctgactcaaaaaaaaaaaaaatcttttcataacattgttatcaagatagccaatacaaagccatgagagttgtcaggagaccccaaacttactattttttaagtagatcctactaattccactttatcatataattgtctcaacaaacgcctaacatgtgccaggcactgtgctcagctctagagttataatactgaacaaaaaaaagatgcatcccatattctcaagccactcagcggctagtggagagacagacactaaccaaatagtcatgcagaaagaggtgaagactataagaaaagtggacttactgtgaaccaagcatttctacatatgttatagtgtttaatcctcaaagtaatgtgtttttgtggataagtttactggggaggagagagatgtcatgatttgcccacattgagatgtaagtaatggatccaagatccaaaggggtttttcagtctcctatgcctgccttttgtttgggttgcgtgttgcccattctctctgtgggtggcaggatgtccatgtgtggcactgagcctgtttttttctgttcattgtctgttttgttcttgtgcattttactttggagttaccgcagttcaggaagaacagtaggaatgggagagagagattaaaaagagggatttggctcaggtcccaaaggaaagggggagaaaagggcacatgattggacttaagaagactcagaccagatcagaacctccatgatccccacgcagcccacccagaggggacttcgacatttgttgacaaatcaagagctctattgtttaatgttacccacatgcaatcaaggcttgggatcttagaagcctctttctagttcattcttctgactctgagattcagcctgatctgcatcagctgtgtgggagacctgtgcgaagaaacttggactctctgcctgggggaaagaaaacatttggaacaagcacgatggaaaaatttcctccagcctctcctatccactaaccagaggaaataaaatgttaggggcccgttactcatcttttgtgatcctaagaagcttcttgacctttcctattctgccactgtcatttcccagaatttagggaggaggtgaaaaaaaaaaattgtttctgggtctttgggccaaatcaagtacaaatctatacagagtttctgtggagttgttgagagtttcttagtaaatatagcagacgtgtgttccagatcttctaggattgttccatttttgacatgatgtcttatagacaattgtcagattgtgtcctaatttttggttggaaaaatttggtcacttgtacagaatagcacttaacatagcatactgtagttatttttttaaaagtctttctttcccactagaccaagaagtcctccaggacaaacgtgatgacgtgcttatctttgattcttagtgcctgttgtcttcccaagcactgtgtactgattgttgaactccgagtcacactcattatgacctgggaggcagatgtctagccttcagctaattatgatgggcagtatggaggagagtgtgagtcaaaccttccatggaggaaaaggagtgaacactcagggagactggagccgtttaaaaggacatggggaggatctaatcgggatcttgaaaatttaatgttctcaaaagttatttctatcagtcttaagtaatagatgaatttctttttgccactgcaaagatgatactgtcttgataaccattctctatcatcatgcccagagaagcttcccacaatagtgcaaactgacaattgccaagcccccctgtcctttattagtcatccaaaacactgctttctctacagtgatcttaggacagtggttcttaagcttttaaatcttaggaccgcttttgtatgcttaaaaaatctttgaggatcccaacataagtggtttatatgggttatagccatcaatcttccatgtatcaaaaactaaaacagagaaattgaaaaatattatttatttttaaaataaacctagtaaattaaaaataataaacttgttccaggttaatataaagaacatattttatgaaaatacctatattcaaaacaaaagaaatgtgaaaagaggatcaatgttttacgtttttgcaactgtcttttctatctggcttaatagaatacacctggattcccatttgcctttgcttttgcattcaacttagattcaaaatagattcaaataggttcaaaaaatctattttttggttgaagtatgcggagaaaattctgtctcatatggctatgtaattggaaaagggaagagtattttaataaccttttctgataattatggataatctttgatcctacaccagaactctgcaaattgtttttttaaaggttaattacaatgtggaatttgaaactatatcaatgaacttgtactcttacattaaaagtcattgctttaccttctactttgaatggatcttttacaaatgcatggttttgtaacatcttacgttgatcatttggaaaatattggtttactgagttatgcagattgtgcaagtgttgacacagttcattaaacaatatgaaaagccatatccattaatatcactaccaatctcatcagaaaagtatttaatattggaaagctatcaagttcataataatgaacacaagttttctaaaattctgggttttgcttgaaagcttgaattttatcattggcaacaaatactgtcagttgttttccttgaagtgacaggatcactttattttttagaaaatgtaggccaaattcccaagtctgaataaccataatttgtctgtcatttgtcctttcaagtgaaaatgatgttttatgaacataaaaagcggctagtccagcttgcacctcaaagagtcgcataagtgcttttattcaagacaatcacagtacttcagtatatagcagaagtgcttctgcgtagttcccaattagtcacacagaaaaaataaaaatatgtttactcaaaggcagagatctaatgaaattaatcatttttattgttttttcaaggacattctttttttttttaactttaagttctgggatatgtgtgcagaatgtgcaggtttgttacgtaggtatacatgtgccatggtggttttgccgcacctatcaacccattatctaggttttacgtcccacatgcattaggttatttgtcctaatgctctccctccccttgccctgcactccccgacaggaccaggtgtgtgatgttcccctccctgtgtccatgtgttctcattgttcaactcccacttacgagtgagaacatgctgtgtttggttttctgttcctgtgttagtttgttgaggatgatggtttccagcttcatccatgtccctgcaaaggacatgaactcattcttttttatggctgcatagtattccatggtgtatatgtgatgcattttctttatccagtctatcactgatgggcatttgggttggttccaagtctttgctgttgtaaacagtgctgcaataagcataaatatgcatgtgtctttatagtagcatgatttataatcctttgggtatatacccagtaataggatcactaggtcgaatggcatttctggttctagatccttgaggaattgccacactgtgttccacaatggttgaactaatttacactcccaccaacagtgtgaaagcattcctatttctccacatcctctccagcacctgttgtttcttgactttttaatgatcactattctaactggcatgagatggtatctcattgtggttttgatttgcatttccctaatgaccagtgatgatgagctttttttcatatgtttgttggccacataaatgtcttcttttgagaaatgtctgttcatatccttcacccactttttgatggggttgtttttttcttgtaaatttgtttgagttctttgtaattctggaaattagccctttgtcagatggatagattgcaaaaattttctcccactctgtaggttgcctgttcgctgtgatgctagtttcttttgctgtgatgaagctctttagtttagtaagatcccatttgtcaattttggcttttgttgcaattgcttttggtgttgtagtcatgaagtctttgcccatgcttatgtcctgaatgatattgcctagattttcttctagggtttttatgcttttaggttttacatttaagtctttaataatccatcttgagttaacttttgtataagatataaggaagggtccagtttctgttttatgcatatggctaggcagttttcccagcaccattgattaaatagagaatcctttccccactgctttttttttgtcagatttgtcaaagattagagggttgtagatgtgtggtgttatttctgaggcctctgttctgttccattgatctatatatctgttttggtaccagtaccatgctgctttggttactgtaggcttgtagtataatttgaagtcaggtagcatgatgcctccagctttgttctttttgcttaggattgtcttggctatacaggctcttttttagttccatacgaaatttaaagtagttttttctagttctgtgaagaaactcaatggtagcttgatgggaataacattgaatctataaattactttgggcagtatggccattttcacaatattaattcttcctatccatgagcatggaatttttttccatttgtttgtgttctctcttatttccttgagcagtggtttgtagttctccttgaagaggtcattcatgtcccttgtaagttgtattcctaggtattttattctctttgtagcaattgtgaacgggagttcactcatgatttggctctctgcttgcctattattggtgtataggaatgtttgtgatttttgcacattgattttgtatcctgagactttgctgaagttgcttatcagcttgagattttaagctgagatgatggggttttctaaatatacaatcatgtcatctgcaaacagagacaatttgacctcctttcttcctatttgagtatgctttatttctttctcttgcctgattgccctggtcagaacttccaatagtatgttaaatgggagtggtgagagggggcatccttgtcttgtgctggttttcaagggaaatgcttccagcttttgcccattcaatatgatattggttatgggtctgtcataaatagctcttattattttgagatatgttctatcaatacataatttactgagagtttttagcatgaagcagtgttgaattttactgaaggctttttctgcatctattgagataatcatgtggtttttgtcattggttctgtttatgggatggattacatttattgatttgcatatgttgaaccagccttgcatcccaggtatgaagccgacttgatcatggtggataagctttttgatgtgctgctggatttggtttgccggtattttattgaggattttcacatcaatgttcatcagggatattgacctaaaattttctttttttgttgtgtctctgtcaggttttggaattgggatgatgctggcctcagaaaatgagttggggaggagttcgtctttttctgttgtttggaatagtttcagaaggaatggtaccaactcctctttgtacctctggcagaattcagctgtgaatccgtctggtcctgggctttttttggttggtaggctattaattaatgcctcaatttcagaacttgttattggtctattcagggattcaacttcttcctgatttagtcttgggagggtgtatgtgtccaggaatttatccatttcttctagattttctagtttatttgtgtagaggtgtttatagtattctctgatgggagtctgtagttttgtgggatcagtagtgatatcctttatcattttttattgtgtctatttgattcttctctcttttcttctttattagtctggctagcagtctatctattttgttaattttttcaaagaaccagctcctggattcactgattttttttaagggtttccatgtctctatctccttcagttctgctctgatgttagttatttcttgtcttctgctagcttttgaatttgtttactcttgcttctctagttcttttaattgtgatgttagggtatcgattttagatctttcctgctttctgatgtgggattttgtgcttataaatttccctcttaacactgctttagctgtgtcccagagattctggtacattgtctctttattcccattggtttcaaagaactcatttatttctgccttaattttgttatttaccccatagtcatccaggagcaggttgttcaatttccatgtagttgtgtggttttgagtgagtttcttaatcctgagttctagtttgattgcactgtggtctgcgagactgtttgttatgatttctgttcttttgcattttctgaggagtgttttacttccaattatgtggtcaattttagaataagtgctaagtggtgcagagaaggatgtatattctgttgatttggggtagatagttctgtagttctattaggtccacttggtccagagctgaattaaagtcccgaatatccttgttaattttctgtcccattgatctaaaattgacagtggggtgttaaaatttcccactattattctgtaggagtctaagtctctttgtaggtctctaagaactttctttataaatctgggtgctcctgtattgggggcacatatatttaggatagttagctcttcttgttgcattgatccctttaccattctgtagtgcccttctttgtcttttttgatctttgttggtttaaagtctgttttatcagagactaggactgctttttttggctttccatttgcttggtaaatattcctccatcccttttttttgagcctatgtgtgcctttgcatgtgagatgggtctcctgaatacagcacactgatgagtcttgactctttacccaattttccagtgtatgtcttttaattggagcatttagcccatttacatttaaggttaatattgttatgtgtgagtttgatcctgtcattatgatgctagctggttattttgcacatttgttgatgcagtttcttcatagtgtcattgatctttatattttgtgtgtttttgtggtggctggtgccagtttttcctttccatgtttagtgcttccttcaggagctcttgtaaggcatgcctgttggtgacaaaatccctcagcatttgcttgtctataaaggattttatttctccttcacttatgaagcttaatttggctagatatgaaattctgggttgaaaattcgtttctttaagaatgttgaatattggccccccactctcttctggcttgtagggtttctgcagagagatctgctgttagtcttatgggcttccctttgtgggtaacctgacctttctctctggctgcccttaacattttttccttcatttcaaccttggtgaatctgacaattatgtgttttggggttgttcttctcggggagtatcattgtggtgttctctgtatttcctgaatttgaatgttggcctgtcttgctagattggggaagttctcttggataatatcctgaagtgtgttttctaacttggttccattcttgtcctcactttcaggtaccccaatcaattgtaggtttggtcttttcatatactcccatatttcttagaggctgtgttcgttccttttcattcttttttctctaatctagtcctcgtgccttattttggtaagttgatcttcaatatctgatatcccttcttctgcttggtttagctattgatacttgtgaatgcctcaggaagttctcatgctgtgtttttcagctccatcaggtcatttatgttcttctctaaactggttattctagttagcagttcctgtcaccttttatcaaggttctgatcttccttgcactgggttagaacacgttcctttacctcagaggagtttgttattactcaccttctgaagcctacttctgtcaatttgtcaaactcattctccatccagttttgtgcacttgctggagaggagttgtgatcctttgtaggagaagaggcattctggtttttggaattttcagcatttttgcattggatttatcctcatcttcatggatttatctacctttgatcttgaggctgatgacctttggatggggttttttgtgtgggggtcctttttgttgatgttgatgttattgcttcctgtttgttagttttccttctaacagtcaggctcctcttctgcaggtatgctgcagtttgctggaggtctactccagaccctgttctcgtgggtatcaccagcagaggctccagaatcgcaaaaattgctgtttgctccttcttctggaagcttcatcccagaggggcaccagccttatgccagctggagctctcctgtatgaggtgtctgtcaacccctgctgggaggtctctccccgtcaggaagcacggaggtcagggactcacttgaggaggcagcctgtcccttagcagagctcgagctctgtgctggtagaatcctccttgtcaggatctgctgcactcttcagagctggcaggcaggaatgtttaaatccgctgaagctgggcccacagccaccccttccctgaggtgatctgtctcagggagaggggagttttatctctaagcccctgactgggcctgccgcctttctttcagagacgccctgccctgtgaggaggaatctagaaaggcagtctggccacagctgttttgccacgctgtgttgagttccgcccagtctgaacttcccagcctccttagcactgtcggggaaaactgcttactcaagcctcagaaatggtggatgccccttcccacaccaagctcgatcatcccaggtcaacttcagactgctgtgctggcagtaagaatttcaagccagtggttcttagactgctgggctccacgggaatgggaccggctgagcaagaccacttggttccctggtttcagccccctttccaggggagtgaatgaacagttctgtcttgctggagttccaggcaccactagggtatgaaaaaaaaaaaaaaaaaaaaaactgcagccagcttggcgtctgcccaaacagccgcccagttttgtgattgaaagccagggccctggacgtgtaggcacacaagggaatctcttggtctgcggattgcaaaaactatgggaaaagcgtagtatctgggctggatagcacagtcctgtgtctggaattggtgggttcttggtctcactgacttcaagaatgaagccgcggaccctcgtagtgagtgttacagctcttaaggtggtgtgtctggagtctgtctcttctgatgttcagatgtgtttggagtttcttccttctggtgggttcgtggtctcattggctcaggagtgaagctgcagacctttgtggtgagtgttacagctcttaaggcggcgggtctggagttgttcgttcctcctggtgggctcgtggtctggctgggctcaggagtgaagctgcagatcttcacggtgagtgttacagctcataaaagcagcgtggacccaaagagtgagcagcagcaagatttattgcaaagagcaaaagaacaaagcttccacagtgtggaaggggacccggttgccactgctggctcccgcagcctgcttttattctcttatctggccccccccccccccccccccgcccacatcctgctgattggtagagcccagtagcctgttttgtcagggcgctgattggtgcatttacaacccctgagctagatacaaaggttctccacgtccccatcagattagttagatacagagttttgacacacaggttctccaaggccccaccagagcagctagacacagcgtgtcgattggtgcactcacaaaccttgagctaaacacagggtgctgattggtgtatttacaatccctgagctagacataaaggttctccaaagccccaccagagcagctagatacagagtgtcgattggtgcactcacaaaccttgagcgagacacagggtgctgattggtgtgtttacaatccctgagttagatataaagactctccacgtccccaccagactcaggagcccagctgacttcacctagtggatcccgcaccggggctgcaggtggagctgcctgccagtcccgtgccgagcgctggcattcctcagcccttgggtggtcgatgggactgggcgccgtggagcagggggtggtgctcgttggggaggctcgggccgcacaggagcccatggagtgggtgggaggctcaggcatggcgggctgcaggtcccgagccctgccccgcgggaaggcagctcaggctcggtgagaaattgagcgcagcaccggtgggccggcactgctgggggacccagtacaccctccgcagccactggcccgggtgctaagtccctcattgcccggggccagcagggctggccgcctgctccgagtgcggagcccgccaagcccacgcccacccagaactccagctggctcgcaagtgccgcccgcagccccggttctcgctcgcacctttccctccacacctccctgcaagctgagggagtgggctctagccttggccagcccagaaaggggctcccacagtgcagtggggggctgaagggctcctcaaatgccgccaaagtaggagcccaggcaggggaggtgccgagagcaagcgagggctctgaggactgccagcacgctgtcacctctcaatccctcacggcttccttttgctgggggtggcggggcgggggaggcccccagctgcttgcacttcctgggcaaggcgacaccccaccttgtttctgctcatcctctgtgggctgtacccactgcctaaccagtcccagtgagatgaacagggttcctcagttggaaatgcagaaatcacccgccttctgcattggtcttgctgtgagctgcagaccagagctgttcctattcggccatcttgccaataccctccaaggacattcttaagtgaaacggaccccttttgctttttactgttggtatgtggcagtgaaaaatatatcagcgactaacatggtttggggtcattaacttgatccatgctcagtgccagagttaatgtcaatacattacaaagggaagtaatgtcttagcattattataaaaatagttttcaccttctagaccccctgaaagggtcttggggttccaaggggtctgtggtccagactttgagaacctctgcaataggtaagatagcaacctaaggtgtctgactttcagtactctttgactaacttgcccttgggaatttacgttggacactataggaaggatggggcaatacccagtctctgcaggtgggccacatctgccgaggctcttctcaaccattttacaaaatggtttgttccaagtgctgtttctggggttccttccattggagcacagtgttctctctaggaggggctagatgtggttagataagaagggaggcaggggaatcgcctaaatgacctctggcattccctatctattgtaatgctatagatctctgcttgtcatctggaaatagtgaaatccttttaaaacacttctaatctagtagttctagaaacgcattttaacttatcatgtaagttttacttcctaattttacaagtgaaaaactgaagcacaaagaagttacagactcagatgacatagccacagagtgtccgaaacaaaatcaaagcttaggtctcctgactcctttttgccttcctctgtaggctattaggaggccatcaatcttctgtccttctgcagaaaaattagtatcttatacacaaagcatcttttaataaggccctgctgtactaacatgaactcaactggtaccaaatttggtgccatactgaacagctttgccccactctacaaaaacctgcattgcagagatcctaacttagaagtcagaaagagaaggtctggattcactggtcctgagtggagttcatggaccttaaagtgtcagaagaactgccagctcctgcaatgtctgttcgaggcactgtgagtctgtagcttccagctatggctcagaagcagttgcttcacagaaacaaggtgactaggcagtgtaaccacatgagggtgtcctggaggctggagacatgcccattctttgccaaggaattgggagttacctaaaagatgctgagtctctttattctctagctctgaatacagctcttgggtttttgacaaatgctcctatcccatagagaccctttaatcacctttgacaatgtaagctgcatagcttcccccatttttgatatgacatcggttttaatgctgtttaacagatatgcattgatgaaaagaacatttttttccaggagccaatcacgttttccgtttgacaatacattgcctaaaatataaatacagcaattgggaaatatactctatataatcaaagttcattttacaatgaaattcagccatcttttctattggatcaccagatttaggaaattattattaagtccaatcacatgaaaaaccaccgctctaacacttaacaactacttttgtttcttcatatattcatctatgtacagagtatgtatatcacatttgaacatactgttctactttttgcatttgattttgtcttcatactcatatcagcttattctaagcaacttatctattgttttattgatcatttaagtaatgtcaggtcttttgctaacatagaaagcactgcaataaaatactttgtacttaggccaggcatggtggtcacgcctatgatcccagcactttgggaggccaaggcagatggatcacttgaggtcaggagtttgagaccagcctagccaacatggtgaaaccctgtctctactaaaaatacaaaaactcaccaggcatgctggtgtgtgcctgtaattccaactactcaggaggctgaggcacgagaatcgcttgaacctgggaggcagaggttgcagtgagccgagattgtaccactgcactccagcctgagtgacagagtgagactctgtctcaaaaaaaaaaaaaaagccacacaacgcttggtacttaaagtcttcctcaacccgtctcctttctttggaattatttccttgaaataatttcccaagatgaaaactgctggatcaaaggatatggatttttcttttggcccttgatacatcttgccagattcttctccaacacatttgtatcaattcagtttattaccaataatgaataaatgtgtctgtttctcccagccttctcagcattcaattaaaattttaattaaaattttatttagtaataatttattaaaattaatcttattttaaattggcattggtttaattaccaacacacttgaatcttttttcatgtttattgtcctttgcctttaaaaccactagggtgttggcatgaatcaagtctgattttgctccttgtctccccagggcatcagtcattgtctggcacactgaaagttctgaataaatagtgtggaatgaatggatgaatgaatgagaagcagttacaaaatgaggaaggaagagagtggagggagatgagcaatgaaaagctgctgatgaagaggttagggcaggagagagataaggccatatgtggctgctgagtggacagcagcttggatggggccagtggtgtgtgggaggatgcgcaaggaggacattgcagtcagttagtgggcaatggtgtggcttggactgcagcggtgaaagtggtaatggagaaaattggtatatttcacatctcttttaacagtagattctgtcatgaactggatgcggaggagtaagagagagaaacatcatagctgacaagctaggtttctggcttggaaatggaggtgctctttcttttgaaaatattcctcaatattattatctctctctttttacaaatgactttgaaatcatttcatcaggctctgaaaaggatcctgtcagaattttaagtgggattgcactaagtctcaaaattaccttgagaggaattgttagctttataatgtttagcttgtctagttttttcccatttatgaataaaaccaagcatttctgggtttccttagcaccatgcctagaagagtgataccatatggaccatagcccttctttctcaatctaactgcagaaacaaaattaaacattatattacagttctccagagaaacagaccaacaggagatagataaatgagagactagatagatagatagatagatagatagatagatagatagatagataatacatttttttttgaggaattggctcacatgattatggaggctgagaagttccacaatctgccatctgcaaaccggagacccaggagacccagtggtgtagttctagttgaattccaaaagcctgagaacaaagggagccaatggtgtaaatcccagccccagggcaggagaaggccaatgtccctggtcaagcaggcaggcagggtgtaaagaaatggatttcttcttcctctgcatattgttctattcggccctcaattgattggatgaggcccacccacacgggggatggaagtctcctttgttaagttacctgattcaaatgtgtatcacatctggaaatcctcacagatgcacccagaaataatttgggcacccaatggcgcagctgacacataaaatgaaccatcacaaacatacaatgaacaataatcccactgcttccttcttccatcactgtggaatccctcccaatcctgagaagtctgcccatcagagcatctcagctgtgccactgccagtgctatgatgggacaggagacattgctgctgccaccaggctgagtcacaaatataggatttcaccaggaaatggaatttggcacccaacacttgtgtcgtcatacacagtttcagtgaaagaaagggcaaaagagaaaggattaaatatcttctttaccctttttctcttgccttccttctgcctctctggaaaggaagtcctatgacaaccagtcactcatgtatgggttgggagtggagaaggaaagtccatgatcacattttccagttaaacagggaaggctgaacacataaatctctgttgtttccccaaatcccacaaagataacactagatgaataaagcagactcagtcccagaggatttctctcacttttttccagcacttttaggtactttgcacaggtgtgttttttagggatttcattctcacccccagatccactcttctctccatcctgctttgggagggtgacgtcgagggatctcatcaagtggctctctcgccctctgcattccagctggatttggtcagtgggaagccaaggacagaggaaagtgaggtcagggtctctacctacccacccactgctccctgccagtggaggctgcaggtgggtggtcctcttccagcagccacagcttctgcccagccaccctgtcttccagcttcaactctccctcctggttcctgaaactgctcctcctcaggtttaggggtagtcacaactccctgggagcttcacctttccttattgcactcctttgactctgccaggcccttataaaatgtcccttcatcaaactcacttctcttgccccacttgagtatgccatctgtttcctgtgggactgagactggtattgccactttttcagaaattgattcttagactctgtacatgtattattttgataaaataagaagcaaagctaacaaaacagtaaagtcagttattactatagaattttatgttgctataggattttataaaagattatacatccccactgtactgaggctgccctttctgaattgccttcctctcccccatcccactcaaatgctgcttccttccattgctcacctaggacctaaaaacacccaaatgagaatgtcttttctctgggtctgtggctaaactcagacgccaatccagttcccattcccaaatcttctctctttgccaacactaggctgtcatctaacccaaaacatactcaaaggaacaacgttataaagtagattattagataggggtttctggaattttagctaagaggacaccctttaataatagggagtgcattttcacagatcatgtttcctggtttaaaaatatatgcaatttccgtaaaaactgagacttgaagagattttaattttttctaaatgatttttgttttctcaagaaggctttgctgtttcattcttatatatgcttcatcaagttaattcctagaattattttatgttttggttattatgaatgagatttccagttttcattacgttttctatcaggttataattagtgtacaaaaatgctctcgttattcccatttattgtacctctatgttttttcctaatagttttacctaatattccttgggttacataagtaatcaatagctatttgcctagctgggcatggtggtgcgtgcctgtagtcccagctacttgggaggctgaggcaggaggatgacttgaacccatccttgaacccatggttaaggccattgagccatgattgtaccactgccactgcactccagcccaggcaacagagtgagacctcatttctaaaaagataaataaacaaaataaaaaattaataatttgcctgtaaaacacaacatgtttttgtcttttttttttctgattactcttccatgatttctgtggtctcccacttgttcactgacaaggtatgatgttgactcttggcttccaggatgttaaaggatgtttaaggatgttaaatatagatgtacacttctaatttttttaatgggtgttgcatttttctttctttttgagacggagtctcgctctgtcgcccaggctggagtgcagtggcacgatctcagctcactgcaagctccgcctcccgggttcacaccattctcctgcctcagcctccccactagctgggactacaggcgcctgccaccacgcccagctaattttttgtattttttagtagagacggggtttcaccgtgttagccaggatggtctcgatctcctaaccttgtgatccgcctgcctcggcctcccaaagtgctgggattacaggcgtgagccggatgttggattttctaatgccatttcagcgcttattgatatgaacaaataattgttactattcaatctcttttgtggagtattataattactagttttcaatttgctagactattcatccattctgtgatgagcctaatttaattgtggtttgttttttccttcctttagtacacatgtgtaattataaactattcacaaagcattatatttttggtatacattttctcaataattcttgccttagcctcataggatgaatattatgctcctgatttatggaagagaaaattgagtctcagagaggctagagagtaggcccagttcatagagcaaatctgtggtcgagctggtgcgtgatatgaaaggcagagagagagagaggggtgggaagagagagagagagagaataggaggggaagagagacagagggagaagaggagagagagggaaagagaggcagccagagaatgatgcactggctgtgccacaggtttgcactatgaaatgcatctggctttgaatctgggtccatctgaccctagagtcctttctaccatgcctctcctttaaagtggtaatccattagtattgtcattaaattcttcagatctacatgcaagagtgaaagtggtacacaattcctgatttttaaatcaactctttatctgactgtagtctcaaggccatactagctttgaggagtaaattggttagttcctacctacctgtttttattcataattgagactttaaaagaattatccacacacattgaatactttcccttatcctcacccccaagttatccaatttcttcatcagttattggtgtattcaagctctttcttttatgtcagttttagaattttactttttcctttaaaaattatccattttatttagattttcatagttcctagcatacaactatagagtgcagtaagatcattcactatttcctggctaaatttacccgtgttagctttatctaataagctgtgtagcttattaaataatgctactgttatgctgttggtaatttacacacatccacttttatatatactgttcccttctatttcttttgggttgtccttttgttcctttggtgaatttttatattgttgacttagtatgctgattttcccattttgttttttgtttttattaataataaatgcacttaaggctgtgaattttcttagtgtagctctgagcccttcccagggaatttaatatgtagttctcattttcattgttttcttaatagagtgcttttgtgcactttatcttcttgacatatttgttaattagcagattatttcaaaatttctaagtagtcagagagttttgatttacatctttgttcctaattttgttttattttgttttggtaagtgtgttagtccatttttgcatcactataaagaaatacctgagactgggataatttataaagaaaagaggtttaattggctgcaggctgtacaagcacaactccagcatctgtttctggtgagggcctcaggaggctacaatcagggctgaaggccaagcggaagcaactgatgtcatacggtgagagaaggagtgagggacagagggaagaggtgccacactcttccaaacaaccagatctcctgtgaactaccagagcgagaactcactcatcaccaagcggagggagctaagccactcatgagggatctccccacctgatccgatcacctcccaccaggccccatctccaatactgggggttacatttcaatatgagatttggaggggacaaacatccaaaccatatcagtaaaagagtgtgttatatataatttctgcttttttgtacttactgagtttttttttttttttaataacctagcttatgttgactttcaaaagcctgttttcttattctgcctcaggtgccaagctatgtgttacctagtgacacacaagtataattagtccatgaaaggcccctctgggccttgttgtttgttcgtttgattccatctaccccatatttattgtgattactgtcctactataatttttctgccatgttattatacatttctgattgtactttctcatttctttttttttagacaccttcttttctttccattgcctaaattattttcttctgctggattaaaagtgatttgatccatttttttgttgttgttcttatggtggttgcctttaatgtaagacacgtacttatgtttatctctgttgaattcataaacaaaacaagtactttagcatactttataattcctttggtctctactatccctgtacccaaatacacactttatgttggttattttctagaattttatttctggattgtatggataatttcttttttgtttttctctagtctttgcttttttacacaaccataaacattactaaagtgttgttcacccatagctctttagcatttttcttatttcactattttctacaagagtatttttataatacatttttgcaaggcaaaccccctaaggccttatatgcctgagaattttttattatgctctcacatttaaatgactgatggctgacataagacctgcattcagaaacactttgttttccattgtccagtgtgtccttctatccagctgcttagaagcctaatctcagtctgaatttggttgcttcctaggtgatcaaatctctctctctgttttgcttttccatttttttgttgttgttttgtttggtttgttttttgctgtctctttgatgttctttattttcacagttaatgtgacttgatgtcgtttttttctttttaaaacctggttttcggctgggcgcagtggctaatgcctgtaatcccagtgctttgggaggctgaggtgggcggatcacccaaggtcaggagtttgagaccagccagaccaacatggtgaaaccccatctctactaaaaatacaaaacttagccgggagtggtggtgcatgcctgtaatcccagctactcaggaggctgaggcaggagaattgcttgaacccacgaggcagaggttgcagtgagcagagatcatgccattgcactccagcctgggtgacagagtaagactccatctcaaaaaataataataatttaaaaataataataaaataataaaacctagttttctattctatgggtcctttaaatatgagggctttcctcctttaattctggagatttattttttgtcaaatatttcccctcctccttttttctctttctgagcctctggtgactcagatattgtcacttctactcatttccttcatatcatctgggttttattttatgtgttttttcccttcctacctcactgctgcctttaaaaaggcttagatcatctaaaaatactaaaaaacaaactcaaaaacactaaaaaggtctattaattaaagagaagaaaaagcaagtgagaagttcctcagttttatccctaggccactcattctttagtgccaaccatcctgcttttaccccaactactatgttgcttatttcaactgttgtgggggttttattataaacctttatgttgaaatagcttcaaatttatataaaagttgcaagaatagcacacagaacttctgatcacctgtcaccagattccacagttgttaacattttaccacatttcctttatcattctctcaccatatagatacatattattttttgtgaacttctgagaagtagcagacatcatgcctgtccttttacctctaaatacttcagtgtgtatttcctgaatgtttttgtaatattttgtaagagaacaaggatgctcttacaaaattacaatacacttatcattaacattgataaaatactataatctaatctatatgtcttgttcaaattatactcattatacctctcatgttctccaaagcaatactgtatcatatcactataatgtaaaccacaaatatgagccacgtatgtaatttcaagtgttctaatagccatattaaaaaaattaaacagaagcaagtgcaattaattttaatgttctattctattttatttaagccagtatatccaaagtagtagcattttaacatgcaattcatataaaaatttattattgagacattttgcattctctttttcataatatgatccattgtatttttttacacttaacagcacgtctcaattcagactagccacatttcaatcacacagtagctacatgtagctggtggcaaccatatcacacagcacagttttgtagcaaatcaaaaataaaaattctggttcaagatccagtctaagattatatactgcatttacttgtcaggtctctttagtcttgttcaatctggaatggttcttagtccttcttgactttcatgacactgatgcctttgaagagtacaaggcagttactatgtagactctccttctgtctggggctgtctgatgctttctcataattagattcaggttgtgcatctttggcagggataccacagccattatggatatttgtttaacacctaatttacattttgttctttttctctatttcttgttcttgcttcatattgctaacatgctcccgatctttgagaatatgtattgtgcttctgttaaatttttggtccatctgttgcaataagctgcttcatgttcagcttgcattctctttcgctagttgtactgcttgggatttagttactgtggcaggtggtcttctgtttctgtggtgatataaatgttctgcctggtagtgtatgatggggaaaggccaaatcctaggtggtgccccttctggtgtgtataaggaaaaggaaggagacgaggcccaggcatcatgtcgctgctatcaactcttctgtttgctttcttctactgggtaacttattcagttaaggattcatcctgacactcttagaacaaagcaggaataggaggaagtgatctcctcaggttctaatccccagccctgcaagtctggaaacagaagggatgaagaagtgtatacccagtgaaggctgggattcgtttatccctgtctctcctgagagggctttatgctgctgccctgagattattctggctgggaataggaatagagctggcctagtcctgcagacatctgggttgcaggacaggcaaggacccagaccctcccttggtgatgtcaaggaggggaaatgagagaactgcaatagtcctcacaaatccatcctcccaccactgggccagaggaaagaggaggattcatcactccatctatcctctttttcctgggtcaggatagcctttgatctcctctttatttcagtgtctctgttagttccttggatctgtgcttccctctgcttctgaagtttccctgggttgaatttagaggatgaggagcacatgctaattcaccgtcttatcaggaaacagcaataacatttcagggttttttatttgtttgcttgtttgttgttcaatctattaaattgttggcaatacctaccctttctgctgtatgtttaattatgcttttcagtctattaatttatcattttcttattaatttatcatattctgataatggggtattaataccttgttctaaaattgtatacttattaatttccctttgatttttataagggatttgttgctatgttctttgaaccttatagacataatatcattatgctctcattattaaggcttttatcacataattaacagttagcttgctttaataacttttaccataattctaccttgtctgaaatctcacttgctttttttccctttaattagtagacctttttagtgatttttaaatttactttttagtgtttttatcctttttctaagcctttttaaagatttcccagtaaattattgcattattccagttggaagcatttttttcgtttttgtgttttattttttcttcctcaaaattgtttgagcttatacttattttaaccctagtccgcttaggtttatgttcttccattttactttttatctctcaatttttatagttaatttgtttttttttcccctagatgttctttggtattatatacacaattaatttgtttggtttgggttttgcttattttaatttcctttagcaactgtcttctttttaatttgattagctgtcaatttaagataaaccacaaagatttcattatcaaaatggtatctttgattctcttttatgggaaacttttgttctttttttgttcttccctactctgttactgcttccatttttcattgaattaacttgttgctcagtttatttattttaatctgcttttattctaacaattttcctaatgcccaactcctatcacaaacaattctttctattgtttttgtttacttatctcttcaataggtacatactaattcaagatttcatactatttttaatagcatcatcttttttcaggtctatcttttaagatcagatttctttttgtagtaacttttgaagtcagtgctggtccattagtgggtgaccaaatttcttaagactgaaaattcatgaacatctttacatttggataaaaacttgactgtataaagacagaaattatacagcttctttactctatggtatgtacatggttttttcattacaatgaagtccttgtctacttatgactatatcttttacatgaaatatgtaacctagctccttgcagaatgttttcttttccttttgtaattaaaataaaatatttgatgatacatgttgatttcagttatttttagtggatcttaaatagggctctgtttgtactttaacctttaactattttattaatggttacatttttcttctagtggatcttttctttttctaatcttcaatgttttattctttgtttgctcattcattccataaatctattcaaagcatctatttcatgcaagcaatgtgttcagttcattccttctctttctttaggaactcctatctcttccagagcactccattctccagatcttcttttgcatatttttatatctcttttcatgctctgcagattttttcctagttcattttctctttctctgttagttacctgtagcatccaattctacattttacctatactaccattgtttactccttcctgccccttcctgctgtaatgagctcttctgaaatagatataatgtctttcttccacatttaagaaatagtttataagtattttctaaatcctgttttgattcttgtttcatttcatggtttattgattcatacttcccatccccaccccaccctgcacccaggttcttaattcatctttcttctctcgtgcctgacaaacattttcaatggttccagtcatttattcccctttactcattcttccttgagtttctcatgatgatatggctgctatttctgaaacctttgcttcagactgttttattcacatttaaataggccttgaaattggaaggttcacaggctctcactcagacttcctcctggaggtccaaaaactttatttcttgagcacatcatgtcctaaataacacacacctgtattggattggccattcagaattagatattacattaaatattactttccttatatctatcaaggtaaagtcccattaccactgagaggggtaagttaatttattgataacttgcttgccatttactcctgctggttggcagtttaaagagcacatgcttcctgcatctcatttatgtagcttaagtagtcacctgttttgaactgatttgagagggaagactggattcattggcaagtcatggatcaattattatgtaagctctaatgctagcagtctcctagcaaaatggatgtgattaacatttaagcacgatgacaacccatgcatttttcatttactatttccttcaaacctatttgccagttcctctgctgtgattccaagaaatgcatactttaataataaagacttaacttttcctttgtatgaaaatattataaacaccaaaaagccttatgaaattataggagggggaatatcaaagaccattaacaacattatgtatggtcacccaggaatttgcacacaaaattctgccaaagctagtgtcatttatgtacttaagttttccaaacaacgagttgaaaaatataccctcaagaattgtttatgccaagaagggccaactatttataatcacaagtggagtttctgcaaaggtctctgccagccactacagtcctggcatacatccctcccaatctgcaaaaactctactgtttggggttgaaagtgaagcatgagtccaaagaaatacttgcagctttttcctagactcagttgaattcagagtgaaagaacatagaagacgacaaagggtataggaaatcgcagcataggcagccctgccttatttttagtgaaaaggattagtactggtagccctgcagtaaagctgatcgcctgtgatcagggagtaggatagttgtaatccctttactataccactgagttgattgattaaattgaaagttatgagtcaaatgcccccagagcatcttggaaccttcctgagtctgtgcatattcatatggtcctaatgaccttccactggaaggaaaaagtgtgtgctgcctgcagggaacacatgaagaaaggcttaggacgaagcaaaactttttcacaaccaccagcaagagtttaattaaactctgtctaacattataagcttgcctcaatttaagagcaaaatgtaccaggtttttcctgcacatggagcctcccagggtcttgcagctcaagtggaaagaacaatgaaaagcagaaggctttcattttacatctggctccttgaaatggggctaagaggctttctggagggttttgctggctgggacagttagtgtttacagatgtgagtggctttcagtcattgaatgtaaattgcatttgctttgttgcacacaccctgggaaaaccaagaggaagaagagaaataatgttcctttatccgcccacacacattgatattcaaggcacagtcttttcaggtttattgggtccctaagcaacctttgaagagatctgtacatctgtccggctgtccgtactccagcggacatggattcctttgctttgcttttcaagtctctggttccatctttggtccgttgactgaattttttggtaaacatttcttgcattcagacctgagtggccacccagctcctgggctaattctgcttctctcttaaaatttgatctgtattctgaaggcaagatcctcaggaaaaaaaaaaaaaaaaaaaaatgaaagagggctagcttttaatgtggaagctaaaagcctaagaagtaaactaaaataggaaggtgggagagagagcaagttcttgctgaaataccaaatccccaaaccagatcagagtaatgcgagagtggaaaggaagcctttctaaagtgagagaaactgtaatctaggtttcttttgcaccttgcagctccccagaaaagagtagccaatggtcagcactccgctgagaggcaatacatattgtatatagtttgaacaataatggactattgtgagtcagatccatctaggagtgttgaatctgagacttactagaggggcttatggaagctacttaacgtgtctgtgcctcagttttctcatctgtaaagcagggataatcaaatcacctatctcatgaagcagttttaaagacgacctaggttcaaagctaatctccaccatttactagctgtagcaccttgcagaagacactgacttacactgacctccagtctcctcagtaaaatcacagtctacatcactgtattgttgtagagttggatgagttaatattcttagaataggcttggaatatgatgaaagctcacaaagtgttcgtcattattattttaaaatgagacgatgtataaatggttcttagctcagaacaagaccaacagcaaggactgtgttagctatggctataatgtgcttatttctagccttgtcctgctacccacccaaattctcaacctctaaataaggatttagctctgatctcatgctgatatcttggataagtcttctcatctgattggcttccatcacctgatgagagtttgctgagattccaacctgactcctgaatttcttccatgtaccaagtggagagagggccaagttccaggtatattttgtcatccctaacttcacaaatatcactggaagtaaagggccccaagtttacacttgacagaccatttataaaagattttatactacaaggcctaaccagcaatgaggaaatagagttttcatttgtgactttttcccctatcagaaaggaatttaataacaaataaaatatatccatttcagcagccaaccagacaaacacatggaactaatcagctaattttaagttagtatttgatgaccttttttttttttgtaaataagaaaagagaagtcagtggagtttggaatttatgtgttctgtgatttctgttggccaaggtcagttttacttgatttctcttcccctctttgcctaccacccaacccccaggagcacataagcaattattaggtgggatctctctctatgtatcctaggggctgagcaacaagcagttagagaggaatcaaagctgggagaaggtaaggaaaccatttaattgttgagctgagtcctgggcagctccttctctttctgcctagtccagtcttacatggtcttcgtatttcagcctaaaccatcacttctttaaggaagctctccctgattccccacactggactggttctagttcttaaacactctttacaactctttgtgcccttccagctatctattgttctgtttatcattctgcacttgaactcctggtctcagtcaatcctcccacctcagtctcctaagaagccgggactacaggttcataccacgataaatagagcaacaagctctatttattgtttagtacagctgcttcaggtttccctagggttatgttcttcaggatattccatataatttaaagcttacagaaataagattaatactgaaaaaggattaagactaaatttttaaaccagctgtaaagtggtacagctgtgcaccaataacataaacacagcttaaaattcattcagtcaccagctttgaaactacggttcttgcaattttttaatttggggaaagagaatttgcattgttttgcacattttgtgcacagagtggctttactaatatttttaaatatttttatatgtctttattaatatttttatgtttctatgccttatgacatgtccatataggtccaaatcagactgctctgtaattatttgtttaattaaattaactggctcccccaataaaggataagttccaggaactgtaactaccctttgttcatttcattccacccagtgcctagcaaaatggtatgtggtagacactcaagaaacctggaagggatttagaagggtagaaactgacaccttctgagaataaaggaggaaaacttttttcttctctgtgggcaggaaggacagcatgttttccatctcaaagacaggaaagagttatctcttcctctgggatccatcagcatcctgcctactcctgcgtcacagcacagatcctaactggcaaaattattaatctctcttccactgaaatagatacatcagacagattcctttctgactgaaactgttctgctgtgaaagactaacaacaaagcagatgctccttcatgcctggccagttctatcagttatcctactggccatccagggtaggaagaagactaaagccttctaacacctgacatctcccaatccaggagagaataagaggaaattcccagttactgagaagtgaattgcagctcccctttttgaggatctaataccatcagccaccccatctccttatgggcccagaaacccatgatctcttattttatctcttcctttataagaattattgagtaattgctatgctgcctatactgtgtcagttgcacatcaattaaacaattgcctaattggactatacattctctaccctactcctggtaccaaaatctgtgttagagttctccagtgggacaaaaccaataagatatatgtatataaaagggagtttattggggagaattagctcacacaattacaagatgaagtcctatgataagctagctgcctgcaagctgggaaaagagagaagctggtagcctggcccagttcaagtctaaaagcctcaaaaccaggaaatctgatagtgcagccctcattctgaggtcaaaggcccaagggctcctggaaggccactggtgcaagttgcagagcccaaaggctgaagaacctgaggtctaatgtccaaaggcaggaggagaggacgagtcttcctctcccagtccactggctcaaatccagtccactggctcaaatgtcagtttcctctggcaacaccctcacagacacatccagaaacaatattttatcagccatctaggcattcttcaatccagtcaagttgacgtctaatattcactgtcacacctgccctaggctattgtttccctgagggcagagactatgttttgttcatgactgcatcactatctcccagcctatgcaaaacaaaatagacaactagaagtatcaaatgaatgacagataacagaatggatagatgaactgggattctggggttcactccatctcttgtagtaatatcaaggaaatgtcataaaagacagaatctaaaccttctttaaaatctatattagttaaatgcattatgcttcctttaatctataagggctgcaaaaatctctcatattaccctcaacccttgggcagcaatcattagtatcttcaagataccacatatattagaaataacacgggacaaactctctatatgatgaacacatccttttccttacctttcattttctgtgtcatctttgctttttccctgcattctatgattttatggcagactctcaagaaaggcattagagttggttgggactgttactatatccccagctccagcaccatatctgatatagagttagtgctgaatacatgttactcaacgaacttgctgcaagaagtcttcacttttaagagaatatttcaattacttaaaacgatcatagaagggaggaatatgtacgtactaacaatctaataaggttactcagaattgtatacacaaaactgctgaagctaacagcatttatatgcttaagttttccaaacaatgagttgaaaatataccctgaagaattgtttatgccaaataaggctgactattcatgatcatgactggaattgctgcatgttttgtgccagccacttcattcctgccaaacatcctcccaatttgcaaggattcttgggtttcgttttgaaaataaagcagtaaaatgcttcttaagctcaacttatgtggggtcttattcttcattagtacttacttaagctatactgattagagtaacatcttaactcttttgaaatgcttattttgattgacaaagtgacatggaatttctaaagtgacaaattgaccaaggagcacagaaacaagtcaatagaattgtgatgttagcttgagttctgaacactcaacacttggaaagaacctcataccaccttttgtgccagagacaccgagaacctgaaaggctgtcagtcagatatttctattagctgaagcaagaaaacttcctcatcctggtggctcctaggccaaaatttgcaggggaaaaaaaaaaaaaggaaaaagaaaaaagctggcagaccaaagccttacattgaccaaggtcttaaacacagcaactagagattatatgcttggaaaataatttataacaaacagcgcaaaagcactcctgataagtgagcctgctgaagacccttcagactcagtccagacctaggttctaaaccagtgagtctccttatttggaagaactgcacaagagtttagcaacccagcattgtaccaattctaacaagaccattacatctaaagctttattaagcatgtagactctgcagtcagaataaatcctgcctccaccacttattacctgcaagaggctaggcaagacatttaactcctctgtgccttggttttctcatatattaaatggggataataataatactaacttcataggactaatgtgaggatgaagttaattaatttatgtaaagcgctcagaagagcgcctagcatatattcagtgttatatacttggcagctattattatgaccctttttcatgatctatttcttgccttggaccccagttctcataactgggtcttaattttcatgcatgtgtcaattccatagatagttaaggactgcctgctatccagctgactctgtcctttataaaatggcctttttccccagcaagacccatataggagccctggctttgcccttccagggatgaagtcccttccttgctccttctaattcttccaagcactagaattctgccttttattgctgccagacctgcctgatgcccagtgtctctatcaccatctgctcctaatccctgatctcgcctaacaccaggggatttctggcctgcctgctcatcccaataccgatctttctgtctagtctttaacctcagctgcctggtctggtcttgattctgacagcacccttgaaatttgttcaagcaatgaataagttattcaaatcctttatttccctccaagggagaactaggaagccagaccttataaagccaaaggaattcctgttgcccccttactgcaataatttaatctctaagaaactcaaaaaagcactaaggaaataaccctctaatcataaacaatccctctccatcaagagaaaacagacctctcctgcctggaattgcttaaacaggagtcttccatttcaccagagctccagggacaaaccagccaccagctaccacaatgggctgcaagtttcagaaacttgcaaaggggaatttttcatcctgattattgcctttgcagtgttctcagctgccagcatgtgatggagggcgtgggtatgagcctgcttttgtgttcttaaataaggctaagaggctgttctccttcgcttcttagccctagacactcatcaatcaaccagatttcctgagtgcacctactatgtgcaggtctttggaaagcaagtcacctcctatgtactttttaaattttttttttttttttttttttttttttttttttttttttttttttttttttgagacggagtctcgctctgtcgcccaggctggagtgcagtggcgcgatctcggctcactgcaagctccgcctcccgggttcacgccattctcctgcctcagcctcccgcgtagctgggactacaggcgcccgccaccacgcccggctaatttttttgtgttttttagtagagacggggtttcactgtgttagccaggatggtctcgatctcctgacctcgtgatccgcccgcctcagcctcccaaagtgctgggattacaggcgtgagccaccgcgcctggccaaatttttatttaaatgtttctgcatacagagtgggtttatatgtgtatagggtacatgagatgttttgatacaggcatgcaatgtgaaataaacacatcatgggtaatggtgtacccatcccctcaagcatttatcctttgagttacaaacaatccaattacactttttaagttattaaatatttttaaatatacaattattgaccatagtcaccctattgtgctattaaatactaggtcttattcattctttctaatttttttgtacccactaaccatccccacttcccttctgtccccctactagccttcccagcctctggtaaccatccttcaactctatgtctatgagttcaagtgttttgatttttagtccttttgtactttaaaaaatattggagggaagctaataatcaaggcaaaacaaataaagttctgatgctgccaaagcagaagggactttcccaaggtcacagagttcaaaaggagcagatccaggatttaattacatcaccctgtgtaatacagattgtttgacacatctcactcagttcactggaacttggcctgttccagcttaatctcatgccctctgcaaatcatactcttggctccacatccgtccaggttcctagagagcagcctctcattctgatctccaggcctttgcacaggctgtttcctgtgattgccaccctccatccagcctctatttcttcacttgactgtttgcttgccaccctttcattctctgcattaaccccactgcctcagaaagccgtttccaattccccagtctgtattggcggccctcctcttttctgctctgtggctatcctatcacggcactttccacactgcactgtaattgcctgtcctcacgtttaatcccctaatatgctgagagaccctcaagggcaggacccttgtctggtttctctctgaatccccaggaccatatgtaggatttagagcacaaacgtgacagtgaatttttgttaaagtaaggtggaccaaactctctctttaccaagctgcctccctgacaggtcaaatcccagactaaaaatagtagctttgcaactcctggctaatggctccaggcaggcacttctgtcccagagcacctgacctctgatctgtaaaatgttctggggtaacatgtgtcctcccacctttgcctcttacaggctcactgatcatcactgtcatttccctgataccacccccattatgggagaaggaaactttcagttttcatccaatgcagctcaagcatagggtaggccagagtgagcctggagagacaagacaagaaaagtaactctgcttctgccgtcactcagttagtttttctttattaaaagggaactttttattgaagcataacatatacacagaaaagtgggtaaattgtaagtctatagctcaaagcttcacattcatgtgaacacgttcatttcaccagcacaaaactcttaaaatgactaggactccagaagcctccgttttgtccccatccagtcactactacatcttgacttctatcatagattaatttggcctgttttaaaacattttataaaaggaattttacaatatgtactcttttgtatctggcttcttttgtttatagtatatagttaactttatagttggtgagattcatccatgtggttgcatatcattttggtatatgttctttctcatagctgtataatattccattgcatgaatctaccgcttttcatttatctatcctattatggatgaacatttgggtagtttccagtttggggctgtaatgaacagtgctgctatatgctatatccattcatgtatatgtcttttgataaatatacatttgcctttctgttggttagatactagatgtggaattgctgggttgtaatgtaagtggcttagctttaataaatacagctaaacaattttccacaccaaaagagatctaattaatctacatccttgcccatacttgatattgttgatatggttttgttttgttttgtttttccactttaactactggatgtagtagtgatatcacgttgggattttgatttgtacttttttgaattttgcctagtgtgttgtcattgaccatttggataacctgaagtatttgttcagatgttttgatcgtttttctttttctattatattctctgccattttcttattgacttgtagtaattctttatatagtctagataaaagtcctttgtcaattatatgtattgcagacatcttctcccattctatggcttgcctttttacttttctaatcttttggtaaatagaggatttaatttaaatgtggtccacattatcttttttttgttcatgattagcaccttttttgctccatttaagaagtttttgcctacctcaaagtcgtgaagatgttctcttgtatttccttccaaaagcttcatagtttttatctttcatatctagatattgaactgatctgtaattgaatttgtgtatggtgtgaggtaggagtcaatagtctttctgaatttttttttacaggactattgattgaagtgtccatctttttcccacttcattacagcattacttttgtcatacatcaagtgactgtacatctgtgggtctgtttcaggactcttctgttcttctgttccattgctgtatttgtctgccctgcaaataatacactgtctttattatggttcctttacaaaaagctttgatatctgggagtgttctctgattttttttcttcttcaagattatttggctattcttggtcatttgcatttctgcataaatgttagaatcatgatcgatttatatttttaaaaaacctgttattgagactgtttttgaactcatagaaaaacgtggggagatttgacaactttacattattaaatctttcaatcaatgaccatattattccatttatttagttttactctaagttctctcaataatgttttatagctttctgtggataagaagtcttgttcactttttcatgagatttattcctgggtattatatgttttatgctattgtgaataataactttttaaaatttcattttccagttgtttgtcactggtatataggaataaaattgacttttgtattttgaattaattttcagagactttgctaaattcacttattgcttctattactttgtatatagattattttggaatttacgtacacaataagttatgccaataattcccttctaatctttatagcttctctttttccttcttgccttattgcactggctattacctctacgatgttaaatagaagtggcaataatggacattcttgacttgttcccaatctcatggggaaagcttttaatatccatcattaagtaagattattgctatggcttttttgtaaatatttttatcacattaagaaagtttccttctattattagtttgctgatatgttttcttatgtgaatgtatatcaaatataatcagatactttttctgtgttctatgaacatattcatgtaattttttctgttaatgtgatgaattgtattgattaaattttgaatgttagactacccttgtattcttggaataaaccctacattgttattatatagcatactttttctaatttactggatatagagtttgctaatattttggggttgctacatctatggtcatgaaagagattgggcttccatcttaacttttacctcaattttgagatggatttttttctacctgggctgacccctcttttgtcctatatatagacttagttaaatagactttgcttctattattagcttaacaaacttcacccagatcctctagtttatttcttattgacagaacaaaagctttctcaacgacaaactagtcatgagccaagtcatggtccaaccactccctggcagtgtgtccactgtcacattatagatcctccctgagcctgtttccttatcaatgaaatagcattgaaaaagaagttagacaatgcataataaagcacctggtacaggcaggtgctcagtaattcccatttctcactacctcttctcttctgcttaaaaacttttcaaatacagaagagcattggcttacttatttacagggcttagccatcagagttaagattgaaatctgaaaaaatgaactaatgggggtgggagatgtccattctttttgttatactctaaaaaacaaagcgaagttgtttactgctcctgctaagcttctttaaatacaagctcctagatttttaaaattagataaacattgctagaatttatcatctgtagtgctacagttccttccctggggcttcaaactcaagtgttagtggagtattacacatttggaagttgtccaggaatatagcctctctcccacatttaacaatgtttatgtgtaaaagtcagcttggaaggacacctttaaataatgctctttctggatatataattgcagtgttacttgtcagtgcataataaaccatcaaccagcctttattgtaccagtgggaatgagagtttgagggtgccctgaaattatgttctttgtgtctgagatgagaattaggttagtagctaggctttatttatagatatccaaataaatcaggagtcagaagttcagaaagactgggctgggaaggctgagtccaaagaaggctgaagtctatgaacaccaagagtcaatacccctaatgctatcaaggacactggataggtcccatcctacttctccccattatctccaccccaagaactaatcccggtgacaggcatgagtgacatcagaatgaccttctgactaaatctgaacttggctcaagctgtggatccccagtggagtagaaagggcaaggccttaaggttggcagatcaatggcaaatctcagccctgccacctacttgcaactcagttctctcaccataacatggggatggtaactgacctacctagcaagacaactgtgagaatggaagggtattagctgatacctgtgaaggacatgatgcagggaacatgctcaataataaatggcagtgattgtgatgatagtgatactgatgaggatgagacaatgacaatgaagacaacatctctagctttgaataaaggggtggtagaggattacctatattatgcttatggaaacaggaggagcatccctaactgccttttttctaatccccacaattattttatggatctctgggcccagacacatgatcttagttggacaagccatgtctcaatttgtgttctcctaaaagcaggatctgaggcaaggactgcaggtacttcgtgtagaaggtgatagaggaagcagaagtgaaggaatagggagagagtgacaagggaggaggaagggtcaaggtaagagtgcattattcaggtcactggcatcagcgtacctctgagaggtgtatagaatgagtccagaattgtccactttccagaattttctactagcacccaccccctattgaccaagggttgtctgcagtagtgtgaacttccccacactcccaggcacttgcttgctggctaaattgactctcaaagcttcagagaaggccatgagtcagtcaacaggaagaggcccttgaggtagacactcactgatagcattagcaagtgctcactgctgcctgccatagttgtggctgaaattggaggtggatggagagtctgtgatacagggcaccaaatgtagctgctgcaggccaagtcttagttcaagtgcagactcctcctgcaagctgtctacttgccacatgtgatacacaattgtgagagtcccccgtcgtcagtagagtctttcctctcccatccccttgtgacagaaaggactacctgcacagttggttcttatatttagcagtacacaaacgtacaccaaattctagagctgtactgtccagtacagtagccactcgatacacttaaattgattagtttatttaaattaaataaaatttaaaatttatctcctcagtcacactggccacatttaagtgctcagtggccacatatgagaagtggctaccatattggacagtgaagtatagtatacttccaacttcttggaaagttaaactggacagtgccactcttgagagagtcagtctggatcctaatcctggctctaccatatactagctgggtggccctgggtgagtcatttaatctgtctgtgctttaatttgctaatctgtaacatgagtttatttccatgattaaataacaatatgtaagcatatagtaaagtctcactacatgttaatgattattatttcccaattcccagggtaatatttatgcaaggcaggaagtacttaaagagcctccaaccctgattcaggccctgggtcccttgaggctactctctgggcttctaaattatctctgtgctcaatatggccatgcccatatacctcccagtctccaaacagggatgttgctttagccctcactgccttttcagcttgtcagttccccaccctaagtccagaggctggagctggaacagtcacccccagcttatgtcaggagccctactgcctgcttctggaaacttctgtctgtgtgcctgactcattctgtcaccattttcccaccacttgcccaccctcccaatgggcctctgcactcccaatgctgactatgacctgaactgaccacctcactttaaaatgcttgctgtcctctaagaccttgtcctaccctaatggacaggtcctgtgcatgtcctggtttgctaccaatttctatctttcctagagaaataaaatattaatatttaaaataaccattattgaatgttttcttgtgtgccaggaactgtgctaagggctgtaatatggatttccttccgtaaccccatcacaaccatagaagataggtactattattatttccatttcacaggtaagaaaactggatcttagagaatttacatagtttgttcaagattgcacagcaagtatatggtgaaaacaagaatgtgatgaaatccttaagccagtaggaggtccttttcttctttcaagacaattgaaaagaaggagggactgatgcatacaacaacatggataaatctcaaatgcatgatgctaagaagtcagactcaaaaggctacatactgtgggagaccacttatatcttggaaaacttaaaactatagggacagaaaacaaaccagaggttgccaagggctgggagtggtggtggggttgttacatgggaatgtgggtaggtaatacaactattcattatcttgattatagtagttactatgtagttgcctgcatttgtcaaaacttgctagactttacattaaaaggggtgaatattactgaattcaaagcatacttttatttttaaatggaaaataaagaagatagagagtaattttcctctgaatgccccccagcaattgttcaaatgtgggaatagaggggaacaaacatcagtttaaagatttggtggagaaaataagctcgggttcagattgcaaggaagataattcaaggagaggaaatggaagcagtgggttcagactgaccttcctgaaaagcctggaggtgcaggaaaggcaaaagatgggcttttgtgagaacaaagcattgatggaagatttttttttcacccagaatgagaaaacttgaacctctttacttaaagggagaagctcttcagtgaagaagagattaaaggtgcaccttacccacatatttcccatttccagcactctttattccttcatgtagatctgtatttccatctgttttcattttccttcagcctaaagaacttcctttaatatttcatatactgcagatgtgctaataataaattcacacagctttcatttatttaaaaaaacgttttatttttaccctcatttttgaaggatatctttgcaagacacagaattctaggctgacagtttttttttttaagctttaaagttgtcatttcattgtcttctagtttgccttgtttttgaagcaagtcatcattcttatctttgtttccctcattgtgtcttttatcgctttttgttgctttgaagattttctctttttctctagttattagattatgatgtgcttaggcatcattctctttgtttttattctgtttggggtttgttgatctgggatctataggttggtatttttcttcaaatttgggagaatttcaggcattgtctcttaaaatatttttttttatttatttatttattttgagatggagtcttgctctgtcgcccaggctggagtgcagtgcacgatctcggcccactgcaagctctacctcccaggttcataccattctcctgcctcagccgcctgagtaactgggactacaggcgcccgccaccaggcctggctacttttttgtatttttagtagagacagggtttcaccgtgttagccaggatggtcttgatctcctgacctcgtgatctgcccgcctcagcctcccaaagtgctgggattacaggcgtgagccactgtgcccggcctgtctcttcaaatatttttctaactcaatctatctattctctccttctggaactccaattaccactatgttaaaccacttgtttttattccacagtcatttataccctagttcatttttttcagcccatttttctctgtgcttcattttgaattgttttcatcaccctatcttttagttcactgatcttttcctttgctgtgttcaaatacagatattatatttttcacttctgaaatttccatcagagctttttaaaatagtttttatttatctaccaaaattccctatctgttcactcattatgtccatctttaaatccttgaacatattgataatagctgttttaaagttcttgtacgttagttccacatgtcagtcatctcaggaactcctgttattgactgtggggctttttcctgatttggggttacatttcctgcctttatactgctcttgtaattttttttttttttttttgagacaggatctccttctgtcacccaggctggaatagagtggcaatcatagctcacttcaaccttgaactcctggaccaagtgatcctcccacctcagcctctggagtatctgtgactacaggcaggcaccaccatgcccagctagtttttaaaaaaattttgtagagatgaggcctcactatgttgcccaggttgatctcaaactcctgtgctcaagtgatcctctcacctaggcctcccaaagtgctgggattacaggcatgagcaccatgcccagccatgtctagaaattttttattgcatgatggacattgtaaatactacattgttgagtgtctggattttttatcttcctttaaagagtatgacaaatggttaatttactgatggatctgcttcattcctttcccaggcctgttttctaagctgtgttggggtaagtctagagtagcctttactctagggctaatgtagttttgctactaaattgtagcctttctagggtttcagttgaacatatagtgttcagcaagttctctctaacatggatgggtagatattttatatctctagcattgtgtgacctctagaatctctattcagctcttagctccccaggggctgttctctgccaggccttgtaaagtgtcaccctgcacaagtgaagcttagtgtttggtcaaagatttaaggggacttctatgcatattctgaagttccatctccatgcagcttcctcctctctggcattctagcccataaatcctatctactttaattgccccaaattcttacctctacctcctcagctcagacagtttaccatggtcagttctactccaccttcctgcaccacaaacaagaaagtgtctgtggcagaaagcctgggcaaacacgggctcatctcttgtgtttcccttctgtcagtgatcatagtcctttgcggtctgttttccaacatccgaaaactggtgcttaatatattttgcccacttatagttatttatgtccagagggctaatgcagtgccacttacttaatcagagtcagaagcagaagtcaagtgagcatatgcagatctgggagttgtctatagacaggactatcttattctcttctctgcttcacattgccttaaagataaaatgtttctattaagacagtcatatcctatcatgatctgcctggctgactgatctcatcactgatcatccagtctttatacacacacactcacacacacacacacacgcacacactaccatgacctactcgtagtcttacacatatctctagctttttcttatgcctctgcttttgcatctattattttgtctacaaaaataaccttcccccaactccctacctgccttcctaactgctacttatccttcagaatttagctcacctgccatctcctccaggacacctcctctggaaccatctgggttaagtgcccccttatttgtgctgtgacattctgtgtttgcctttatcaaagttgtatcacccacgctttattgtaattgcctgttatgacctatcttccatgcccttcacaccccaccctccagacagaacatctctaagaccgggatcaagtctgagtcatctcagtgtctctatgacctggcacaggttttgaaactttttgtatgaagggccaaacagtaaatattttagagattgtaggccagacatcttcagctgtaactactcaactctgccgttgtagcatgaaagtggccataaacaatagataatacataaaatataagactttattgaaatagaaacaggcaactgtagcttactgatccttggactagcacatagtataatcccagtaaatattcattgaatgaattaataaaatattattattggaggcctcagaagaaatagaaaataatgtaatcaattttataagtgcaagagttttcctgggaacggaaaagtggcactttccttgaggccctagggaaggaaaaaaagacagtggagtgaagaaggcaggataatagaaaactgggggatttctggcctaaatgacagacttccccatgcatggcttttgccaggaggccattctgggatgggaacctgaaaaccagaatggtctggtcagagtgagttcccaaggcagccaagaacagagaatgccaaaggacaagtacaagctgtgtcctgggcagcacccaggcgcaaacccgcagaaggcatgttttgcagccaaattcaaagtgtcagaaaccaggcaggttctagaactgcatctagcatgaaaataacaagggcaagagggatgtgagatccaaaacaacttttatgaatacaactggcaggtccacaatacttttctgttggtcactggccacattgtgcatggatgagtctgtagatgggttaaccttggctttttcagaagagttaagtgaccagttcatctactaagaaataaaaggaggaggggagcctagaacttagaggctggaggagatctgtcatatataactactatagcagattccataagggcccaatcagggctcaaaacaaagatttgctgaaaagtactatgggtgaggctgaggttagacaacagaaggttgcagcaatctaatcactaaggttgtaggacattctgtagagaagcattatgaatgagtatcaaggaaatgaataggtggcttgctgcagaattgggattggcaggggaatgcagccactggccaggagatccagatagtcactgaatacctgttgtattagtcagggttctcctaagaaataaaatcaatagggtatgtggcggggcagggcggtggtgaagagatttataaggatgtggctaacctgagtacagaggctgagaagtcccaagacaatgcagttagcaagctggagtcctaggggaaccaatggtatagttccagtctcagtgtgaaggcctgggaaccaggattgttgatggttcagttccagtcctaaggccagtaggctgaagacccaggaaaagccagtgttttagtttaagtccaaaggcagggggaaaaaagcaaggttccagcttaaaggcagttaggcagaaggcatttcctcttcctccagggagagtctgccttttatgttctattcaggtcttcagctgactagatagggcccacccacaatagggagagcagtctgttttactctaccaattcaaatattcatccagaacaccctcatagacataactactttgatcaaatgtctgccctccccatagcccagtcaggttgacatataaaattaaccatcactctgccatgtgcagaacacctcagagaatctatctaccatgcaccctgtctccttcaacactagataaaatatcagacagaattatttgattagcactggtgttttaagcatcattgtgaatgctggcaatttagtaccaatgatgacagcagaaaggatgttaggaaagaggttactacacatatactcaaaattatctccctggagtagctttttagacaaatgcacctggttggccatcagtatctcaaacttacatgtctaattatttcttcctcccagcttccccccacctctgggcctcatctaagctattgggaataaataaataaacccagagaggctacttgaactctgctggaaccagtgagggacatgcaaaatcaaaaagccatgtccttacctgaaagccaaaaaggatagtgatagtctgccgcttccccctaggtctgagttcccagtgtttcaccaaagactccagaggctctgagttttcctttaaggccacaagctttaacctcgtctcctttttcccagccctcctgatacctgagtcttttctctctcctcctctatttactagaggatgtggggcccaggtgtaaactttctcgtgtcccagctaactgagatctgcttaaccacctcattctgcaggccccagatcagagtcccatttagatgattccttgactccttttttcagattcagatccttgcatgtgacattcctgtcatctccacacccctccccaatcacccaatcagattctctttggttaccatgccttacagaaatgtgtctgcattttccctgctctatttagatttaattttactagctaatatttattgaccctattttatgcgccagccactagtcactatttcatggacttcagccttggaacaacactaggaggctgatcatattactatccctattttacagatgaagaaactgagattgagagtgactaactgatgtgtttaatgtagaaagtttcagaaccaagactagaatatacatagatctgacctccgaaaaaaaaaaaaaaacccagttttaactactttaccaaaatgcctcccaaggactgttcagtcttctgtcttattgtctcacactcctggccccttgtccccattccccctaccactgccctaagtcagacactgcatgattcatgaagggaatgtcaaagggccttctatttggtctcctcaccttcagaccctctcccttcctatccctgggtatgtcctaccaaaggtatggtaccatgcagcagagaagagctggtctttggctctttgactcaactttgaatcccagtgtcataactcgcctgcctctgcatttttgggttaactgaatgagaatagcatctgtattaacagttttctttttgagcgtttaatgagataacataggtcgagaccttggcattgtgcctgacacatagtaaagtctcgtgtattagtccattttcacatgatataaagaactacctgagactctaatgtaaaaagaggtgtaattgactcacagttccgcatggctggggaggcctcaggaaacttacagtcatggcagaaggtgaaagacaagcaagcaccttcttcacaaggtggcaggagagagcaagagtaaaggggaaactgccacacacttttaagctatcatatataataagaactcactatcatgagaacagcataagggatatcacccccatgatccaatcacctctcaccaggtccctccctcgacatgtgggaattacaacttgagatgagatttgggtggagacacagagccaaaccatatcattctgtctctggaccctcccaaatctcatgtctttctcacatttcaaaacacaatcatgccttcccaacagtcccccaaagtctcaactcattccagcactaactcaaaagtccaagtccaaagtctcatctgagacaagggaagtcccttctgcctataagcctgtaaaatcaagagcaaattagttacttccaaggtaaaatgaggatacaggaattgggtagatgctcccattccaaatgggagaaattggccaaaacaaaggggctataggccccatgcaaatccaaaacccaaggcagtcattaaatcttaaagctccaaaataatctcctttgactctgtgtctcatatccaggccacgtcgatgtaagaggtgggctcccgaggccttgggcagctccacccctgaggctctgcagggtacagcccccgcggatgctttcacaaactggtgttgactgcccatagcttttccaggtacacagtgcaagctgtcagtgaatctaccattcaggggtctgaaggatgatgaccctcttctcatacctccactagacagtgtcccagtggggactctgtgtggtgagtcttcagccccacatttcccctctgcatggccctactagaggttctccatgagggctctgcccctgcagcaggcttctgcctggacatccaggcatttccatacatcctctgaaatctaggcagaggtccccaaacctcaattcttgccatctgtgtacccacagacccccaacaccacgtagaagcagccaaggcttggggcttgcaccctctaaagcaatggctcgagctgtaccttggcaccttttagccatggctggagcttgagcagctgggacagaaggcaccatgtcccaaggctgcacagaccagcagggccttgggcctggcccagaaaaccattttccctccttggtctcccagcctgtgatagcaggggctgctgtgaagatctctgaaatgcccttggagacattttccccattgtcttgactattaacatttggctttttacttatgcaaatttctcttgaatttctccccagaaaatgttttttttttcttaccacataggctgcaaattttccaaacttttatgccctgcttcccttttaaacataagttccaatttcagaccatctctttgtgaatgcatatgactatatgcttttagaatcaaccaggtcaaatcttaaatgctttgctacttagaaatttctgctgctagataccataaatcctctctttcaagttgaaagttccacagatctctagagcagaagaaaaatgctgccgctccctttgctaaagtgtagcaaatgtaacgtttactcccgttcccaagaagtttcttacttttatctgagaccacttcaacctggacttcattgtccatatcactatcaggattttggtcaaattcactcaacaaatctccaggaagttccaatctatcccacatcttcctgtcttcttgtgagccctccaaactgctccaacctctgcctgttacctgcttccaaagttgcttccacattttcaggtatctttatagcagtgccccactttgggtaccaattttctatattagtccattttcacactgctataaagaactacctgcgactcggtaatttataaataaaagaagtttaattgactaacagttcgacatggctggggaggcctcaggaaacttacaatcatggcagaaggtgaaggagaagcaggcgccttcttcacaaggcagcaggagacagcaagaatgaagggggtactgccacacactttcaaaccatcagatctcatgagaactcactcactatcatgagaacagcataagggaaactgctttcatgacctcccaccaaatctctcctgtgacatgtgggaattacaactcgggatgaaattcaggtcaatagtcaatagtcaaatagtcaatcatcaaatagtcaatcctcactataaccttatcctcatgttacatatgaagaaactgaggcccagagagcttaaggaatcagcccaagctcacagagcaaggaaggagcaaaactgaggttcaagcccaggtctgcctgactccagaacacatgttcatctccctacatcccactgtgaggtcatgatacagaagagatgattggatggactctggaaacaaagaaattagatgaaaaagaatttcagggctaggttgtggtgggtgctgagtgcccttggtggtaaatggcattggaaaagggggaaacatgatcaaaagttcctcctgcgaagaatgacataacaatagttaacatgtattaggctgatatggtttgtctctgtgttgtgtttgttctcaaacccccttataccagttattctgacattgtgcttacataatttagttaaatcttttgaaattgatgagatatgagtgagaaaaggaaggcattttttatggctgctctgaaaggactcaacagaggcaagttgtcaaaactattgtcaaatagtttaaattaaatcagataagtgtaccttcaatcagaaatataaatcatgccaataatttatcacccctgatttccagtttaggcttcttgaaaatgaatctgtacttaaagatacttgcagaaccttctgagtatagaactcctgagttttacaacttttcccaatcttttacagatatcttgctctcacctaattatatattattttcagcaacttgcctctgttgagtcctttcagagcagtcataaaaaatgccttccttttctcactcatatctcatcaatttcaaaagatttaactaaattatgtaagcacagtgtcagaataactggtataaggaggtttgagaacaaacacaacacagagccaaaccatatcagcttaatacatgttaactattgttatgtcattcttcgcaggaggaacttttgatcatgtttcccccttttccaatgccatttaccaccatcggcactcagcacccaccacaacctagccctgaagttctttttcatctaatttctttgtttctagagtccatccaatcgtctcttctgtatcatgacctcacagtgggatgtagggagatgaacgtgtgttctggagtcaggcagacctgggcttgaacctcagttttgctccttccttgctctgtgagcttgggctgattccttaagctctctgggcctcagtttcttcgtatgtaacatgaggataaggttatggtgaggattacacataggagatcatcatcctaacacctattagatgtttgagcctagcatctgtattgttcattgaatccctgctccgactagcctgccagtcctgcgcccggcaaactatccccttttctatctatttctttacatctctaggcaccctccttccaactggaaagttcccttgctccaccaccttcttttggattggtgcttcatatctgtaataatactgagagctttgttttgtacaactctttacagctttcacaattctttcgaaaactatctcaattaatttgtacaactctgggagattctccagcttggtaattattatttctatttcttaaagggaaactgaggctctgagagattgaatgactggtttgtggttataaatggggcctggagccagagtcttctggctcctggtcaccatgcctttcttccctgcaccattttgcacctgaatgactgctgctcacctgacatcaataccctttgtaatgttgcaaattgtttttccataggtgcctgtcttgtcccccgagggcagcgacatagtcttattccttccccctggccaagtgccttacaaatatctgttatttggttgatgtcattaaatgtgttaaaaatttgaattaggtcgggcgcagtggctcacgcctgtaatcccaacactgtgggaggccaaggcgggcaaatcacaaggtcaggagtttgagaccagcctggccaacatggtgaaaccccgtctctactaacaatacaaaaaattagctgggcgtggtggcggacgcctgtaatcccagctactagggaggctgaggcaagagaatcgcttgaacctgggaggcagaggttgcagtgagctgagattctgccactacactctagcccaggcaacagtacaagactccgtctcaaaaaaaaaaaaattgaattaatatgttatgttgtaaggccattgtaggaaactaacagctgtattggctaggaggttgaacttgtgtaattaaattttatttaagagagagaaccataaagataggtcccacgcttgaggtgcctgtttctctgcactcgtgcctttggactttgattccttggatctggggaatttggagttagctgctccatcctctgtgctctgcattcttgtgctataaaaaaccctgaccacagtggattgtaattaatccgcttatccatctgtttcccctgcccccagactgtgagtcccttcagggcaacaccatatccagtcctcctcagtgtccagggcccgccactgtgcttggcacataatggaagttacaagaataagccagaaaactccatctgggtccctcccctaatcccctaggattgtacatgttcccattatcttatcatacatatttcttatctcttatactgaattaaaggcaagtttcatgttttactcagttttgtagcctccctaccaaccatgaaaggaagaaactataattattgactgtctattgtgtgccagtagtgatttcaatatattatctcacttttaaataatttaatttaattctcataataggttgataaggtaggcattatcatccctgaattacaaacgagggaactgagactcagggaaataaagtaattgaatttaaccaagtttacaaagccagtaagtggtaatgctaggatttcagtccctgtctgctggctctaagaccaatgcctttcttttttgttgttgctttttgttttttaacagcacataggatactgccttagcctagcaggtgtcaggaactctgctgaaataagacttgaatttaatcacggtgaatcaaatctgtgcaagcctgttcccaactatgtcaagtgcatatactgctgccctcccatttgattgtttggatgaaatgcttctggaaacatatactgagcactaacaacacactaggcacagcactaggtgttgggctgaagtcaggctccctcaagaaacgttcagcctagtgagataacagactgtaagagtgataataaatgtgatttgtgctatggcaagacagaagacaaaagtttaggttggcttgtggtggtcttgagtaacttctgagtattttataaaggaggaatgggagttggctaagccaaacaagaggagagtacagagcaaagagcatatggtaattctgcactaaggtacagaattgcaggcaggacacgcctagaacaaggagtattttggtggagaagggcagggagagcaagagtttctgaagctgcttcactctgtgtccacatcacgaacctaaggccattactggttaccagccattgcccctacacaagtgtactttggctttgatgacggctaggactcttcacccaggaaatgagttagagaaacggctggcagcatctctatctgtctactctagggatatgagagatgaaggataaacatggggtctgcattttcccgatgtgtaggaaataatgaacaagcaattgggcaaacccgcatggtgatgtcctctgcctggggtgggccgtggctgccctcagcaggccaggaaggtgcggcctggctttacacctatgttcttgatgtggccctggagcagagggccatggggaagcgatgtgagctgtaaacagaaccaggccatgttcagaaccactttctttctttcttttttttttttttcttttttcaagagtgtttattaaaataggcagtaatggggtgaagagttctgcccactctgggccacaggatgggaaactgaaaatgttagttgggttcacccagttcaagttttcctctttgatatgcctgaaaatgttatttaacttgagactttgtttaaccaaccaaagaatggctgagaattgagccaactgtgtgatgaactaattatatgtaacttagtcaataataaatgtatatgcatctgtattcatcacatgtaaaaaacaaatccagtaaggtgctgatactatcagttccttcttcctccaggacttaaataaaatcctcaagtcaagttctgtcttgctccagcccagatcttactctgttttcccatgctgttgtgttgtgcattaattccctcccacatcccactgcagccaccatcccatgtgatcttcaccaaaccactgtggactggtcacttccacatatccaaactgtccatcacatcctttaaatatagctaacctgcctgccccttgtactgaaatgtacatagaagtcagctgaaatcaaccatgtttacttctaaggctggtccccacacatttcttttatcttttgctccttgcttacctctccagctctccactccaactgtgctctctccaatgcattcttcacactgctgtctggatgatttatctaaaattcaaatgcaattatatcactcctctgccagaacccttcagtggttctcagatcctttcaaatgacatccaaactcctgaagcatttagagcaaggccattcatgagccagcttcttcctacctccctggcatcatctcctaactttccccttgacagtttgtgacacagcaatgctgaattagttatgactctccaaacacacaatgttatttaatgtttctgagtctggtctatggctataccaccctgaatgcacccaatcttgtctgatctcagaagctaagcagggtcaagcctggttagcacttggatgggagtctgccagaacagtcctttctactctattttgccttacaaatatgatcagcctttaacgttctctcaactatccccttctctgagaccttcctagacagaacgcatctctgggctgcctctgcgtcttgttcaacatctgctgttgacctgtctgtacattcccaagacctatttgcttataggaactcagtcttatcactgaatggcacagggcctaagacagaataggtgcttagtcagtgctctttgaatcgatgtccaattacgcatcctccccatcatttaagggactcgtgtttcagccacagccatgctgataactgcctcctgattggctttcccaggtcgggccaaccactggtctgcgatcatcggaggatcccactccaagaattatgtactgtgggaatatggaggatatgccagcgaaggcgtcaaacaagttgcagaattgggctcacccgtgaaaatggaggaagaaattcgacaacaggtaagacaaaaaaatcacagaatgaccaaataacagaaatgcagtcaaagcactccttagatatctttcccaggggcttgaaatttgcagtacaatgtggtggaagaaaatctatttgctgagtttgggggttttatgttaagtagaggacagacagaggcacaaatatccattttgttgtctcagattgtccctgactgcattcatgttttcttcagcctgtgctaaatgctgctgctgtggccatattgttgggatgccttgtctctagtctcctgagagtcaaagccatgaattaaggttttcttactgtgatctttgagagggtcagaggagtaatagtcaagctgtccagccaaatccccaaaataaatgtttgagtattggcacgtgctttttgcaactatgtcttgaggtacttgataaattagtcgttcgttcatcataatcattatggactgaggcatcttctgtgtcctatgctgtgtgggcccaggagcagtcccactctctaggccttcactgatacctctgtgagataagggagaaaaagtccataattcttatcaattcatttggctgacagtgccatcgtccttcatcaaaagcctaatcaggttgacaccagagagaggctaatgagagaaccttggaagaagagccacgtggctcagtggtggtttgctgcaagacatggcagtgcagctttagccatcactacccacaaaagcctgtccagcctgagagagcacatggcagcatgtcccactgcccaccaagtgctctggaggaagtaaggaaagagcaaagcatgcttgggatgtgatcattttacaacacaggtcactgagaggctgttgccctccctgtgctcctgtcccacatctcctgaaacaatgcaggaggctaagaaaacaccagggaccccatctcacagtctgcatgtgcccagaggcctgagcagcacagcagggcaagcacagctgaggcccgcagtgttccccaccatctggactccaagctgcccacagaccctaaattggaggcaacaaaggtcactctgactcctgctataaatcccctgaggaatcagtttggactagagtcgaaaaatgccccagaatgagcttatgtttcttattaatttgatttgaagtctttcctcctttcttggaaaaaaagatgtttgaccagatgttttaagagtgcatgctattcatccaagatgagctatctaactatgctctgtttctctgactctggctgccatgcctcataattggcatcactccttcagactatggcaaagtcatgcagggctctatattggtgctagtctgtctggcctatcatgggggaaccattgtttgggatcctggaggttcacattcccagttctcaagtatggaattatgcctccctgatttgtcaagctccatggtgtggaatcttgaaaaccttttgttacaaatagtagttgaaatactaaagtttgccagttaattacatcagggtcaagggcatcttcataataatgtcagtctcacttgttggctttcttgagaggtttctggaaaagaaagaatcctgcaggaatcatacataactggaactatattgtgctggtgaacattatctgacatgtcatagcaataaaaagattgaaaactcatggatgggaccccccaccaccaccactgccagcctcagaatccctcttaggaaaaagttctttggtatgttcctaatcagcatggctgtgattggcttgtattaccacacaggcaatgtctgtctgcctatcccagctggctagtgtttcagacaaacagtcgtaataataagtttaattatgggtaccgcacatgggaatgaacatatctcagtgcctgtcaccacctttcaggccccctgggtgctggatatctacttttcgcccccctcacatctaggctgaggatgctattattatcccagttttacagataaggaaaccaaggcatggtcaacagcagagaataccaggacttaaacctaagtctgtctggctccaaagcccagacagtactagacatataatctgctccgtgtaaacctgaggccacttgtttgaaacttgttgagaatctcaagatggcagtaccgtgaatttcatagcatggggtcctgtgagcctgcatgggtcacctgcccctgaagccaggcctacctgtataatttccctgtcccacacagctgccccacagagaaattcctcttgccagcctctgaatctggcctctgctaacagtgcctcaggttccccagctcctgggaaagtcagttggatagggtgatttcaggattccaaataactcatctttctaaatattgttccccgcaagcacacaattgatttatttttttgtaagtcaggtaagaaacaacattaaaataagcaagaatatgaatcctcctagaatacaaaagtgtcctctgaataaccagaaacttgtttgaaaacatctgcaaactaacacagtgttctcgggctttaatactttatatcctaccaatcactttgtcaaagaacctgagtccagccatgatgaaaataaaaagccctcttttctcaagaaagacatttatatgcttaccagcattctcttattataaacttacggctcactgcaagtttcaagggcatgaagaatcacaatagatattcttggaggtaaattttatgctaatggctttcaagcacaaatgaacaaaaatactaatcctattaatagtggaagtattaataataataacagtatattaataataatactgttgagtataaattttaatgttactataactgcaaaacaccaagaaaattaatgaaaaattacagcagaattattggcagtagtgacactagtggctggggctggggaaggccacaatgctcaccctttcgtggaaggacaaaggcaaatgtgtcctggtggccaggacacctggggactgggaattagaaatactgagctatggctagcctggcaggtcacaaatgggtaatccaaggcaggcgggggctgtaggaaatggtagatcacacttgtaggttggtgtgggagtggaaagtgagcttatgaatactcgttatgaaaacacttcatcccactaagaccatttctacttcagtaagcccatatttctggcatgtttactaagtgtctggttctctgctggatgctggcccaaagatgatgcccctttcactcggttattcaggctagaatccttgatctctccacacccaaacttgtgccttctcttttaaattcatccagttcaatctgccctcatcaccacctccctccacttatctcttgcctaaattgctgcactagcctcctgatgcccctgcctctgattctcctcctgttgcccatgctgccccagggccatctttataaaaaacaaatcagatcatgccactcccccacttaaaatgtttaatagcttctccttgaccctaagataaagtccaaattccttatcaaagcctgaataccctttatgtcctgcccttgtcttacctctccaattttatttcttgctgcaaatctaagttttgggcatacagaacctctttcagtctatgcacaagggccatgcccttcttgtctctggaccttctctcagccagacatcttccagcagccttctaactggtgaactcctattcatcccttaggacttagcttagatgttgcctcttccaggaggctttccctgattctgtactaaattgatcttgccaggtgctctcccagcactttgtccttctcctattgttagcatcatcacacttacatatttctttgatgtctctccctcactaaacaacaaggtttaaagctgccgttcccactattatatcccctgagcttggcatagtattggatgcttcctaaatgtttcttgaatatatagtttgttcattcaataactttataaatatttattgaacttattagtttattcatttggtaattttactgaacacctactatatgctaggcattggagatgcagcagtaattaagaaaactcctttccttcatgagcctacatcctaacagtggagaaaaggaaaacatgtaaaatatatatatatatatttaagtgaaaagaaaccaacaagggtggtagtgacataaagaggattaggagtagggaggggcctgttttagataaaccggtcagggaaagtctccctaacaaatgaccatgaagcagaaacccaaaagacaagtgtaggggaaaatcattttagatgctaacaacagcacatgcaaagggcctgtgggagaacataacttattgtgcttagaactaaaaaaagactagtgtgacacaaggatagtgaggggattgtggcacaaaaggaggctggagagttgaatgccggaccactttgtctctactcagacgaaattaacaaagtgggagaggcacatacatgactatttccatagaaggtacttattccttaggggaatctgtgcatccattggggaaatgtggacacacatttgggcagggccttgttgggtttcctctctgctggagtctccttttccaatccacgtctgcttctttccactattctagtccttcattagggctacttttatgtcttcaataattttaaatatgtctaattgtctctttcagattattctattttctcataatcttagagactatttttccttttcattgaacttgctctctcagtgacattagtttcttctttggttttaaattgtttgatcatcttcagtggtatttgttttgtttttttgagatggaatttcactcttgtcaccctggctggagtgcagtggtgcaatcttagctcactgcaacctccgcctcctgggttcaagcgattctcctgcctcagcctcctgagtagctgggattacaggcgcctgccatcatgcccagctaatttttgtatttttagtagagacggggttttaccatgctggtcaggctggtctcgaaatcctgacctcaggtgatccacccaccttggcctcccaaagtgctaggattacaggcgtgagccaccacacttggcctcagtagttttttttctttttcttttttttcctgttggaggaaaaaaggttcaagtgatggtgtctttacagtgactttgtattttcttctcctggtcccacccaagtttttatgtcctttctcagattggaattgcccactgcacagctagtatacgtctggaccctgcactaacacatgagagcaattgggagttccatttcttggaggtgtcttgggcagaaacaaccttccttgccatgttcccgaatgcttgatggagggttttctcatgccctattcacaaacagggcagccctttaaaacatccactgtatgcaggcgtgccccccccatgccccacttctcactggctcaagatttccccttctctccatgcatgggcttctaaacccccgcctccagctcctggggcctgtatcccagtccagggccccaacagctcaccacgcactagctcctgcttactgttctgagttagactttcctccctatttctggcatctgggcagtttttctaaacttgtttacatatttttgtaatgtgttttgttatatttgtccagcatttctatctgtttgtagaaggagagagaactttttgtgtcagttcagttttccacattttcaggtatccagctaatatctgtagcacctaacaaatatctgaattgatgacaagcaagccatgaatggttcttgcataaaactctgagctttgaagagtcacccatttattaaaaatccattagaaaaatcattccaacttttatatttctctggattcaaggctttcctgaccataagaggtcagataatggtggaccctaatacaggcattgattatttcaccttcaggagaccttgttttggaggatgacttgaaccagcccacaggattatcacaccgcctgtggcatgagaagcaatagacaagcagatgttctttttctttaaagttgaaacagtttatatggctccaggaactggaagaaaaggtttgagaattttcttttctcatctcctttaaatcattggagatgacatatgtctactaaactattgtttttttctgatttttgattttctaaatttttaatcacttttctttaattaaagccatggcctgacttcaagtgttctctatgattcatgacatgctgcctcatccggtttggaaaaaccacacacaaacacacacacaccccaccagcttttatttataataataaagctccagtgatcttccatgcttatgagaagtagtgatgtataatgtctaaaagcattgcctctgaatcaagatttcctgagttcaaatcctggctccatcccctgccaactatgtgactttgggcaagttacttaacccctctgtgtctcagttctctcttctatgagatgaaaatggcgattgtgccaacctcatagagtcattctgaggactaagtgagctgataagtgtaaagtacttggagcagagcctgcccttagaaagagattgctggatgttagctatcattaccatgttttcattcttcagcctctgtttccttatcagtaaaatgaggggtttgtcctaagaccccctgcaggactagaaaatttaatgttcaagttcgtgtcatttctcagtgtgaaaaggtccagaggatgaggccacaactcctttaccatctacttcaactacttcagcatccccaggcactgcccaagcctgcccctcctatccccacttgacagtgtcatctcccaatttgccctaacattttttcccaaagttgatcataagcaattaagggtataaattaagccttcaaatatagaaagagctacagtaaaactccacgcccattcccaactcactgctttgcacatgctccctcccttccttggaacagcctcatcaggatgctcgctggagctagttcgatgccacctccagaacagccctagaggcagccatggagcacatcttcctgaatgtagcaagacacaagccaaggggcagaaatgtggctcccaacctaaggagagaggtggtttagtgaagtctagtttgattgtaacaggaacccactgaaactaacttaagaacaaaggaaactttattgtagaaagaaagtaggacacatgagaacacaagtttgtgcagagtacaaaaaccctcacgaaagctggaattggaaggcatcaggctgagacgaccactaactctctctccctcctccacactgcccccagtgtcaggtggtcttttccatgcccttccatgcaaatctctccccgactatttctcaacagagctgctgcctctgcttacttgggttgcacatggccccaaatggtagccataggatcttcctccttggcttctcacagctagctgagcagttttggtgactcttagtgaagcaccagaaaaacaggttgatcactggatagcctgggcaatggtgccccctgcatcagatatctacccttactccaatccagtggccacctctgtgtaaagaaccatccggcctgttattatatccagtggctgtgggcagggcagtttatactaagaagggaactgaaggcctgggtgtggtggctcatgcctgtaatcccagtattttgggaggctgaggtgggcagatcacttgagctcaggagttcaagaccagcctgggcaacacagtgagcccttatctctacaagaaataccaaaaattagccaggcatggaggtgcacgtctgtagtcccagcagttgggggactgaggtggaaggatcacttggcccaggaggcagaggctttagtgagccacgatcacaccactgcactccagcctgggcgacagagtcagaccctgtttccaaaaaaaaaaaaagggcaggggaaactgaaggtagaagataaatttatatttcagggcagcagtggatgggcaagaattagactgagttgcagggccctagccaaaggacaggagctcagggcaggatttcagtcctgtagaagagaggggcactgaagagagaagaagttcaggagcactaaagaaagaagagggaagatcagcagaaacccagagttcagagctgcaccaattgggtgacaaaatgctgggtctagagtttggtttagcaattgaggtgggatcaagggacattactaggcctaaacacaaggatatggaaaggcagaggtcagagaaagagtatggggccccaaagcactgttaaggccacttatttacccttgccacctgctgccttgcattgttacttaagaaccatgaaaacagtagagaacctgtacttcttaagtctctgacctcgagtaggtcacctaagctcactgagccttagattttacatttgaaaaacaataacaagaatatgaattacctctgttggttatgaaataatacgtgtacaaagcatggcttggagtatgagctcattattactcttattattgcaacaaaaaaattaaattggaaggacttagaacccttttttccttccatcttctaaaagggtatttcggttttactgggtgggaatacaatggaaagaagacataaattgggctaggtagaatctactagagcataaagacaaggaaaagggagaaagaaagatccaaagaagacttttagaccaggcgtggtggctcacacctgtaatcccagcattttgggaggccaaggcaggcagatcacttgagttcaggagttcgagaccaatctggccaacatggtgaaaccctgtctctactaaaaatacaaaaattagccaggcgtggcggcaggcacctgtaatcccagctactcaggaggctgaggcaggagaatcacttgaacctgggaggcagaggttgcagtgagctgagattgtgccactgcactctagcctgggtgaccgagtgagtgagactccatctccaataataataataataataataataataataataatgaaaaataaaaagtaaaaacccaaagaagactttgagtaaatttgatttctaaaagaggaaacttcaaaagagaacttttagcagtatactttgcagaatattgtgtgatgtcattttccctttgctgccttctcaagaaaacttcagcaaagacctctaatactttttcaaggcttctgggagtcagattgggtctgtttttttaggtgtgtcaccctgctgcaaatggcccccaagggtgcccaaccttatttgggttacattgatgacacacacctcctttgttctcccctacctcattcaaggcttaattccatgtagtatgggtaagtgggcacttgtggttggtagaaataaaatgacactcagagtggtgatagggtaaggagtcaaataaagattctgtcacagatactcgatacagaaattaagacattgtttgaaaggtatgatttgagtcatatgaaacctcttgtttgctttcagttgagtcttcaaacaaatccagattacagtaggacaagctgccagagtgatttcgtgatgcctgttctttaataaaactggcacaggctgcctttgctggaagggtatagagctggcctcttagcattacttcttaacctctacagttttataagacagcatcatgatccctgggaatttttctgagaatctctgtatgagagaaatgtgggacagtcttattcaagacttacagaatatttgactcactaaaatatctatttttacagtaactgagccaaaatattgcaaatagaaggcaaatttaagtgagagatcattaatatattaccttaagatttagaagacaatttagcaatatctatcaaaattatacgttttcttttttctattgtagtaaaagaaaacacataatatttaccatctgaaccatttttaagtgcacagttcaggagtgttaggtatattcacattgttgtgtgtatattttccttatacatcaacataataaaataattctatatctaggaatatgtctttctgaaatagtcttgtgcaaaagtatatgaggaagaatattcattatagtattttatttttaagagatggaacaagcaaactttcatcaataggggtcatattagaaactctggatgcatttaacgggtcaaataccatgcagctattaaaaagaataaggcagatttgtgtgtactgatacagaatgctccctggtgtatatagttagatgggaaaaaagcagaacagtgtgtatagcttgattccatatatgaaaaatggcaggttagagtgaaatgattatattcatgtataggattatatatgcatagaatatctctatgaacatacaccagaaactccttgcctctagagcacacagagagtaaggggcagaactgaaaggttcattcacattttgccatacggcctcttgtattgcttgaattttaccatgaacacaaattactatactttttttttttttttttgagacagagtctctgtctgttgcccaggctggagtgcagtggcaccgtgttggctcactgcaacctccatctctcaggttcaagcaattctcctgcctcagcttcccgagtagctgggattacaggtgcccaccaccatgcccggctaatttttacatttttagtagagacggggtttcaccatgttggccaggctggtctcgaactcctgacctcaggtgatccacctgccttggcctcccaaagttctgggattacaggcgtgagccaccacacctggcctactgtacctttttaaaagaataatatttaaatgaacaaagaaaacttggataagaaaccaaatattccccccaaaaaaaatactgcataacttaatctgtaaatttaaagtgttccctcaaaaatcccagataattttttaaaaattatacaggctgacgctatagaaatagaaaactaaacagtcaacaatagtcagaaaatgtttgaaaaagcatataatgaagggaagactggctaaaccagatataaaaacgttataaaacaacattaactaaaactgtgtgaagctagagagtgaatacacagatcaatagaatctaatagaaagtccagaaatagacacaaattctttgtaagttaagtatatgaaaaaagtataattttatatcagttggaaaaacactagatccttcaataagtggtaatggcacaactggaagccatctggaaaaaatatttttcttcataccttaatcctggaaccaatacaagctccaaatatatcaaaaatttaaatatttttaaatgaaaacataaaaacgttagaagaaaacatgaaagaaccttttttttttttttttttttttttttttttgagacggagtcttgctctgttgcccaggctggagtgcagtggtgcgatcttggctcactgcagcctccacctcccgggttcaagcaattctcctgtctcagcctcctgagtagccgggactataggcacctgccaccatgcctggctaatttttgtatttttttttagtagagacagggtttcaccttgttggtcaggctggtctcaaactcctgacctcaggtgatccacctgccttggcctcccaaagtgctgggattacaggcgtgagtcactgcgcctggctggaaccatttttataacctagaacaaagcttcttccaagcacatcacaaaacccggagatcataaaaggttaatgaagtaaactaaaaacatttctttttttgagatggagtctcactctattgcccaggctagagtgcagtggcacaaacttggctcactgcaacctctgcctccaagtttcaagtgattctcctgcttcagcctcccaagtagcttggattacaggcacccaccaccagcctggctaatttttatagttttagtagagatgggctttcaccatgttggccaggctggtctcgaactcccgaactcaactgatctgcctgccttggcctcccaaagtgctggtattataggcatgagccaccacggctggcccaaaacattttttaagtagtggaaaatactaagactttttttttttttgagaggagtctcgctaaacaaagggctaatttttttttgatatataaagagcttcttatggtcagtttttaaaagaccaacaaaccaatagatcaaaacacatggacaggtctcagaaaaggaaaatgagatggcttttagatattataaatgatgttcaacttcatttacaatcatagaaatacaaattagtttcacagagctacaatttttgatctgttagacttttgacaactatattgtcagaggtgtagggaaacacctttctacactggagagcgctttcttctgactcagcagttcagtcagaaatttatatacacagatatactcacatttaggcacattctatttattggacattgtaacacaagagtggaataaattaaatatccatgaataggggaccagttaaataaatatgagattttgatattaaacatttccaagacaaattgtttcattaaaaaagaaaatgcagcagggtactcatgattggtcccatttgtgctatctttctaaagatgtgtacttacgtctcttgaagggtatataagaatattaatagtggttgcctctggggtggagagttaagagattgcggaaaacgaagagagggacctttcactgtattccctttggtgcctttggaatgtggtaccatgtttttgtgctatctattcaaaaagtaattattttatagttgaaataaaaaaaaataagccaaccaaccaacaaacacccaagcttaggaacatttaaacgatgctgtatctgaaagcacattgtggggtcttggtagatcgttctcctcctggtgaccaagagagctacagtccacctgttattttaggtgagaaaactgaggctcagaaaatatacttcacatgtccaaatgctagtggcaacacaggacttttgacttccctcctggtacttttttctgtctctgctaaaagagaagagacataggcagccctgaaaacgtcactctggtgtatgtactcctccagtgtactgaaacatttacttttcaccagattgtgtctctgagacagtttagagctggacttttcaatgaatacttgccatctagtggtaaaaaaagatgtgtgcacctaacatagactgcattcattcattcattcatgcatcaaacaccatacagtcatgcactgcataacatttcagtcaacgacagactgcatccatgacagtggtcccttaagattataatggagctaaaaattcccattgcctagtattcactatactgtaatttctatcattattttagagggtactcctacttattttttttaagttagctataaaacagcctcaggcaagtccttcacaggtattccaaaggaaggcattgttatcctagaagctgaaagtgatgagttactgcccccgaggaccttccagtgggacaaggtgtggaagtagaagtcaatgatgttgatgatcctgaccctgtaaaggcttaagcacattttttaaaatgtgtgtgtttacatcttagcttttaacaaaaaagtttaaaaagttaaaaaaagaattaaaaaggcctgtagaataaggatataaagaatgaaaacattcttgtacaacatgcactgtgttgttgttttaagctaagtattattacagtcgttaaaaaggtaaaaaaaagtgtataaagtaaaaagttagaataagctaaggttaatttattattgaagaaaagtgtttttataaatttagtgtagcctaagtgtacagtgtttattaagtctacagtagtgtgcagtaatgtcctaggccttcacattcactcaccactcactgactgacacagagtaacttccagtcctgcaagctccatacaggtgtaccatttgttatcttttataccttattttaatggtaccttgatatgtttaaatatacaaatacttaccattgcattacaattgcctatggtattcagtacagccacatgctgtacaggtttatagcctaaaaacaataggctataccatatagcctaggtgtgtagtaggctagaccctccaagtttgtgtaagtaccctctatgatgtttgcacaatgaagaaattgcctaatgacacatttctcagagcatatccccgttgttaagtgaggcatgactgggaaatcacttgtccttaaggcactcctagtctcttgggaaagactgacagaaaaacaggtgattacaccagtatgatgaagagacaactgcactcccatgtttattgcggcattattcacaatagccaagatatggaatcaacataagtgtccatcaacaaatcaatgaataaagaaaaattggtgtatatacacaatagaatactatctagccataaaaaagaatgaaatgccatcatttgaggcaatgtagatgagcttggttgacattttgttaagtgataataagccaggcatggaaagataaatatcacatgctctcactcatatgtgggagctgaaaaagttgatctcataatagtggagtgtggaatagtggttactggagactgggagtcaggggatggtgagaggttagttaacggatgcaagattgcaactagatagaaggaataagttccaatgtcactggagcatgactgtaattaacaacaatctacagtatgttttcaaatatagctagaagagcagattttgaatgttctcaacgcaaagaaacaataaatgaggtgatatgcatgcaaattaccctttgattattttacattgtgtacatgtatcaaaatatcacactataccctgtaaatatgtacaaaactatgtgtcaactaaaaataataataaaagataaaagaatagaaaaatggggaacaaaaagacccatggtgagcgtgaaactaaaaaaatagaatagaaaatgtctcattaatgttttcgttatattgattacctgctgaaatggtaatcatttgtgaaaaagaaaaataggtgattccactacagtgcaactaaggctaggaaagtcaagtacaggacacagggagcacagtgtagggcttaaccttgccttgggaaattgcaggtatcaggagcaacactgaactcacttttctggattctcagtagatgctaaaattacctcctttcttgtcttcctcttgctggaccccatcaggaccaggatagcagtttttgttgttacgttctctgtgtctgaggatggactcattaactgatcatgttaggaaggcagccagtgtatgccctttggctacatggagtagctgttccaagagctgaatccgtgccaccgttgcatctggtctgcagatctgttttccaaagagccatatgcgaatgcattgttcatttcccacctctggtcagaacatctgtggaatgtccctcctgcccatgtagtttttcagctctgttatcctgaagctctttcaaaggttagcctttcattctccaagcaaacaagttcttgtagcccatagaagatgtcctccatagaaaccaaagcagtccacccagcttgcctagaatgaaaggtgcctaaagtggtagggggtggacctgcaaagaaaggtggagtcctttcataaatgaacttaaataccaggctggagagatgcagagattacaagtagacctaaagtaattaggaagccattgagggtttctgagcaaggaagcgaccagagaccaacgtatttgttcattcaacaaataattgtcaacatctactgtgtgcaaagctctgagtgagaccctgtgctacagaccccagcacagagatgaataagacccagggtgggagacatgtcatcctcctgggttataatgccttctacctccatgcaacagcttaaattttttgtctcagagaaggaaagaaatgtcagagcataagaaattagtgacagaaattataaactataaatcacagttctaattgttctataatcatgtaaacatagcaatttttctttaacatagaaatatacaaatcaaagataaaacaggagccccatctcatggagagatagtctgctgcctcttcagattctacctcaacattataacatgtccttttgacactgtggagccaataaggtttccatccctagaagacctttctctcccaatctgtatccatcagaattccactcaaccttccataccctccttgccagaatacctttccaactccttccaaatgcatgtcatttctgcctccttggatcttccagaccatattgtaaccccatttggcccagttcctgccttgtattatgggtgtctgctcctaaaaacaaaagtaggagtcagtctgagctggggtgtagtctggaatcacccctccatctccctagtcatgcttttcatatgtctcatagtacattgagaagtgtctgttgaattgagttgaatgctttagacctcggttcactgacagagggactcctttagcaaagttagccattttacctcctttgtctccatagctacttccagttctccaaactacaacctatttcccaacagactccagttacagtacttcttaatttatcttctattcaaaggcaaaactactgcttcattaatcaatgagtaaggaaaatcaaaagcttattaactagcaagccaatgctcttctaaagggcattgatccatgtatgttatgggcagcctgttcattgatagctacagctcttggagagcagctctctggagtagcattggggaaactgaaatcttattttgaaatagcttttaaatgcatggaaacacatctgattcttactgggaatttcttgatagggaatacagaagggaagactatttgcttgtcagtaatatgatatagagacaaatcatttcataggatttcataagtgcatatatgtaaccaagaaacacaggtactttcatattatcttgagaaaaatgaattcattctttaaaatgcaatgacttccctgcataatgcattcaagaatcaatgcaaatataaaggatgtgtttattggcttgtgatctgtattcatgactgcaagcatggttggatcttttgagatgggggtttcctctgtttcagtggccaagggatattctttctcaaatggacatggtgatcatttgaaacttatcccatgcatagtgaccccaaattcgagtaaatatatatcaagtacatataatacacaaagaagtgagtctgaagtcaacctccaagcactccaaattagggccctaagacaactgcagaatttgttgcagggcagatgtatggcctggtttagaactttattattttgacctccattcgcatgttagttttacttcttcttctatcttcaatcttttacaacatacatcctttacttattagattctaatatattagcatttaacatacttttactatttcttggacaatggaaaaaccttagaacactgtaattccctttagcccatgtattagtctgctctcacattgctataaagaactacctgagacttggtaacttataaagaaaataggtttaattggctcatggttccacaggctgtaaaggaaacatggctgtggagacctcaggaagcttgcaatcatggcagaaggtgaaggggaagccagcatgtcctataaggctggagcaggaggaagagagcagggagggccacacacttttaaacaaccaaatctctgagcactcactcactatcacaaggacagcaagaggaaagtccacccaatgattcaatcacctcccaccagaccccttctccaacactgaggattacaattcaacatgagattcatgtggggacacagagccaaaccatatcattctgcccctggccccttcgaaatctcatgtccttctcacatttcaaaacacagtcatgccttcccaacagtctcccaaagtcttaactcattccagattaattcaaatgcccaaatcccaagtctcatctgagacaaggcaagtccattctgcctatgagtgtgtaaaataaaaaaacaagttagctacttccaagatacaatgagggtaaaggcattgggtaaatgcttctgttccaaaagggataaattggcaaaaaataaaggggttacaggcgctatgcaagtttgaaacccaacagggcagtcattaaatctcaaagctccaaaataatctccttagactccatgtctcacatccaggccatactgatgcaaatgatgggctctcaaggccttgggcagctccacttctgtggctatgcagggtatagcccctgcagctgttttcacagactggcatcaagtgcctgcagcttttccaggcacatggtgcaagctgttggtagatctaccattctggggtctggagaatggtgaccctcttctcacagctccactaggcagtgccccagtaaggatactgtgtgggggctccaaccccacatttcccctctgcactgtcatagtagaggttctccatgagggctccatccctgcagcagacttctgccatgacatacaggtgtttccatacatcctctggaatatatgtcagcctcaacttttgccacctgcacactcacaggcttaacactgtgtggaagccttggtggcttccagcttgcaccctctggagctgtgacctgagacatatcttggccccgcttagccatggctggagctagagaggctaggatgcagggcatcatgtcccagggctgcacaaggcagtgggaccctgtgcctggcccacaaaaccatttttccctcttgggactctgggcctgtgatgggacaggctgctgtgaaggtttctgaaatgccttacaggcatttttcccattgtcttggctactaacatttggcttctctttacttaggcaaatttctgcagcaggcttgaattcttccccagaaaatgggtttttcttttctaccacatggccaggctgcaagttttccaaacttttatgctgtacttcccttttaagtataagttttagtgtcaggtcatttctttgtttatgcaggttagtgtaggcttttagaagcagccaggccacatcttggatgctttgctacttagaaatttctaaatttctaagataaaatttctaaattttagataccctaaatcatcactcttaagttcaaagttccacagatctctagagcagggacacaatgccgccagtctctttgctaaggcatagcaagagtgccctttactccagttcccagtaagttcctcatctccatctgagaccttagcctgggcttcactgtccatatcacttcagcttttggtcacaacaatttgacaagtctctggaaagttccaaactttccctcatcttcctatcttcttctaagccctccaaattgttccaacctctgcccattacccagttccaaagtcacttacacattttcaagtatctttgtcgcaatgccccactccaggtaccaattttctgtattagtccattctcacattgctataaagaactgtctgagactgggtaatttacaaagaaaagaggtttcattggctcacagttccacaggctatacaggaagcatggctgggaaggcctcaggaaatatacaatcatggcggcaggtgaaggggaaactgacatgtcctacatggctggagcaggaggaaggcaggggaggtgccacacacatctatttttttatttatttttattttattattattatactttaagttttagggtacatgtgcacaatgtgcagtttagttacatatgtatacatgtgccatgctggtgcgctgcacccactaactcgtcctctagcattaggtatatctcctaaagctatccctccccactccccctaccccacaacagtccccagagtgtgatgttccccttcctgtgtccatgtgttctcattgttcaattcccacctatgagtgagaatatgtggtgtttggttttttgttcttgcgatagtttactgagaataatgatttccaatttcatccatgtccctcaaaggacatgaactcatcattttttatggctgcatagtattccatggtgtatatgtgccacattttcttaatccagtctatcattgttggacatttgggttggttccaagtctttgctattgtgaatagtgccgcaataaacatacatgtgcatgtgtctttatagcagcatgatttatagtcctttgggtatatacccagtaatgggatggctaggccaaatggtatttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatagtatctcattgtggttttgatttgcatttctctgatggccgtgatggtgagcatttttttcatgtgttttttggctgcataaatgtcttcttttgagaagtgtctgttcatgtccttcgcccacttgttgatggggttgtttgtttttttcttgtaactttgtttgagttcattgtagattctggatattagccctttgtcagatgagtaggttgcaaaaattttctcccattctgtaggttgcctgttcactctgatggtagtttcttttgctctgcagaagctcttgagtttaattagatcccatttgtcaattttggcttttgttgccattgcttttggtgttttagacatgaagtccttgcccatgcctatctcctgaatggtattgcctaggttttcttctagggtttttatggttttaggtctaacatgtaagtctttaatccatcttgaagtaatttttgtctaaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagggctctgttctgttccactgatgccacacacttttaaacaaccaaatctctgagcactcactcactattacaagaacagcaaggggaagtctgcccccatgattcaatcacctctgaccagaccccttctccaacattgaagattacaattcaacatgagatttggtcgaggacggagagccaaactatatcaatccactaccatcttaagtattattgttaccaaataattaaatttcatatatattttaaccctacaacacattattagtattgctttgcccagtcaaaattcatttggctttacccatatatttattctttctgttgttcttcctttttttatgtccattttccttctgggatgatttccttctacctgaaaaactccttcagcattttttagaatttgcaggcaaagaattctcagttcttatttatctgaaaatgtctttattttgtctttatttttgaagagtatttttaaataagttgccacttattttcattcagtatttttaaggcatcacttgtctgtctgtggctttcatgatttctgttgagaagtcatctgtcagtcttatggttgcttgttagaaaataacatgtctttttacatagctgcttttaagattttgtctttatctctgattgtcagtagttttactacataggtaggcatgactttatttatatttattgtttttgagatttctagcacttcatgcatccatgtcttggtatcttttgtcagttttggaaaattctggcccttatttcttcaaacattggttctatcccaatattctttctcctttccttctggaactttaattatatatatgttcaactttatcatcattttccatatgcttcttatgctttttttgtatattatttatcattttccctccatactttagcgtggatatttcctagtcctctcctctgctagtctgaaatgctattaaacttgttcttaattctagttatatttattaatattagttctagaattttcatttgattcttttttttagaaattccagtttgttgctaaaattctccatctagatttctatttccttgaacatattaattatagtttttaagtccaagtctggtaactataatatctagatcatttgtaggtctatttctattatttgtttttcccttgcttcagtttcttggtatgtctcatcattttctattgaatgccagacatgtgtatgataaattataggggctctggatgacattatcttccttcacaaagatttgcttcttctagcaggcagttggagtatggaaaatcacctaatcaggccttgggttgggttgtttttaagctggattctgtctttgtgagggctcttttacttatggttcactcttattccatgggtgtagctcttcagggttcctcacttaaagcctgtagtgcttaccagtgtgtctcttccttatggtttccaatttccaattttaatcttccccaaatctgaggctgctaaaagctctgtttaatctcttagccactaatttctacccagagttgcaaacttccttcaccatgactcttacaaattagcaactgcctcagaagaaacagcagtgccaaacatcaggctcacttctctgtccctttctcttcagggacttgatcttagctcaagtcattttctctccccagtcttatgagactgatgaaagctgtactcagcttctcagcctcttagccttgtgtggctgatgaaaaagccagagcctgaagggaaaaaagcagtttggaatatctgactcacctccatgcatttcccttctctccaggatcttggccttcaagtcctggctgcattgagacctttccaatactttaaaccaagttactttgttttgttttattcattttttgtagttgttcttgggagattgttggcctcatataagctcgcttatcagtgttgcaggtgaaactagtatctcttctttaagtacttgggttctgtctctcctacatgcaagtctttctcttgcatctttctgatttgtgtctctaacccaatctcacttgctggtatcagttctaatatgctaggtgtggagaactgtacgtctgtctgcaattgttcaaatctttcctcttaagtaatatctcttactttgtttctattcttaatttatattgggaaatataatattacatcaagtgtgacttccttcaatgtgagtgccttggtaaaactctgcaactcttaggactgaagaaaaaaacctctatggatttaacataattaattacttatagtaattagtaagactctaattgattattacctctaagatgtcatgaattgatgccacttttttctgttttttgagttattagatgtgaaacagtcattattaaaaatttttttgatgcctttggaaagaaattacgggaaaggtgctcaacatcatgatcatcagagaaatgcaaatcaaaactgcaatgagctattatctcaccccagttaaaatggcttatatctaaaagacaggcaataaaaaatactgttgaggatgtggagaaaagggaaccctcatacactgttggtgggaatgcaaattagtacaagaactatggagaataatagtttggaggttccttaaaaaactgaaaatagggatactatatgattcagcaatcccactgctgggtatagatccaaaagaaaggaaatcagtatatcaaagagatatctgcactcccatatttgttgcagcactgttcacaatagccgcaatttggaaatgaccaaagtgtccatcaacagatgaatggataaagaaaatgtgatatatatacacaatggagtactattcagccataagaagaatgagatccagtcatctgcgacaacatggatggaactggatatcattatgttaagtgaaataagtcaggcacagaaagacaaacatcacatgttctcacttatttatgagatctaaaaatcaaaacaattgaactcctggacttagagattagaaggataatttccagaggctgggaagggtagtggggggtgggaggtgggggggatggggatggttaaccggtacaaaaacatagtgagaacgaatgagtacaacctatttgatagcataataggtgaatatagtcaataataacttaattgtacatttttaaataacttaaagagtataattggattgtttgtaactcaaaggataaatgcttgagggaatggatactccaatccccataatgtgcttattacacattgcatggatgacccaaatcatctcatgtacctcataaatatatacacccacaaaatttttttaaattttttttaaaaagaaaagaactatagatactccttgacttacagtgaggttacatcctgataaactcaggatgttttatcagttacaactgaaaaaagttgaaaatatcactaagtcaaaaatacacttaatatacctaagctactgaacattatagctcagcctaacctaccatatatgtgctcagaacacttacattatttttatatatatatttatatatatatatttatatatatatatttatatatatatttatatatatatttatatatatatatttatatatatatttatatatatatatttacatatatatatttatatatatatttacatatatatatttatatatatatttatatatatatttatatatatatttatatatatatttacatatatatatttatatatatttatatatatttatatatatatttatatatatttacatatatttatatatttatatatatatttacatatatttatatatatatttatatatttatatatatttatatatatttatatatttatatatatttaatttatatatatttatatatatttatatatttatatatatttttatatatatttatatatttttatatatatttttatatatattttatatatatttatatatttatatatttatatatatttatatatttttatatttttatatatttatatatatttatatatttatatatatatttatatatttatatatttatatatatatttatatatttatatatatttatatatatttttatatatttatatatatttttatatatttatatatttatatatctatatatatttatatatatctatatatttatatatatttatatatatctataatttttatatatttatatatatctatatattttatatatatctatatatctatatattttatatatatctatatatctatatattttatatatatctatatatctatatatttatatatctatatatatttatatatttatatatatctatatatatttatatatttatatatctatatatttatatatttatatatctgtatatctatatatatttatatatttatatatatatttttttatatctatatatttatatatatataagatggagtcttgctctgtcactcaggctggagtgcagtggtgcaatcttggctcactgcaaactccacctcccaggttcaagtgattctcttgccttagcctcccaagtagctgggactacaggtgcacaccatcacacccagataatttttatatttttagtagagacgggctttccgcgtgttgtccaggctggtctcaaactcctgacctcaggtgatccacccacctcggcctcccagtgtgccgggattacaggcatgagccactgcatccagctagagcacttacattaacccaaagttgggcaaaattatcaaacacaaagcctattttgaaataactgttgaatatctcatatagtttattgaatactatattgaaagtaaaaaatagagtggttgtatgtgtactcgaagtacagtttccactgaatgggtattgcttttataccatcataaagtcaaaaattataagttgaaccatcataagatggggactatctgtatattaaaataatgaaggttttccacaccaggtgtggtggctcatgcctgtaatcccagcactttgggaggccaaggtggggcagatcacttgaggtcaggagttcgagaccagcctggctaacatggcaaaaccccatctctactaaaaatatacaaaaaaaatggctgggcatggtggcaagcgcctgtaatcccagctactcgggaggctgaggcatgagaatcacttgaacccgggaggcagaggttgcagcgagctgagatagtgccactgcacactagcctggtcagaaaagcaagactctgtctcaaaaaaaaaaaaaaaagacaaaataatgaaggttttcttaaaatataaaatgaaatatgaacactaacccatgtatattacacatatatgtagagagaggggggaaacactaaccaatgtatatataggaatgtctagtttggtagatgccctccattccaattcaaatgagagcagaagttgattactataacctaaagaagaatgtgttaaagcagggaatttaaaaattaatacatggatatgtcaaatagtttaacttaaatcagataagtgtaccttcaatcagaaatataaatcatgccaataatttatcacccctgatttccagtttaggcttcttgaaaatgaatctgtacttaaagatacttgcagaaccatctgagtatagaactcctgagttttacaacttttcccaatcttttacagatatcttgctctcacctaattatacattattttcagcaacttgcctctgttgagtcctttcagagcagtcataaaaaatgccttccttttctcactcatatctcatcaatttcaaaagattttaccaaattatgtaagcacaatgtcagaataactggtataaggaggtttgagaacaaacacaacttactcttggtaaacatgcaagtttactgcagaagcagaagcgtgctgccacagcggagagtgggcacccagctgaatcatccggatgccctagctctgtcagtgtttataatactacagagggaatggcaagcatcggctggtcctgcaaagaggttaagtgttggctagtcaagagagcttctgcaatacagttattttgagtatagttattttgcttaatcttgggttgaatctacatctttttgaagtcaccttccttgtcaccactcatcttatcctcacattcactggcatgatttcagaatgattggagatagcttcttccaatctaaatatcacagattgcctaagtttaataataacagtgcactttttgtgtgttaacaaataccagacttctaaacactttacatgaatgtcattgaatctttagaaccctaagaagtagggctattattatccacattttgtacttgaggaaatggaggctcaaaggaatgaaatggcttgcacataggctcatagaaagtaatgataagtgcaaaattcaagtccaggtcatgagcatctacaacttacatgtgtaccacacactaagtgcatcccttgtcatagaacttgggggctggtggtgggctcccgcctgtcaggctggggccagctccccaccctgccattctccttttatttctccagtcagcctccctaaactcagcccactttgccttctttcaggaagtgattacttcttatagccccccagattctccccccatacctggcaaagggctgggttcaggcatcctccattccctctttcactgactctgaggatatttgtttgagctccttgtgatttcagaattttactgtcatcactatggagacatggggtgagagaaatacacatgcagaaaaatgacaaaggcttcagaaacttactacattcttggattctggttcctgagctaccattcttcatgcccgtgctgtggtgggaaccaaatgctcccatggactgctgtcctccatattgattcctgagagaaaggctctccaattccctcccccgctttagcaacagccctggttacccccacacccataaaggctactttgcccagcacagttgtccccttgtttatagtggagacttgtgctctaaagcccttcaaactgggaagcattcaattctggcccccacatacagcagcagtaatgacccctctgggcattacctgatggtcactatttagaactaagtatcatgacttctggaaaaactgttaaaatgccaagtatttttgcctggcacaaatcaggttgagtggccaaggcaaaagagccacagcttcagccaccgttaaccgttaaaggtgaaaagaaattcgtttatccacatagcctatatccaagatggttttactggctgtgctgaaatggcagaaactcacgggaagtccatggataaatttaaatttccactatccagtgcatctaacatgtatcccagtatcaatcctcccactccttttaatatcaggataccagttgtcagctggatacatggccacccagaataatacatttcccagcttctcttgagatagccatagttatgaaactaagttctgaccaataaggtgtaagaaaaataatgtgtgcaatttcctgaaagagtacttaaccagagggagcatgcccctctttgtcttctggactgtccacctacaaacttttttacataagacaaaaataaacccgttctaagctacgatatttgaggtttctcagttatatgcagtcaaacctaatcctaactgggttaaccacccaagaagttcatcttgcccactgcctagatagccgattcatcacgacaggggcattgcaatagagaaagagtaatttatgcagagttggccatgcaggagaccggagttttattatcacttaaatcagcctcccctagcagtcagggagcagagattttaaggataacttggtgggtggggggaagctagtgagccaggagtgctgattggtcagagatgaaatcacaggaagtcagagctgtcttcttgtgctgagtcagttcctgggtgggggccacaagatcaatgagccagtttattgatctgggtggggccagctggtccatcaagtgcatggtctgcaaaatatctcaagcactgatcttaagagcagtttagggagggtcagaaacttgtagcctccagctgcatgactcctaaaccataatttctaatcttgtggctaatgttagtcctacaaaggcaatctagtccccaggcaagaaggagacctgctttgacaaagggctgttaccatcttcctttaaactataaactaagtttctcccaaagttagttcagcctacacccaggaatgaacaaggacagcttggaggttagaagcaagatggagttagttaagttagatctgtttcactgtctcaatatgattttgcaaaggtgatttcaatccctccttttgggtttttataacaccttgatcttaaggtgtaggctatgaggatgggaaaaggccgtcgatcactctggcttctttctgctgacaggagatgtagtgggaatgggagtgacccccaaggtgagaagagtagaaccactttgcaattgtctgagtgtactcatgcaggcctggctgggttttcaaggcttgcatggcaaaaaacattagtactctcatctatagttttactacagtgtttaaagtgaccagcctactataaggtaaataacgagtccgaggatgaggagtacaattcccaattttaaaagcaaagatctgaaagcattagtttggggacttctaacccacaaagaatttagaatttagtctaaactgcagaaaaaacctcaagaacagctaacaacagtgtactatagcttttcttttgaagcataatttttctgtctccagtccccatttttattcaaaacaaatcatgatagaactgacttgtttacaaaataaactttactcttactgtacttggcctgattattggcaaaaagtgcagcaagaataattatttttcacttaggctttttaaactggctttgatagaactctgctctatgaagactctcagataagactttttaaaaggtgagcccaggcatgggtttgtatcctcaaatacctatgagttgggcaaattcctcttctcttaaggtcccaagataacttggggttcctgggcctgttagaaagtggcattctttaactttccacaggtcaggaacctggtacagggactctgtgtacacaaggtatgaggccagattccccaatggactttaattggctctataagtcaactttgattctttaaaagaagcatgccattccagtcaaagccttggtaaaataaccagtttatccaattgtgtcctgttacaaaaggaaagagattcttactgtgcttatacaattaactatactataatgccataaattgagaatattcacaaatagtttccgaattctggagaaatcaggtagaaaagaacaaatatgatccaaattttgttcacaagagtatattttactcacttgttaaaagttgcaaatagctctaaagaaattagtcctcttgtctctgaaaacaaaaggtttagcaatgtttaacacattagctctccatgagagtcctagaagtttggctttttcatgtactccaatagcacaatttttaaagttatctgagtcctgcacttaagagtcctatatctgatcataaactgccttttgaaaaggaccaaaacaagacaaaatgtctgtggatgacaaaagtctatagccactattaaagctacaattgactaggaatttgggttacttctgtggcataaaacaattttatataacaattacaattaataatgtacactaaattatactaacattatagaagtttcccataattttggaacacatactcataacatttatacaaacacagtccaaagtaaaccaaacagcatttactcttctatttgaaactttttcttctaatctcacaatctccagcattattcatcagaatcctgcatttaagagcaccttaaatagctcattataaaaccatcttttaaagaggaccgaaacaagacaaatgtctgtagatgacaaaaatattttagggcagccacagttaaagacacaattgacaaggaaatttttacctccatggcacacagtctgttaccaaaataattataatactgataacatatattaagtcatattacaattataggagttttacataattttggaacatataccaataacacatttacataaatatagaccaaagaaagccaaacaccatttcatatttgatgatgcttcctgtataatttttgtaccaaataagccaaatgtcattactggactttagaggacctaacatctaaaatattaggctagaaagagacataatttataatttttttttggaaagttgtcagatatcaaaggtttaaaacactggatatcacaaaatagaatcacaggtcatcataagtcattcatttggccaaaatgataactccaaaatcttaaaagaaaaatctttactcagataggaaacttagccaataaagatagcatgaggccagctgaatttgtctcttctctctcctcccctttttttccctgccatttacccaaaggagaaaacaaaaccattttcattatcttttaacattacttaaaaatcgtcttcaaaaaaggaaaccaaatttcatgtttgcattacagcatctttaatgttaaagctagttatttaaataaaattttatatttctatccagttttaattaatttggccataaggtaagattttcattaactttttagaacactttacaattttccatcaaatagcagattaattttctaagaaaaccctgttacttggacacatgggcccagattctggtcccacatcagtatgattttaatgtgttaacctgtggaaaaaacctaaataatttctcttaaatcttagccaccttgtttatacccacagaattttttcataaaattaaccaaacccttttcactttgcttaagacttcagttttgtcccattactcttttaggttaagacaatctataaaatcctctgaactggacaaaattacattctctttaacaaaatccatattcctatgccttcttataatcttttaccaaaaacaccttccctatacaccttgtacgtaaaactgtttctccagtggtctcaactacatattatactgttaactcttactccttttagcatagctagtaggcatggctctccatatgttcccaggccttatttataacctaatgctccaaagtaggtaaattgaacaattttcaaaagtcaaacagtttgaccttaaagcatttagcaaatctgatatctgaccttaatttagaccaaatgtctacattttcaagacattttattttaccaataatccttaaaactgtctttatttccaaaagattactaaagtcacgtgaacaaaaaggcattaaagcttcttttttctgacaaaatgtttgatttaagtgctttttctaagccaattaatcagagctcttttatagataaacatacaacacatacaaaaatgcagacagaagattcaatgcttgtaaaatttttctttttttttcttttatttttattatactttaagttttagggtacatgtgcacaacgtgcaggtttgttacctatgtatacatgagccatgttggtgtgctgcacccattaactcgtcatttagcattaggtatatctcctaatgctatccctcccccgcccccaccccacaacaggccccggtgtgtgatgttccccttcctgtgtccatgtgttctcattgttcaattcccacctatgagtgagaacatgtggtgtttggttttttgtccttgcaatagtttgctgagaatgatggtttccagcttcatccacgtccctacgaaggacatgaactcatccttttttatggctgcatagtattccatggtgtatatatgccacattttcttaatccagtctatcattgttgaacatttgggttggttccaagtcattgctatcgttaacagtgccacaaaaaacatatgtgtgcatgtgtctttatagcagcatgatttataatcctttgggtatatacccagtaatgggatggctgggtcaaatggtatttctagttctagatccctgaggaatcaccacactgacttccacaacggttgaactagtttacattctcaccaatagtgtgaaagtgttcctatttctccacgtcctctccagcacctgttgtttcctgactttttaatgattgccattctaactggtgtgagatggtatctcattgtggttttgatttgcatttctctgatggccagtcatgataagcattttttcatgtgttttttgactgcataaatgtcttcttttgagaagtgtctgttcatatccttcacccactttttgatggggttttttttttcttgtaaatttgtttgagttcattgtagattctggatattagccctttgtcagatgagtaggttgcaaaaattttctcccattctgtaggttgcctgttcactctgatggtagtttcttttgctctgcagaagctcttgagtttaattagatcccatttgtcaattttggcttttgttgccattgcttttggtgttttagacatgaagtccttgcccatgcctatctcctgaatggtattgcctaggttttcttctagggtttttatggttttaggtctaacatgtaagtctttaatccatcttgaattaatttttgtctaaggtgtaaggagatccagtttcagctttctacatatggctagccacttttcccagcacaatttattaaacagggaatcctttccccattgcttgtttttgtcaggtttgtcaaagatcagatagttgtagatatgtggcattatttctgagggctctgttctgttccattggtctatatctctgttttggtaccagtaccatgctgttttggttactgtagtcttgtagtatagcttgaagtcaggtagtgtgatgcctccagctttgttcttttggcttaggattgacttggcaatgtgagctcttttttggttccgtatgaactttaaagtagttttttccaattctgtgaagaaagtcattggtagcttgatggggatggcattgaatctataaataacttgggcagtatggccattttcatgatatttattcttcctacccatgagcatggaatattcttccatttgtttgtatcctcttttattacattgagcagtggtttgtagttctccttgaagaggtccttcacatcccttgtaagttggattcctaggtattttcttctctttgaagcaattgtgaatgggagttcactcatgatttggctctctgtttgtctgttaatggtgtataagaatgcttgtgatttttgcacattgattttgtatcctgagactttgctgaagttgcttatcagcttcaggagattttgggctgagaaggtggggttttctagatatataatcatgtcatctgcaaacagggacaatttgacttcctcttttcctaattgaatgccttttatttccttctcctgcctgattgccctggccagagcttccaacactatgttgaataggagtggtgagatagggcatccctgtcttgtgccagttttcaaagggaatgcttccagtttttgtccattcagtatgatattggctgtgggtttgtcatagatagcgcttattattgtgaggtacgtcccatcaatacctaatttattgagagtttttagcatgaagttgttgaattttgtcaaaggccttttctgcatctattgagataatcatgtggcttttgtctttggttctgtttatatgccagattacgtttattgattttcgtatgttgaatcagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgccagactttggtgtcaggatgacgctggcctcataaaatgagttagggaggattccctctttttctattgattggaatagtttcagaaggaatggtaccagctcctccttgtacctctggtagaattcagctgtgaatctatctggtcctggactttttttggttggtaagctattaattattgcctcaatttcagagcctgttattggtctattcagggattcaacttcttcctggtttagtcttgggagagtgtatgtgtccaggaatttatccatttcttctagattttctagtttatttgcgtagaggtgtttatagtattctctgatggtagtttgtatttctgtgggattggtactgatatcccctttgtcattttttattgcatctatttgattgttctctcttttctttattagtcttgctagcagtctatcgattttgttgatcttttcaaaaaaccacctcctggattcatggattttttgaagggttttttatgtctctatttccttcagttctgctctgattttagttatttcttgccttctgctagcttttgaatgtgtttgctcttgcttctctagttcttttaattgtgatgttagagtgtcaattttagatctttcctgctttctcctgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagtttcttaatcctgagttctagttggattgcactgtggtctgagagacagtttgttataatttctgttcttttacatttgctgaggagtgttttacttccaactatgtggtcaattttggaataagtgtggtgtggtgctgaaaagaatgtatatcctgttgatttggggtggagagttctgtagatgtctattaggtccacttggtgcagagctgagttcaattcctggatatccttgttaactttctgtctcgttgatctgtctaatgttgacagtggagtgttaaagtctcccattattattgtgtgggagtctaagtctctttgtaggtcactaaggacttgctttatgaatctgagtgctcctgtattgggtgcatatatatttaggagagttagctcttcttgttgaattgatccctttactattatgtaatggctttctttgtctcttttgatctttgttggtttaaagtctgttttatccgatactagggttgcaacccctgcctttttttgttttccatttgcttggtagatcttcctccatccctttattttgagcctatgtgtgtctctgcatgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcatttgttgatgcagtttcttcctagcctcgatggtctttacaatttggcatatttttgcagtggctggtaccagttgttcctttccatgtttagtgcttccttcaggagctcttttagggcaggcctggtggtgacaaaatctctcagcatttgcttgtctgtaaagtattttatttctccttcacttatgaagcttagtttggctggttatgaaattctgggttgaaaattcttttctttaagaatgttgaatattggcccccactctcttctggcttgtagagtttctgccaagagatcagctgttagtctgatgggcttccgtttgtgggtaacctgacctttctctctggctgcccttaacattttttccttcatttcaactttggtgaatctgacaattatgtgtcttggagttgctcttctcgaggagcatctttgtggcgttctctgtatttcctgaatttgaatgttggcctgcctcgctagattggggaagttctcctggataatatcctgcagagtgttttccaacttggttccattctccccgtcactttcaggtacaccaatcagatgtagatttggtcttttcacacagtcccatatttcttggagggtttgttcgtttctttttattcttttttctctaaacttctcttctcacttcatttcattcatttcgtcttccatcgctgataccctttcttccagttgattgcattggctactgaggcttgtgcattcgtcacgtagttctagtgccatggttttcagctccatcaggtcctttaaggacttctctccattggttattctagttagccattcatctaattttttttcaaggtttttaattgctttgccattggttcgaacttcctcctttagctcggagtagttggatcttctgaagccttcttctctcaactcgtcaacatcattctctgtccagctttgttccgttgctgatgaggagctgcgttcctttggaggagaaggggtgctctgatttttagagtttccggtttttctgctctgtttttcccccatctttgtggttttatctaccttttgtctttgatgatggtgacgtacagatgggtttttggtgcagatgtcctttctgttttagttttccttctaacagtcaggaccctcagctgcaggtctgttggagtttgctggaggtccactccagaccctgtttacctgggtgtcagcagtggtggctgcagaacagcggatattggtgaaccgcaaacgtttctgcctgatcgttcttctagaagttttgtctcagaggagcacctggccgtgtgaggtgtcagttcaccccgtaggggatgcctcccagttaggctactcgggtgtcagggacccacttgaggaggcagtctgcccagtgcttgtaaaatttttcaattgccagtttcttaattggattactggcttcagggtggagcccttggaggaacagggccaggaaagcatgcatttctagggccaaataagcagctgaaggcaaagacagttccccaaaattaagggtgccattttatactggatcctggatccccaaaaggagggaaagactatgggagaagatagtgcaatgcttctaccctgcatttcagcatttcattgcaaggcaacccaaagccaatcagcccattttgtaatcaccccatctctcatgagggagtctcatctcccatttggggatgaggatgtttccttgtcttccaggtggccacgagcctgcttctctgatccaagtgtgctaagagtcaagtatccctccctaactactgttagccatcccttaaagtgtatttcctacctagttataatgtgaagtaatttgatacccccaaaactcaaaaccttcagataacacaatgcaaaacagaacacagcctttgattttgagagggatttatctgcttttaattccttgggtttcatgaggaaaacagaggggttttttttttccccaaaatggggcctgtggcacctcctctgttttcccaatgagtccgaggctaccggaagttatcttagggcctctcctgtgtgcattaagtgtggcaagacaaaaaaaagaaaaaaaagaaaaaaaaggagaaaaataattcagtcaattgagaagaaaaaacctttttccagaaaaacaagttccaagaagagaaaaacataaaggccttttaaatatatctgtagcttgtttatccacttttaattaagctgatttttaatcatagtgctctctaaaaaagaaatcctttcaaatctcttattacctgactttatccatgccaagtggccaatatttctagcttctaaactttatgaaaggtaacctcctaggtgcttcaaaggcatggtaagcagtttctttttttataggagttagaagctctacaagatagttcagagaaaggaaaattaaagagaggaaatcagaagataaccatgggtggggggagggggagactcaataaatggcaaagttacacaaataacaaaccagaaaggaatcattccagaagccaacaattgaacctaggccaccactgtcagaagataaagccttagctactgagctgtacagcattgagcagtttctattgcttttcccagaaggagcctagagaagccagtttcaagctttcaaggctttaactgctcacaaaaaatttttaggactaactatgacaagaacccccaaattcctgtcctctggatggtggaaatcaaaagaaagtattcccacatggtcactaagttaagctgttaaggacacaaaacaagacagagaaatttcctacagtattggtttcagggacccatagcaaagtttgtaactgaccagcctgccaggctggcttgaaaagcagggttataggggtcctaaacccacatgctatcctgtgatacccctgtctccattacagaacacagaaagacaaattcttattacaaagtacaccagatttgctacagcctaagactagtctcacaaatccttttttctattaatcaaacccttgcagaggacaccagtagtttactgttttactcaaacagagaaagagagagcaagcagaaacttggctggtaagaatttcttaccctttttgctggcataccaggtttctaggttccctttctctgcagtttccagaagaaccgagtggcttctggcgaccctgctcacttgtgctatagctggggattcaagccactttacaagagaaaattaccctttactgtcttacagaaccataggcaaggttcttaatttgcaagatgctgcccaatgggctgcatgggaaactgaattaacattttccgttccagcaaaacacacataacaaaacagacattacttaccttgttcagcacccactatcagcctggcaaagctcaaactttttcccattggtccctgtcatctttgatctactctatgtggggacagatgacctctgaagggtaattcatattggggtctctgggaaaggcaaagagcagacaggcactccgagacaggcctgttaagccctctttagggttcattgaatgtgaccagacgaataaggagggttctctgagttaggcctgctggacttccatcagcaacccctctgagatcccttccacatatgcaaacacacacaaagatgagacagacagaaggccttccaaatcagatccctaaccaagagctccaagaatatcccttattccaaactatcctcctattctccgtctgagaaaccgcctcaaaatctttctgattgagaagtctccaaagccaggactcttcctactagttagaaagagccaactgagacccccaggagccgaacagacaccctgcaatgaggctacaggtatcccatggtagagctacaaagagacaccccacaatggagctacagacaccccatcatagggctacagacaccccaccatagggctacagaaccagtcgggagaaggaaggtggccttggcagcaatactcaccaatccagacacccctcaatggggctacagacagatatcctgtgatggggtacagttaagggacatctcaggactatttctccattgcaattaaatccatgcacattgggtcggcagtgccccaccagtagagagagtaccagagtcagtccccagcccaagagaactaggcgactgcttgggttggcttctggatccatccataaaaggggtgccaccgaaccacaggcatgtagccacaagggcaatcccagacaagcccttaaatttgtaaccacccgaggggttcgccttgcccgctgcctagacagagccgattattcaagacagggaaattgcaacagagaaagagaaattcatgcagatcctgctgcacaggagactggagttttattattactcaaatcagtctccctgagcatctggggagcagagttttttgttgttgtttgtttgtttgttttgagatggtgtctcgctctgtcacccaggctggagtgcagtggcgccatctcagctcactgcaagctccgcttcccaggttcacgccattctcctgcctcagcctcccgagtagctgggactacaggcgcccaccaccatacgcagctaattttttgtatttttagtagagacggggtttcaccttgttagccaggatggtctcgatctcctgacctcgtgatctgcttgccttggcctcccaaagtgctgggattacggtcatgaaccactgcaaccagcccagagtttttaaggatagcttggtgggtagagggaaaccagtgagccaggagtgctgattggtcagagatgaaatcacaggaagtcagagctgtcttcttgtgctgagtcagttcctgggtgggggccacaagatcaatgagccagtttattgatctgggtggggccagctggtccatcaagtgcagggtctgcaaaatatctcaagcactgatcttaagagcagtttagggagggtcagaaacttgtagcctccagctgtatgactcctaaaccataatttctaatcttgtggctaatgttagttctacaaaggcaatctagtccctggccgtccccataggtgaccaaccatgctagtccttctctagcaagaaggaggtctgctttgggaaagggctgttatcgtctttgtttaaactatagactataagctaagtttctcccaaagttagttcagcctacacccaggaatgaacaaggacagcctgaaggttagaagcaagatggagtcagttaagttagatctgtttcactgtctcagtcataattttgcaaaggcgatttccctgacacatgtaagaattccaaaagtatttcagagattgaaagacttgtttcttattcctgttcaaagtacttgtcacatgaaatacattaaatccaagattctctgattctctcactgttgtaaaacacacacacaaacacacacacacacacacacacacacacacgctttggtctccagtgactggggaggagtcgtttgctctcacagattattgtattctacacacaattcttcaattaaatgaatgtttagaagtcacaaacactttgggaggctgaggcgggtggatcacaaggtcaggagatcaagaccatcctggctaacatggtgaaaccccatctctactaaaaatacaaaaaattagccaggcatggtggcgggcgcctgtagtcccagctactcgggagactgaggcaggagaatggcgtgaacacaggaggcagagcttgcagtgagccgagattgcaccactgcactccagcctggggaacaaagcgagactccgtctcaaaaaaaaaaaaaaaaggaagtcacaaacaacacagaatcctgcacaaacttggtctcagttttcaaccaatccctaccctcactcgcgagatgagaaaacaaaagaaatcagcctgcctttttttattccttgggctaaattgttacatactctgcaaggaaatgagcatagatatttccaagactaaaccatcatacccaagcagtcagtaataaatatgatgaatgcctaaataaattatggctagagttggtaaagtaattcttcaccatcagatgattcctgtaaaaagcactaaagtgtcaatctacatgaagcccccggccctgtttcaagttatctgttaattacacatccctcatttatccagtgactctgctattatggtaagtgtcggattcattttatcccattgctcaatagattttaattgcagctgctgcagcagacaccttgagatacatttcctattgagaccgtggcagcctgctagactggcccaatgatgattaatttcaatgacttgaatcactgagaagaagggaagccacttccattttaattacatctacaagagtgcagcacttttataccagttcattgtccttaaacaaaagaatacctgaaaggaaaacaaaattcagggtatggtggtctctatttgtactgatctccttttttcagttcattgcaccacaactcagtcagctctgtattgggaaatattggcaagccattgggatttgcacacagattagaaaccatgaagaaagcgtcattcagcttgtttttgtttatcttacttgggcaattagaatccattgagcgggttaagatatgacacagcattttgccatcatcgcagatgttccacataaaagggtcaagaataattaactctgacatgcatatgtatttatttattgttccagggagacagagccaaagacattcttgggattttacagaacactccatactcattcatacccttggatgctggcacatgctagtcccttctcttccccatccatttggataaaattttccagcaaaggccagctcaattgtcatttcctctgtcctgccttgagataggggtggagtgagggtgggggttgaaagagcagaggccttggatgagacatatctgactgggactgccagtgctgtgtgaccttgagcaagttacttaggctctctgagccacagtttcctcatctaaatgaagaaaaattaacattctcctatgttattatcatgtggattaaatgagatactttctagaaagcacccagattgatgcctggtcataaaagggtgtgatgggtataagtctactttcctcttctgcacttctcgcagtagcacttaaaaaaaaaaatctcctttatgatgctaattgatcagcaagccagaaaacaggaatttaggctctgtcctttcctccttcccctccccgcgtaaaaagatgatgaaatgtatttgtctctacttcctatttcagattcattctcttctcttcgtcctcactgctaactaccttgattcacacctggtttcttcatccctcacctgaattaatgcagaagactctttacagatccccacacctcccatctgacccttctattgcatcttccatgaggcttgcacagtgatcttccctgcccctccccataggtgaccaaccatcccagtttgtccaggacagcaggggttcccaggatgtgagacttttcagttttaaaatcaggacattcccaggcaaaccaagatgagttagtcaccctgcatcccttagttaaaatctctcaacagtttctcaaagattccaagataaacttaaatttgtcagtgtaatacacaaaactgtttgtaatctagcccttcctctctaccttcatcttcatcatgcctccgtatttcctgcacaaacacacacaccctttgctttggcaatactgggctcctagaacttcctccgcagatatttcatgctctttcttgactccttctttgtctttgcccttgcagttccttccacttgcaatgcccattcccctactcctttcatcggctagctccttcagatcctgatgcatcatctccactaataagtcacccctgagagtctaacgtagaagctcctctactgtgacttctatcgcaccctgttttaaactctgacctgacatatcttatgcttcactgtgattatgatctgcctgccctaatagactgggcagttcctgaggacagggactatgccttctttaagtcagggagttgacgcatgtctgtgctcattattggctggacgaacaaataagttgtatatatttgccttctcacctccactactaagtgacctcctcaaaggcagaaaggacacatcttgattttctttgatctcttgattttctcccccagcacctggtccacagcagggcttaattaaatgttttgaatatatgaatgaatgaataaatacatctttctttagatatgagcctagctttcctggtgaaataaacttcccttcagtttgttcactaccccctgccccagctggctgtgtgccctagacaaggaactagttgtcagaactaaacatggccccacactgtccctcaagtggccatcagcccgaagacactggggtcaggacctctcctataggcatgaactccagaaggaaaaagatttctgtccaaaggctgatttcagtcaaatctaataaaattttcaactagattccttacacaattaaatataaagaccactagcatatggggaggaaagctacaccagatggctttcccactacaaagagatgaaatatatgtcatttccacttccatagtggtttagtcttcttggagctcagcattaaacagctgggagccctttctgacagctgggagccctttctgacagtgcagattccactgctgatggcaggaagtcagtatcaggcagcatccatccattttctccaactacctttccagccaaccacctatgactttctctcctacaaaagttttatgacaagttaagtagaaagcttagcaatgaataagacctcaagggatttggcaggatggagaaaatgaggaaagtttggaataacattgattgttcctgggaataaatgtaaagtggaaaaaggtctaagggcattgtggtcgcacagaccagggatcaaagcctcactcttccatgtagaagccacctgaccccagttcactgggcctgggcttcagttttctaatctcaacagggagaagaatgacaagacctagttggcacagagtatgttcagtacattttagctctcttcccctctcttgactcctattgtatttgctaaaatgacacttctggtctgaaatggattttttcttttcctcatgtgtgggttttttgttttttgtttttagtaatgataacgcccataaatattgttttaaatgaaatcagatttagatatgcatttttaaattacttacttttgaatagaaggacaagactatgctgaacagaataaaattagaattgtcaaggggtacctgggaaatgtgacagctctatccatgaggcaaccatgacagctaaaaaaattggtaacttgtaattggctttgggtctccagtatattctgctgtgagtctcacatttgctctcctaagtctcccaaatggagaggggtctctaacactcttaagctccctgatataccccttgatacctgtccctgagactacttgtttccatacactattgttcctgatattcattcacctccaagtccactcatcttttaaaatcacatttgaataggcatgtgtgagagaggctaacacacctgtaagtcaaaatcccatggcgcgctgtagaagacatcccagtaaggctaaatgagcaagggtttcagaatcagaggcctaaattctaaccttggccccttcatctttgtacaagagcagcgcttatgtctgtgggctgttatataaaatctacaaatacctgtcattcagtccagtttcccattcaatgagaagcccctttcatcacattcctagcagatagtcaccccatctctgcttcagttcctccagtgacagagacctcccttttctgaactgccatataagtttgtgcaatttgggtattgcacaaaagcaccaacctgaagaggcaaatgggagctaaaatcgagtccccattctgcatgtaaagcttgttgcctaaaagggatgcctttttcttatttgacggtccataaaaggctcctttttctaacctcacaaaggcaccatatagactatcagtgaccctgccaggtcaacacactccagcgctcactgaaaaatagaaggaacttcaacctctgccatgaaggatgttgtttcagatgccaagtggacaatgagactgtgtcctttggctcctcttagcaagggccacgaccccaaatgagcccaggtgttgagagaccagcaattagttgccgtccaagctagtgtctctgcaagagaagaatataacaaaataaataaagacctgcagcagcacaccatgcttgatcatttatcaaattgcaaaatcttatccatgactgtgaaatggctttatagttaggaaaatgtactaataatgttattaggcagcaattaaacttaaattccttttaactgtatttgatgtcattctttttctgggcccattagactaacattaaggtgtttgtgcagatagctcagtcatttcaaattactttcttgtctaatgtgggagcctttaatagcatactcttaggttgaattcaattttggagacaccaggcatgctaattagattgtctcagtgttccttgcagaagaagccaaagaagagctatttttctccctcttctgcttagcaatgttcatggaacacaactttctgtgcaattagaggtatagaccctttaccacacaaaatctcacttgaaccgtaagtattgctagcagacacaatgtctggttaatatgccaccattgttgaaatgtttttaagttctcattagagccagtaagttttctcccctattattctgagtatcgtagccagtgtttgttctgtctcagcatgttagagttggaagagagggagaaataagtgaacatttattaggcacctaccatctgccaagttctgggtgagatgtttaatgcctccaacagccctgtgagctgtgggtcattatctccatttacagatggggaaactttgactcagagagggtaagtaaagtgcccaaggtctcacagctggcaggttatggagttgggatttaaacagatctgactctaaagatatggtcttccccttctcttagctcctctgcttactggtttggaaacttagaaagtcactttaacatcttgatcatcaagatcacatctataaaatatgataataatattcaccccctcacagtacattgtatttatcaaatatagtaataaacgtaaatggcccttggagaaagtgaaatgctatacatatgttgatgaaaagcaactcctgagggaccttagtttccccaggctgatatatggatcagatgggatagtattatgtcaaacatccagcccacggcccagaactcaaacattcaaccgaacaataatttcatcatcatttcaaccagccttagtccctggaagccttccaactatgtaatctctgctcatttacagattcccttttctaagtctcctttttcattgatctattaacataaattctttcttcaagtagtcattgcacttggcattgatctactaacttatagctattacaatcatgattgcaattaccatttggctccctgcaatgctatcatcattttctcttggttaccatgataaatcttactaataactcctgcctcagatcctttgtggaatgaggcaagagattaatttattaattgatggattaatgactcataacagttacagtcatcattaattgctattacctctgaagcatcaaatggttgagggggaataagagtaaggctaagtggagtgtttcttcctctcagagggccagcctggtagagaaggtgaaagctgtcaccagccaggcagagaaagtaaatgtcaccttgggagtatgagtgtattaaaactgttatggcacaaaccaccgctgttccaacccattcctttgtcttccctggctctgacttggctttccccataactactgtgattctttcaacattagacatccagctctgggctgctggcccttccctcatcccaaggtcattctccacccaggaattcctgagagccagccaggcaagataagaaaacaacaggcctatttgcccctccagcctttgggatccctgaaagctctggtgagtgcagcaagtagctacaaacttgtcaccctgtctttgagagatcactcatccttgagccctcagattccgtggaacccatggaagaccagagctcaaagtcagaagaagggtacaccatgaagaacccaaacttttcatcagtccacactaccccatctccattcatacccagctctcctgtgtaagaaaggtaacccttccagagccacatgaatctcttgtgcaaccctcttagccatgcagcatttctgcttagatacaagagtggtgccaatgcaatgcacatgcttttgctaaattattcccatcaaggaaacagtattatacattctgcttatcacagggtctacctgtaatgaccccccaccatcagcaaagccaatcattttcccttaaatattatagctattgttcattactattggctatagagtttagtttgaaggtttgcccatagcatatcccccatcctttaccatccaagatctatatgtatgaactgtttttcctctatttactatcaactttgaatgtatgtgccccccgctcctttctcctagagagcctttctcatatagacctgacctctctcataactcatctatagaatcttgcaaccattttcctgaaaaaacaatggaaacagaccaggggcttggttcagtgaaaatgttagttaaacctgagtctacatggtaaaatggattatacatagtttaccaaacagatgaaatgtatacacagctaccccaaatagcacacaggcatcactgcagagtaaagttgggttaatgatcaatccctccaaaacagggcattaggaaagcccttggcctaggccagttgaatggatttttcttgggcttctccagactccttttgtctttgtgatggttctgtagtttctgctgattgacctctgaacccaagatgagcagcgccccttctcatcagactggccacttccttatatcagaactgatcagaacattgcaaagagttatttaatatgcccgtctaactgatctggcaaagtggaaggaagactgggcaacctttcaatgccagactttgcatttgatctcatagtcagtaaagattattgagctgaggagtacatcttggtaataacaatatgcatctccctgagttgtctgaggatcaaatgaaataatatatgcaaaatgaatttgaaacctatataggcctgatgattgttattatttctttctgaaggagttcttccccattagtgattcctggcttgtctttggactcctctttcagaaaagcaagccagacacatgtgacaagttaaacaggcatagaagatatttttatctgctcaagccaacaacagtaaatgcatccaacacagtgtgtgattaattgccaaatgaattgtgaaaagaataattgccagaagagtttgaacaagggagggctcagctctaacaagtgggcaagggaagaaggaggatcaggagaggctgtatagaagaacagagattttgtttttggtcttgtgggccagataggatttggattggcagggagaggacattccagggaagataagttatgtatggttgggtggacatgctagggattggagtgttcagggagctgggagtgggggagatgcatttgatgtagtgggaaattgtgaatggtattttctttgactctgtacctttaaccatgccctacataattgtgccacccactccaaccagcctctccaatcctggctgtcccatttatccaacactcactcctgcttatgctgtacccaccctttgccatcctggctcatcttcatacctaatcttgactacatttcccatttatatccttgtgcagggccctgtgaacttgattcaaatttttgacctcagaggtttcttcctcaattcccactcaagcctacagaagtaaagctaacactaagccagatcttcgtgtgagatcttgaaatcttctatctccttaaagtaatcctgtgaagtgaaatttcttttacccccattttgcaggagaggaaactgaggcttgagatgttaattgtgagcactgtgtattattagtccactttgcattgctataaaggaatacctgagactgggtaatttataaagaaaagatatttatttggctcatggctctgcaggccatacgagcacagcactggcatctgctcggcttccggtgaggtctcaggaagcttttactcatgacggaaggcaagggggagcaggcatgtcacaagatgagagaaggggcaagagagatgccaggctcttttaaacaaccagctgtcctgtgaactaataaggtgagaactcactcattacctcagggaaggcactaagccatttatgagggatccacctgcatgacccaaacacctcccaccagacccaactccaacattgagggtcacatttcaacatgagatttggaggggacaaatatccaaaccatatcagggtgagatttgaaccccaacctgtctgaccccatagcctaactcccaccactaggcagatgacaaagcctcttattgccttggcccaccatattggtttttttcatcgttagtacccttggataggatattttactctaggcaacccttggaacttagaccctgcctcatattgccatcctgccgcaaatccttgggtagcaaggacatgtcataggtaggaattctcagtgcagcagttagtttggggtcctaaaagactttattttctttttgttgttgttgttttttgagtcagagtctcgatctgttgcccgggctggagtgcagtggtgcaatctcggcacactgcaacctccacctcccagattcaagcaattctcctgcctcagcctcctgagtagctgagattacaggagtgtgccaccatgcccagctaacttttttttttgtttgagatggagtttcgctcttgttgcccaggcctggagtgtaatggcgcaatctcagctcaccacaacctccaccttcttgggttcaagcaattctcctgcctcagcctcctgagtagctgggattacaggcatgtgccaccacgcctggctaattttgtattattagtagagacagggttttgccatgttggtcagactggtcttgaactttcaacctcaggtggtctgcctgcctcagcctcccaaagtgccaggattacaggccactgtgcttggccaatttttgtatttttagcagacggggtttcagcatgttggccacgctggtctcaaactcctgacctcaggtgacccacccacctcagtatcccaaagtgctgggattacaggtctgagccactgtgcccggcccgtaaaagactttcaacaccagcatttatatttgattctattgacagtgcaagccagtgaaggttttaagatggttataaacatgaggataacatgatcaaatgccatattttcagaagataagtcctggacacagtccaggactatcctgcctcttccctcctatacaatgaagaggtggcaggaagacacaatttgcaccctattttgtggtttaagttaaggttataagagtctgaattaggtagtggtggtagaaatggacagaatatgataataagtaattgactcattttactctgaaataaatgtatttcttctgaaaataaactttctcaccaatagcatcatctggaaagaataagctcatagcttcataactctcggggacccaggatgtatctcaggtgtatcattgttccttggttcatattcttgaaacttttggcaacagcatgatgtggagggaagcttagggggttgaagtcaggcccgctttctagtagtgactctgccactcaactaaccatgtgaccttgggaaagtccttaatctctctgagcctgtcttctcatctgtaaaatggggttaatgtctgtcacacagggtagttgtgaggcttaaatacaacagaagatagaaaagctatgatgagcacagaataaatgtcagtttttatactatcttttcttagccaaacatctcattaaaagccctgagtaatcacccttaaagtcatgtttgaaagaaaagtgattgggtttaaccaaccttttagaaagaaatttggctttccaaatgttttccactgtgtattaagacacataaaaatgttcatatcttttgacccagttgttccacttctcagaatctattgttaggaaattgtcctcaatacagaaagagtggaatgcacaaagaggttcaatgcacagatggctacaatagtgaaaaatcagaagcaatttgaatgtccagaagccaatgattgcagagtcccactgcagtctgctgatactttaaacatgctttaaatcagtataaaatacacagctcaaaacaatatgaaaacgggcaaagtaaatcaaggatcaaacattcttttcttcgattcatcacctcccacctctgatgtccaaccccactcttctgcagggcttccctgtgtggcccatataccaacaattctctttttctgccatctgggtactaccagggctcatttgcacagcattaagcttcccacccagctgcctaagccccctcggaggcaaatctcagctctttcccctgcagacacagaggttctctccaagcttggcagttttttggcacagctctctctctgtctcccaaggcttccttgctctggccccaccccatatccctattaccttcccacttccaacttctttcccgattgtctccaacgcagttcgctgtgcccttctaagttagagaaagtattttctcaggtgtccaaaatttgttcatctacataaacttaaggaagagggaaaaaagatagattttgatgtcaaagtttatttagaagccagtttacactcagtctccaagtctttcagtcttgactgcttcgtggaatccctcaagagaagactaaaatgttattaaactacatcatttcaaagctggaattcatgaagttagaaacacagacagttagctggtcaaaaataaaaataaaaatcacataaagtcatgtggtgctacctgtattttgtaagcgggcacttcctcttttggtaactccttgaatgaagagcatttggtttctcttgagtttgtataattatatgcattgtgcaatttcttagctttggcaggcgctgggtagcatttggcttcagcactttcaactctaaggacaatttcacaattgggcttttcctgtcagctccaacatctggacccaggggagactgggtccaccatgcgatgaaaccctatgtgaacttcctcagccaagcaagaacaagctgtacaagggcaggtccttccctcactccaggagcctgaaagcaggtctttcactgtggctgccaggttatggccattttttaaaagaaaataagctgatcattttttaaaatgctgctttactggttgaacaataatcactatttcaaatcaatatttattcagcacctactgcatgccatgagttccaccctgtgtgctggaatacagagacagctcctgctaatccatcctgcctcttctatcttccttcttctttcctccttcttccttccttccttccttctttacttccttccttctttagttccttccttccatccttcttccttcctccttccttccttctttacttccttccttctttggttcctttcttccatccttcttccttcctccttcctcccttgcttcttttcttttctttttctttttcttttttttttttttgagacagagtcttgctctgtcacccaggctagagtgcagtggcatgatctcggctcactgcaacctccacctcccagattcaagtgattctcctgcctcagtgccccgagtagctaggattaaaggggcccgccaccgtgcccagctgatttttgtatttttagtagaggtggggtttcaccaccttgaccaggctgttctggaactcctgacctcatgatctacccacctcggcctcccaaagtgctgggattacaggcatgagccaccacgcccagcttcctttcttaaatattgtttaaataatgctgaaaacaaaaaagaaaaaagcacttacaatcccatcacttggtatataaagaataaaaaagagcattgttctaaagcttatttagaagcccatttacacttagacctcaagtcttttagccttgaatactttgtgaagttcctcaaaagaagagtgaaatgttattttaaaccacatcatttaaaaaatacattgctcatcctaccctctctgagtccgctgctgcctctggtggcctggggcagggaatccaatgcctgccccaactggccacggcagtgatggaaggtggaccaatgagaactagtctctgcctaggaagcactcgtaggttatgttatatacaaaggatgatgccttcacagtttaaactctccccttaatttataaccttgtgctgagctttctgcctctcccacagatcttccagtcccacctcctctcaagtagaactccttaaatgtagagttgtttccttcttccttccccacacacttaaaacaggcaggcacattttgttcttcatgaacgttcaggacccgcacactgtgaaacaatgagtgaaaggagtagacagcacggactctgacttcctggctctagaaaattccttccagagtaagtttgcatgcagttcactgttgcacacagtcctgggccaaaggatcccaaatgaaagcaaaaacccatcaagagaattgtgatttaaaagttaagaaaacagcctgtgcatatttttagaacagcccagaaaagaatacatctgtgacttgaaacagctggaaatctactttctgccaaaattatgctgattatgaaagctgtaatggtcagacaagagacagtcagaatccaaggagtcctgtattttcatgtattcaactttcaaataatctttactttcatacattaaacattgacccctctacactgcctttcaaacaccaaatgccagccagccatgaagtttttacagccatgtttgtataattgaggattttattgtattttgcccttatcagtttagtagtaagaatgatcaaccaaaagaacaaaagtaatcagaagcgtgggttttataaactcataatatacttcagaaaataaagaaaattatgaggcatcctgaaaacagaataacattagccctggatagtcattgggttacaccagtcaaccatgtgttcaattctgaaggaaaacaaaattttaaaatatgtgtgaaatgttaaaaatattggtaacaacttatggctaaaagacaaggtatcattagggatatatatatatatatatatatattaggattactgaaaatgaagtcttctcctacttggcactctgctagggtatgtctgtcattcactgttatgtcctcagtgccttgcacataatagatgctccataaatatttgttgaataaatgaataagtcatttgtagctttgacattttaaagaatttattatgcataaaagtagagatatatttgcctgtctctaaatatagaaagagaagtagaaaaaggatttctgaagctgccccgtcaatgtgcgtagagatggatcaatctcttacaggggtacaaaaggtgaatttaagcagaaagggtgacagtgagctgtttgtcagactattgtccaaatgccctccctcacggtacaccctcctccaagccacacatacccctgactgaaatcaggcaaaaaaacagacctggtaaggccaggacaaagacaaggcttaggagtgaggtgccccaccccccgcccccatcacaggatgcaacgtctggaaagaggtgggacaggaagttgtgcccgggggagaacatcaaattctagtccaatatagtccaaactgaggaataaaatgaaaatgtacaaccaaggtaaagaaccaaaccagagatgctggtgagtgaagagcattcaaatggacatttctagaggaattctcggggtagagtgcaggcatccaaactggtgtttcccaccaacttgctgtgtgcatttgaagaaaccagagcagaatgcatgcagctcctatgcaaaagacggataaattacaacacagaaaagacagtctaaactcgtgcaccagcagagcaagtctctgatgtatttgctccaaaatgtaaatgatgaagccaaatattggacacagttgagatcaggcactggaaaattatttcaatggtgccaaggccacacgcatggaggaaaagcagtgtcagcagcaagtgtggtgagaaacagggtaaaagcaggatggtcctgagattctaagatcagaaccaggaagtgttggcaggaaggcctgggagatgatcagaacagttctccctccagagaggacccaagcctcactcgcactgccacgccaccccaatcttgaaggtaccccatgccgaacctcatcactgacagcttgtgaaggtgtataacgcccaggaggagttgtggtaaacgtatgcacacatatatataaatatcatcttgctccaaggtttttgaggatggtgagctctgcttgtcacaaaggtaacaggggtggtcattggtttcactttatgtgaccttaaagtgcattttaagtgaactcacattcaatgtcactttgtgggatgcttggggaagagggtctcctttagtgtccagtcttctgaggctctgccttttccctctctggccctcctcagacaagcagagctgagactctgccttcaaagctcgggtattgcctggaatccctgaggcagtgctagctggggaatccagtcagctaacacatgcctctcagacagtctatactctctcctctgacatccaggagggctcatggcagggccacacggtgagaccttgcccatcacacagccattacagaggattcccacagagccttttgacagtggtggccactcatggctttcagagtatgctgcttccctgaggagctcaccaagggctgtgatactctcagaagtgcctctgaaaggcagcagtttacagaaggacccctgctgagcccctggtgaagctgagctgctgcacagcttgcccaaggaacacgttttagaaatatcttcagatccactgggactgccagaggctcctcatcctgtgcccagcacaggccagtggttctagcccttttggttcaggataaaacttcacccttcctaggtttttgtctttccactcatccctcactggtgaggtaaaatatgcctattaaatcttcccattggtgtgcgagagtcaatatttagggtacttgacaaaagctctagattcctcttcctctgagtccttacacagcatacacctatgggcatggaattgaataatctgccagtcctccatttccttcagctccctaaacagcaaatacaaactgaacttcattagcaactccaacttgaatggcaaatgccagccactgggtcagctcaaagctcaaggataaatttcagtggtgaaacatccacagaaaaccctcaagtgggagaatgctaagaaacagtgggaaagaactaatgggaatctaggcctacttcacacacacacacacacacacacacacacacacacacacggactgcctgcgtggctggtacaataaaagtgtgtatttacactcgctcatctatttcattacaagggaccaatcacaaagacatttattttgtcttctttcctgctctggtaagctaattacaaagtaattgaattagctacagaataaattagttgttatcaaactgcaagtaaagggattcttctaaaaatgattttagggtaaaacactggcttgcacaattattccaggttaggaaatatttttaaaatttattttattaatatgtttattgtaggaggaaatcctaaatttaaaggtaaacctaaagtaaatatttattctacctttaatgaatgacaaagaaaggaaagcatgggtaaattcttgaaaatgctagagggggcagtctacgtgaaatgtttacatgataatctttgttggttgaagtcactgaaatattgaaacgtctttagtggtgagcaagtggggtggaatggtgcttactctacataatgttcgatttagcacccttaccacatgtaattactaagtagccagaaagaatgtctttttcaaaagtacatactctgccctcttaaaaatctcaaaaatagcatgttttcttttcaacttctaaattacacttctattaaatgctatgcagagttcagaaaatggctgcctctgatcaatctggtgtgcaaagcccttcatgaagtcatatccatttgatcataaataagctcaaagataccttgcaataaaagtgtcaggctttcagctctctggcaaagtagaagttatttatacattgaaagggtgtgggatattaatggcaaagacaaaaatgattggaaaaggcctggaatcaaaggacaaaagctggaattattaaacacaatacaacataatgccacaatcagaaacactgtaataccatggaattcttacagtgccggtcaaattatgcccatgagcataatacttgagacttgagggtgaaatgtcaggtcctatacttgggcctggaagcaacagcacaattacaagatcaaataacagtattgggaataaaaatagtttgcaggttttagtgggcagtgaactcagagttcatggcatgcagaggctgcagaaaggccaatttgaggatggacagtcctacaaggcatagtctggaagcagggttcttaactggggctctgttggtggggagtggatttgggagtcacagcctctattgtcagacatttatttcacagtttcatagcaacattgtcatgattagctatgtacatataactttgcaaccatccttaatgaatacctaaggatcatcctagaagtgaaatttctgggtctgagggtgtatacattcttagtgcttttaatacatactaccatgtgcctctagaaacattttctgtttctaataagagcagttgaaaattcctgtttccccagctatccaccatttgcctcatgattttctctaggactaaattttaaagtagagtctttaaagtagaagggagtccaaattccatccctttcattttataggagaaaaaaaattgaagcccatgaaggataggcgatgtgtcctctaataccagagcttctcagggggagagaagatgggggtggctatagctcccttctcctggccttaggcctgatatagaacaggtgcatggaaacgtccagcatagagaaatctacagaaacagaaagtagattagtggttgcctaggcttgtggatgggagggaagatggggagtgacaactaacgagtatggatgggtgttttggtggggccattgaaaatgttctaaatctattgcggtgatgtttacacaacactgtgacgatactaaaaattattgagttactttaaagaggtaaattgtatgttatataaaatatatcccaataaagctgctattttaaaaaaaaatgtgctcagtaaacatttgtagaaggacagaatagagggaggaaaacagatcaaacatccttgttccttcatttccaaccagtggtctttccactttctcactttcactgaagtagaacatgtctaaaattgtccccagctcagtgctgggtttcccctaggtgtttccctgtgtttcaggaatgtgtttttttagtaaacactaacctgcctcttccagaacttttgagtagagaattttttaaatctgagcttcaggccaggcatggcagctcatgcctgtaatcccagccctttgggaggctgaggtgagtggatcacttgagatcaggagtttgagaccagactggccaacatggcgaaactctgtctctactaaaaatacaaaaattagccagatgtagtggtgcatgcctttagtcccagctacttgggaggctgaggcaggagaatctcttgaacccgggaggctggggttgcagtgaacagagatggcaccactgcactctaatctgggtgacagagtgaggctctgtctcaaaaataactaaataaaatctgagcttcagccttttatattttcctgagaatctagctcagggctggtcacaaagtaggcacttgatagatgcttatttactgaaatactggtgaactgtatgtacattaaatattaagtaataaggcagtaatatagcattattttctaatattgatgcctaatttctccagctgtcagttcaagctctgtcaattcagttggcagttaacactctggcatttcagagattctgatctccccccttacatttcactgtgcatagtgagttgttacgggccccactttgccctcagtgcccgaaagcacaggactaaatttaaggctcagaagtattgactgcagcatctggggggcaaatctagaatccatgaagcttaaactttattcactttggaaggaggaaaggtcctctttaaaaataaataaataaataaataaataaataaataaacaagtgggggctgcgcatggtggctcacgcctgtaatcccagcactttggggcagtatcacctgaggtcaggagatcaagaccattctggctaatgcagtggaaccgcacctctactaaatatacaaaaaaaaaaaaaaaaaattagctgggcatggtggcacgcacctgtagtcccagctactcgggaggctgaggcaggagaatcgcttgaacctggaggcagaagttgcagagagctgagatcacaccactgcactccagcctgggtgacagagcgagacttccatctcaataaataaacaaataataaaaataaaaacacaaaattataaatgctaagtacagcaccttggaaggggcctgaccaaagaagcttcctcagcttcctgataagtctgcttgtggctttgttcgtttctctctccttttcattggatttaattttgtttttatgtttaaaagtccattgttagtagcaatttagcatcataagcctcctaattcttcttaaaaatacagtgcatttaagtaattgtgtaattaactacccacaccatctagacgataactagaatggtggggcatcccatctggagtggaggatgggctctcaaatcggtgcctaatgtgaaaatcacacatagtcctaattgtctttaaaatctcttaaattgcctgttaagtacagaatgtgtggttttatgtgtctgaccttgtcagtagttcttagacatactcaagtttgaaaatcactaagccagaccaaaggaaggaaaatccaaatgcaggtgcctggaggtaagaacctctttgccttatgaccgctctcaaatctctagcttgaacaaaggtaggtgctcacctgggatgttgactgcctcttgtttttgatactgagcccttataaacttaataaatgttaccagcttggtttgttgctatggaatttgaaaagatgatatatttgaaagctgatagactgggacttggcacaagaggtgctctgtgaatgtcagttggatttaaatctcatttgatcaggtctccatacacactgctctgctaaagatggtgtcttccaagctggtgtttctgtttgtggcctcactacatgacaatcccactcattcagggcgtgggccctggactcagcacctctttcggggtaaataaaggattccttttacctgagggagggttctcaagtctcccatttgaaaacatttcttcatgacaactacatgatgtaactttgtataaacaaaagttatttgaaatgaacttacttaataatttacttgctacatttgcttttttacttctttgtaaagcttaagcttagaaaaggtgcttctgttgtatttgcatttttttaaactgactcgagtaaggcaatgaatgaggtttccgaaagatgaccagagataaatctagctaaaatcagtctcaggacttgagttagttttgttcctacccttatacttatttcactgacataagtaatagtgtttcctactatctactactttgggggaagaaaagagagtccctttggtacagagttactaagcacctaaatatcagccctgtttgctgggcatgtgggattcggaaatgaataaatagtgcacagccttgacctgaaggtcacatatgtctgaagatatttagtcccctagatactttcttaaggagatgtaagggcactagctttcaatgtacttttgagggaagtaaccatattcctccaatgtcttcatagttacattgctttatacaaaaactctcttcgtaatagcaccaacgtctgcctaggtgttcaatccagacaccatgagtcacccagaccactccttcccttcacccccacaacagttgaccaccaagacatagtagctctaagtcccaaaatatccatctctccctcttactcctctatctctttcctggttcaggcctcatcacctcttgccttgactatcaccacttcctaaacttttctccctgtctcccattcccacttcctgccttttcccaatctccctgccttacccagcccatgttccatactataactagaaagggctttttaaacacaaagctaacaatggcaccctcctgcttaaattcctctgtgcttccccgttactctcagctgtggtcctgcacctttttctcctgctaatgtgcatgctcatatgtatgtgcattcagaggttcattcgctcatgcacggttctgagcatgccagctataatcttgccccatcactctggagggtgcaagccctcagtggggaacccctgccttagagcatgaagctcaagttccttggccttgcctaaaggttctttctgatctggcctattcacatctgcaacctcatttcctcccagccacgcatatgtgccctgttcatcagcctattccaaaccgcttacagtaccctcaaagagaccatgccccatgcgtttttacacattgctctcttttccttgaatactttccccccacccctcatccacccatttagcaactactaaccctccaagacacaacttaagaaccaccacctccaggaagccttccatgctccatttatgtccctattctctatgttatatgtccctcccctataagatcatttatggcttcatgcttatctgtaattaatagagtgttcaagtttatagcttgtcttgtgtgctagggaataagctccttgagaccaagaactttgggttatcaattgttaagatctcagttctttgcacagtgcttttcatcctaggaatccgctaacatttgatatttgtgggaggaaggaaagaagtaagagaaggtggaactttgaagctgtgatcattttctttccatcaaagccatagcaaaaagaacaatatttttaacatccatttaattaacttctataaagattttttgttgacttcatgaatcttaaaattctttattaaaagatcttttggctggtttcttcattctcacttttgaggatttgtcttaaagttatataaaggattcataggagagaggcagaggtggacagattacttggggccaggtttgagaccagcctggccaacatggggaaaccccgtctctgctaaaaatacaaaaaattagctgggcatggtggtgcatgcctgtaatcccagctactcaggtggctgaagcacaagaatagcttgaacccgggaggtggaggttgcagtgagccaagatcacgccactgcactccagcctgggtgacagagcaagaccctgtcttaaaaaaaaaaaaaaaaaaaaaaaaaaaaaaaaagatttatgggaacattcaatggtcccaggtttcaacaaaaactctgtagctctagaggatggtggccggaagttgggctttgaagtgaaacagacctgtgtttgaatccctcttggccacttagtatctgcatggctttggcaagttacctacctctctgagcctcagtttccatatctgtaaaatagggatactaaaactaccaactcctggccaggtgcggtggctcacacctgtaatcccagcactttgggaggccagggcgggtagatcacaaggtcaggaggtcgagaccatcctggctaatatggtgaaaccccatctctactaaaaatacaaaaaattagccaggcgtggtggcgggcacctgtagtcccagctacttgggaggctgaggcaggagaatggcgtgaacccaggaggcagagcttgcaatgagccaagatcacgccactgcactctagcctgggtgacagagcgagaccccatttaaccaaaacaaaaaaacaaaaaaacaaaaaaaactaccaacttcatagcattagtttgatttttttttttttctttttgagacaaagtcttgctctatcacccaggctggagtgcagtggcacagtctcagctcagtgcagcctcaacctcccgggctcaatcaatcctcccacctcagcctcccaggtaggtgagatcagaggcctctgccaccacacctggctattttcttatttttagaagagatgaggtctcactatgttgcctggtctggtctcaaactcctgggctcaagtgatcctccctcctcagcctcccaaagtgttgatgttataggtatgagccacctcacccagcctagtttgaaatttaaatgataaaatacatacaattgagtatatacacataagtatttaatgtatgatgatgattattattattacaaggacaaaatctagtgcatctgatcttaagctatggtttcatagtaggtgactgtgaagtggtggggggagtccttgaaaggagaaacaaaaaattcagtgggaacttagataaggagaagatggagaagtcattttttttcctaatctgtttagctcattctcttataattaaactgcaagattattccttcaactacaaaatggataaattattcattatattgacttgtttgaaaagatatcatagtttaaaattgaatgaatttctctttaatatgattttctggcaagattagattctaatgtggattaatatcctaaattgagagctctaattgaacactgtgggaaccaagcatgagtcaaagacatcgtccctttacaagtggcagtcaccgaggaaacgttcacttgtgtgtcagagggacacctaacatcagcaagagtaacagtagctgaggctgaatgaaggcttgctgtgttgggtacgcatgtcaagggagacgcaggacgctatttgcctcacatctccctcatcttgcagtcatcgccgtcctgtgccttggtggagtttttagtgtatgcagcttctgtgaacacaaggacctccccatcatgtccattgcactccctccatacctagcacaagtgcatggtccggagtagtgcccagtgaatatgtgtcaggacagtggggaagggaggaggacaataccctctaacggccccagagtctgtgccttctggcccagattcagtcagactccaccaaagtcagtctccaggactctgttttccaagtttgttcagcccttccccctcagctaacctgttcgtccctttgagccaaactcactgattagcattcagcttctttcactttcaatcatgccagacccggtgtttcatgcttaaccgttagggaaacatcctgtcttttaccatgatttttgcaggtggctaatatcatcaattattttactcactcaactctcagagggtaatcacttctttgattcaagtttcaaggccatctcactgtgggctcctatacatcaccgattacaccgggcagagtcaagcagaggtgctggccctgttctttacagattcatctggaaactatggtgctgttaatctgctctgtgttcatgctaatagtgtctgtctataatcaacctcaatctaccattcaccacgccaaaaagataaatgccagacttcagaaaatgaactaaaggcagccctcaaaccccagaaaatctcctgtccacccctgccagggcgcaagatgtcctgatttaggaggttgatccctcctctaattcctccttagaatgtatttcaaaatcaaaagccaatagttacatttctaagcaacggagcagaccaaaaatgttttgtttgacacagaagcaatagaagcaagaccatgtttctattttatgaaacctctgagggtaattcactgaaatcttgacatttaatatcacccaatcacctctctagcaagctattttctttggctccattaaccccacacacacagactgggctgctggcacttactgggtcttgtcgttaggtgggctgcttttaataccagggcaggatttggcaggaagaagtggcacctgctttattgaaagacatcttcatattttagcctctgaaagagaaatgtgcaacataaatgtccttaagagacgattatcgtacatcaagatgtccattccaaaaggcattgtaccagatgcccaatcacacacagtcacccagaacagacgtgacagatggagactttgagcttttaaagaaaacaaatgtgcaaattccaaagtgtctgtgtgctccaggccagcacatgcccaggtaatttgagttgtgcccattggctgaaagataagattcaggcctcagagagggtttggggagaggatgagtacaggtttcttgttgcccagagtctccaaatagatacacacaggatacaccacctcagcccagagatatttaagcactgagttaaaagaaaggattgagcatgcagcatcaattgatacattaatgctggttctctggcatcagggaagacattaacatacagaacttgtcttctccactgttcaaaaatgggaagaatcattccaacagggagagcagggaagtccaaaatccataatgctcaggtacaaagtaatgaaaccagaaatccagggtatttttgctattactaccaagggcctatcttcggtgtaatggcaatcttctaaatctctgcatagtttgacacctgcaaatctgattgagtctgattgaaccatttgctgtctaaaatccttgggagaccccgataacctagagctgtagctttcaaattgctccatgggctcgggccaaggcttccacagggactgagggaggaagggtacagctcttgggcacatccccttggctccagtcagaaaagttatttcctctgttttacaaattgagcttccaagtaagattttcttcttttctctttttatctgtctctgaggttgggtacagtggcatgatcgcagctgactgcagtcttgacctccctggctcaagtgatcctcctacctcagcctcccaagtagctatgaccacaggtgtgcatcacctgtggtctaatttttttattttttaattttttgtagggacaaggtctcactatgttgcccagactggtctcaaactcctgggctcaagtgatcctcccgcctcagcttctctaagtgctgggattacaggcgtgagtcaccatgcccagctccaagtaagattttcaacaaagagtcttgaggcttaaaaacaaagtatgtttgaaaagaaggggtctgcaggattaaattcagataagatcctccccattcttttttgtttgtttgtttttggttttttttttgtttgccaggctgcagtgcagtggcgcagtctcggcttactgcaagctccgcctcccgggttcacgccattctcctgcctcagcctcctcaatagctgggattacaggtgcccgccaccacccccggctaattttttttgtattttttagtagacacggggtttcaccgtgttagccaggatggtcttgatctcctgacctcgtgatccacctgcctcagcctcccaaagtgctgggattacaggcgtgagccaccgcgcctggccgatcctccctattctttatcctgtcttcctcttagacgttccccagcacacccagataatccagtcatgtccagtgacttccttctctctatatcaaagtttccttccgttccatttgcctggaatgttctcccttttctcttctctgcatggtaaatctgtattcttgttttaagattcagttcaaattttgccttcggagtactaccattcctgcttagcagcaattatccatattcccactgcatttgtgcatgtgttgacgcatatcgtattattacatgtgtctgaatcttggatcagtctgcacactcatagaatatagagtccctgtcttattctgtcctcctccatcttcctccagggcctggtatgctgtgggcactcaataaatatttgatggatggatgcttagctatttaattcaccactagatagcaatttggcatattcccaaacaattttattcagaaggaattcaaagaaataggcccacattctcataaccaactcaagcagctctatgttaacaaagaatataactacttctaactacttctgtttaggtcggagttttatttttttaataaaatttatgattgcaacaacattaaaagagatattgtatagaggtcacatgctgaaagcccatggacaacaacagtcttttaaattggcatggtttgaccctgccaatctgattgggtcatttcttcacttaaaattctcacgagacttcctgttgtctgtggagttcagaggtttctaggacacctccaatgctaaggcctccacatggaggcctgaatggaaaggaagtggctcagggtctcacaccttttgcttcagtcaaagaggttctacagaatcaaagtgttttttgtcttaatttctttttattggaatggctatggctgagcctgactctccaggtttccatagttcccaacacttgctactttccccatccatcttcacctgcttgattcctgatatttgagtttgcaactcaaaactcacccctaaccccagccctctaaaaccgttttcatttttatgaacctatttccaggcccagagcactatgcctatttttatatatacttgcaattgtattgcatatacaattttatattctgttttcttcacttaacactgtatcataaatatttttccagtatgtgagatgtgagacacagcctctgatggttactttttcttttttgagactgagtcttgctctgtcacccaggctggaatgcagtggcacgatcttggctcactgcaacctccgcctcccaggttcaagcgattcttctgcctcagcctcccaagaagctgggactacaggtgcacactaccacacctgggtaatttttgtaattttagtagagatgggtttcaccatattggtcaggctggtctcgaactcctgacctcgtgatccgcccacctcagcctcccatggttacctttttaaatgacaagtttttaagttggttggctctaatttatttaggtcttctgttattgttgtatcaactttttatttttttgctcttagaagtaataattgtgttgaaaatcttcatacatatgaattttttctaacaataaaagtgttcctcatattcccattcacaattgccacaaaaaataaaataaaatacctaggaatacagctaactatggaggtgaagaaactctacaaggataactacaaaatactactcaaagaaatcacagatgacacaaacaaatggaaaaacattccatgcccgtggatagggaagagtcattattgtgaaaacagccacactgcccaaagcaatttatagattcaatgcaattcctattaaactaccactgagactcttcacagaactagaaaaaaactattttaaaattcatgtgaaaccaaaaaagagcccaaatagcaaaggcaattctaagcaaaaagaacaaagctggaggcatcatgctacctgacttcaaactgtactacagggctacagaaaccaaaaaaacatggtactggtacaaaaacaggcacatagaccagtggaagagaatagagaattcagaaataagaccacatgcctacaaccatctgattttcaacaaccctgacaaaaacaagcaatggggaaaggatttcctgttcaataaatggtgctaggataattggatagccatatgcagaagattgaaactggacctcttcattacaccatatacaaaaattaactcaagatggataaaagacttaaatgtaaagcccaaaactaacctaggcaataccatttaggacataggcacagtcaaagatttcatgacaaagaagccaaaagcaattgcaacaaaagcaaaaattgacaaatggtttctaattagagcttctgcacaggagaggaaagtatcaacagagtaaacagacaacctacggaataggagaaaaattttgcaaactgtgcatccaacaaaggtctaatatccagcgtctataaggaacttaaacaaatttacaagaaaaaaaccaaacaacctcatttaaaagtgggcaaatgacatgaacagatactcttcaaaagaagacatatgcgactaacaaccatatgaaaaaaaacctcaacctcactgatcattagagaaatgcaaatcaaaaccacagtgagataccatctcacaccactcagaatagctattattaaaaagtcaaaacataacacatgctggcaaggttgtgggacgcttatacactattggtgggagtgtaaatttgttcaaccattgtggaagacagtgtggcaattcctcaaagacctagagacagaaatgccattcagcccagcaatcccattactgggtatatacccaaaagaatataaatcattctattataaagacacacgtacacgtatgttcactgtagcactattaacaatagcaaagacatggaatcaacctaaatgcccatcagtggtagactggataaggaaagtgtggtacatatgtaccatagaatactatgcatccataaaaaagaatgagatcatgtcctttgcagggacatggatggagctggaggccattatccatagcaaactaacacaggaacagaaaaccaaatatcacatgttctcccttataaatgggaactaagtgatgagaacacatggacacatagaggggaacaatgcatgctggggcctattggaaggtgaaaggtgggaggagggagagtatcaggaaaaataactaatgggtactgggcttaatacctggttgatgaaataatctgtataacaaacgccagtgacacaagtttacctatgtaacaaacctgcacatgtacccctgaacttaaaagttaaaaaaaaaaagttgttcctcattttagcacattccttatacgttattgattgtattattttgatgcaaatatatttcaatatgtttttcttttcacttctcatatttttatgattaaaatatgttaaatgttacccagatgaatcttttgatcacttccattgttatttcttctattgcttcaagctagtgagagttcttcatagttcattactaatagctcccaagatctcatgcaatcttcattctcttttcctttgattgctctatgtatttaaaaagtatgcatttaactctttaactcatctgagcatatttggcacatgtttaataaatggtttttacattgatcatatcattattattaaataacttctcctttgcccattgtttattgtacttcatataaccaaattgtcatgtataaataggtgtatttcagtgctgctaattctcctctactgttctatatgcctggttttgtgagtactttattaattattattgcttcataatatgtatagaatttatagtactgtagtactagtcttccccaattgaaggtcttcatttttcaaaatatcattttatattcttggcattttgtttgcctcataagtgttaaaattgctttgtcaagttataaaaataagtggcgattctgatttaaaatatatcagcttcttaagtcattgcatacattctaagcatcttatttttgttgttgttgttgttttcgttttcttatggagagagagagaaagggagaagttacccatagttgcatagttgcaccattgcctgagatatcctgatgcaactttgttattgacagctcacagaatggagcaaggttttttgaggcccaaagcttatatgagtgagaggagacttctttaagaaaaataatttttttattatactttaagttcttggatacatgtgcagaacgttcaggtttgttacataggtatacatgtgccatggcggtttgctgcacccatcaacccatcatctacattaggtatttctcctaatgctatccctcccctagccccccacaccccgacaggccccggtgtgtgatgctcccctccctgtgtccatgtgttctcattgttcaattcccacttatgaatgagaacatacggtctttggttttctgttcctgtgttagtttgctgagaataatggtttccagcttcaaccatgtccctgcaaaggacatgaactcatccttttttatggctgcatagtattccatggtgtatatgtgccacattttcttcatccagtctatcattgatgggcatttgggttggttccaagtctttgctatcataaatagtgctgcaataaacatgtgtgtgcatgtgtctttatagtagaatgatttataatcctttgggtatatacccagtaatggattgctgggtcaaatggtatttctagttctaggtccttgaggaattgccacactgtgttccacaatagttgaactaatttatactcccaccaacactgtaaaagcattcctatttctccacatcctctccagcatctgttgtttcctgactttttaatgatcaccattctaactggcatgagatggtatctcattgtggttttgatttgcatttctctaatgaccagcgatgatgggctttttttcgtatgtttgttggccatgtaaatgtcttcttctgagaagtgtctgttcatattctttgcccactttttgatggggttgtttgtatttttcttgtaaatttgtttaaattccttgtagattctggatattagacctttgtcagatggatagattgcaaaaattctctcccattctgtaggttgcctgttcactctgatggtagtttcttttgctgtgcagaagctctttagtttaattagatctcatttgtcagttttggcttttgttgccattgcttttggtgtttttctcatgaagtctttgcccatgcctatgtcctgaatagtataggttttctttttcctttttttttttttttgttttttgttttttgtgtttgtttttgtcgaagtctcactctgttgcccaagcaagctggagtgcagtggcacaatctcagctcactgcaacctccaccacccgggttcaagcgattctcctgcctcagcctcccgagtagctgggacttacaggcacaagccaccatgcctggctaatttttatagttttagtagagatgaggtttcactatgttgaccaagctggtctcaatctcctgacctcgtgatccacccaccttggcctcccaaagtgctaggaggattacaggcatgagccaccgcacccgggcatctaggttttcttctagggttttgatggttttaggtcttatatttaagtctttgatctatcttgagttaatttttgtataaggtgtaaggaaggggtccagtttcagttttctgcatatggctagccagttttcccaacaccatttattaaataggaaatcctttccccgttgcttgtttttgtcaggtttgtcaaagatcagattgttgtagatgtgtggcattatttctgaggcctctgttctgttccattggtctatatatctgttttgataccagtaccatgctgttttggttactgtagacttgtagtatagtttgaagtcaggtagtgtgatgcctctggctttgttctttttccttaggattgtcttggctatacgggctctttttaggttccatatgaaatttaaagaagttctggccagggcaatcaggcaagagaaagaaataaagggtattcaactaggaaaagaggaagtcaaattgtctgtgtttgcagatgacatgattgtgtatttagaaaaccccatcgtctcagcccaaaatctccttaaactgagaagcaacttcagcaaagtctcaggatacaaaatcagtgtgcaaaaatcacaagcattcctgtacaccaataacagacaaacagaaagccaaatcatgagcgaactcccattcacaattgctacaaagagaataaaatacctaggaatacaacttacaagggatgtgaaggacctcttcaaggagaactacaaaccactgctcaaggaaataagagaggacacaaacaagtggaaaaacattccatgctcatggataggaagaatcaatatcatgaaaatggccatactgcccaaagtaatttgtagattcagtgctatccccatcaagctaccactgactttcttcacagaattagcatcttatattcttatattattatacgtgtagttttctaggggtttactgcttgtgtataataatgtatatagtaatgtagtatatatgaaaacatggtgtatagtaatatattgggcatagtaatgctactgacctttgaattttaataccaaactgtcctctttctaaactggttgatttagttccaggtgtacagcaaattctttgtaaatattttttcttctttcccagtaattattgtcctttaagtcttttgcagtttgtctaaagcaatattatgttataatagtagctatattattttcaggggccaatttttgaaaaaaaaagcttttaatcttaatccattattgattcattatttaaaataggtatctttatcaagttaaggtagtaaatagtatcactccaagtaaaggttttatcaatttttcttttgacatatattgaaatagattatgtcatctaatgttaatataatgttagtcttttattgattttttttttttgcatttctttagtaaccttccttaagatcaaatttgtcacacagaataattagatggagtccggccttgtctgtgctttgatgcagtcagcatagcttgggaattatctgttccttgtgagcttggaggaatccattagatctgtatgccttgctttttggggatattctgaatttttaaaaaatttctacctccattactgctttaatagggtttcctacctcattgcgtcatttttaaatataagattgaattaaaatcatatatgtttattataaaatatcatccatttgttcaggttttcagtcagttagcatataattagacatagtattccatataagtggtttaattccttttgctactgaatatattgagtcagacctgaattctcatccaggttccaccactgattcatgtgactttaaccaagtaacttgacttctatcatcatttccctataaataggggtcatattacttagagtataggattgctgtgaggattacagatgatgtatatgaagttcttagcacagtgcctgtcctcactaagtagaagatattacactgttctctttcctaatgctgtttgtctccttttttgctgttctttaattatatttgcatgggttgtctatttttcatagtctttccagtattttcagaagcaacatataagcaatggggagccactgaaggaaagagtaccaactctgataatcgaatgtctgagcatcatttgtgggtggatcatcaaaagatgggtctatgctgtgagaaatgacagaattgacaagaggccatctagactcttcttgccaagcaaaatgtggaagtgtagtccttatattcatagtcagtaaacacagtctccagagcttgggagagactcttttaagggcttctgagagtgggaaattgaccaggcccccagttgtcctgtgcctgcatccaagcctttagggcctggaaacagagatgctgacaaacaccatgacccagactgaacccagcttttcaatgggacaacaaaatgagctttgttcatccttttgaaatggagcccaattatgtttgattaataaatgaaactctgtgtccaaataggagagacactgtagaaaaaatggtcagaaaacactttgtgtaagaaaaggctgatgaagttttcatcagagggctttcatttgcctggagctagtctcagacagagagaaatgttcagcttccaaatccttctcttgtttctcattccttttttttttttcttaaatatgtttaactctcctgcttaagatttattttgggctccttagcgatggatttgtgtttattgtgtcatttaaagaaaaatgcactattaaaaacactcctaatccatttataaatgtcaacagaaaaacaagtcaaaggttgacaatagtaattaatcaaacgatatttattgagcactttctatgtacaaagcactttctatgtacaaagctatatgctattaagtaagaataggaaacagtctccagcctcaagagtccttcagttgagctgaggaaatagccaaataattgactagctataatacaagggaaatggaaataaatattaaagtcagtacataagccacgctgtactgaagtacatatcccagggatggattagcaaggacttcatgagcaagttgcatttgggttgcatcttgaaatgtaagcaggcttttttataaggatgtgttctcttagatttttaggtgagccagccaatgcacctatgtattatgccccagatgtcagcaaacacaagcaactattctaagctagtccatcaaacccatgtgtgcacacaagcacacaatcatgttgttcccaggtcacctatggttactttcctattcctcattgcatttgtcccatccaaatgcttactcccaaacatgcctctgaacctcttcaatttgatgacctccaaagcttagcttcttaaatctggtcctttttacatggtttttggttttgcttccttccttaagttttagcctttcactccatgttgtcctggggaaagaactctcggctctggtcctctgcgcgtagggcccccatccctagccggatcaaatcttggaatgaggaagcgttggaagaattccctgtgttatccacccaggagttgtgtaggtaatacaggttctcctccactccctggccccaagtaagatgatgcttcagaataaaaacatgcccttgcatagataggtggttcccttcacagctggctccttaccagaatggagaacagtcctgctagcatggggttcagagtcttcctgtgtgtgcatctttccaaagatattaagaggagaaaaagatccaagtgaatttccaggtttctccaacactttaaactatacatttgatattcttaaccaacttgatgaacatgttggcctgtctgttccacacaccaaggaggtaaagagaaggcaagtgagatgatgagccatggaattccaactgctatgtcagtcatcaggctagaaaaatgggaggctgtgcattaatttcaagagagcctcggagaactgtctcaggataaatcagccagagtgactggaacattgtaccattttcaactggcaaatttattaatgaagtaagagtacagtctcaagccaactcctcttgcccctgtaacaaactccccctgtgagagaggatgaaggggatgtgtttgttagaatacttagaggccatgagtaacacaaagcctaaccaacagtgctttaaattttgtggacttttactatttcattaagtgaaaagtttggagataggtaattccaaggttagtagagtggctcattcatgtcatcagggactaagacatttccatctttctactctgccttttttatgtttttgtttttgtttttttaagagatgagagtctcaccatgttattcaggctggagtggctattcacaagcaggattatagcacactacagccaagaactcttgggctaaagcagtcctcccacctcagcctcccaagtagctgggactacaggtatgcaccacacccagcccactctgccatttgtaatatgtcatcagtggctccctttatggccacaagatcagtattagcatagtagttccacacattgcctccttaggtgacctgggttatttcttcttctcagagtgctattggccaggttacttgtggtattcaaatacaaatgggctggtgtaaagggtctgagatggtattattcatatgactggaaacttcaaggggtatcttgaaggcagggactggcaactgaagtgtctgcatgactcttcagcatggtggtctcagggagtcagactttctacatgatggcttggggtcctcaaaggcagtattacaaaaggcagaaagtggaagctgccagtgtcttaaggccggggcccagaaactggccaaagcagtcacaaagccccccacattcaaggggagataacatagacccccatctcctaatgggaggagtgtccaagaatttagttatctttgggtcacatgtaggttataagttaagctgttgtaataaagagaccaaaaatatgccgacttaagatagaagtatatttccccttgtacatcacagtttagaggtgagcaacacaggctggtggtctatttctgccagaaagttcccatatctggatccagcatgctttgtctactacttcttctcaagtggtgggaaagggaaaatgagaattgcagacaaacagcttccttgtaaaagataatccaaaatttctacacatcccttctgtttgcatcacattggctaaatgttagtcacatggccacacctgtctgtaagttattgccaaatagaacgtagggaaaatgggtattgaggacaattgttcatcaaggtggttaagaatatcaaatgtatagtttgaagtgttggagaaaattggaaattcacttggatctttttctcctcttaatatctttggaaagatgcacatacaggaagcctctgaaccccatgctacaaaagaaataggtagtgttggaggagattcaactctagacaatgaagttggcatctgtggtggtttatgaatcaaccctgtacctgcaaagggttttcacatctggggctgggtggtaaatcatagggtgctctgaacagatctttaagtattgggctattcacaaaacagaagcaaacaatgtgcagatgcctccccccatgaggagtagctgcctatttgaatctctcactggatggtaatggaaatgatcagttgggttcacttggtagggtactccttagaaatagctaatgaggtttcttattgtcttagtctgttttttgtttctataacagaataccacagttagcttcatagttctggaggctgggaataccaagagcatggtgccagtatctgaggaaggtcatcccatggcagaaggcagaaggcagaagtgattgattacatgaaacatagaggcaccaggggctgaacttactctacaacaacccactcttcaaataactagcccactcctacaataacaacattaatccattcacaacccaaattacctgttattggaccccacctcccaacaaggttgcattggaaattaagtttccaacacatgaattttgggggaacacattcaaaccataacatttactctgaacttcacaaagaccacaaaagaattagttgataaagaatgagctaaatagttgactaaatggtttagcaatcataaatataaagcagcataactattgtgttaaaagcattactatgaggcagatatagcaacagcatcagcctgatctaaccaaacaatgccatctcagtaggatactggtgaagccattccctaggagaaggtggcgtgcgtcataggtgtttgctggactttcttctgccttattcctggttcagagaaactcagtgatccatttttcatcccactccaaagcagatcagatggttgtcttgcttgtatcagagctaatgcttccgtggggagagctctctgtttctgcctgcaagtgctcacagttcggttgtttcagccagcaccaacatttgtttcttagatctaaaagtagccctattcctgtctgctttatatattggagttctgagtatacttttgtttaacaaaatgtgttctattacgtaaagaaaaaaaaagattgatagctattagcttaggaggcttctagaactcagtgcacagccagctcttgctctctcatatatttttacaaatatcttcaagaaacaaatggcctttccactggctcttgagggataattttaataatatatttgcagaaatatttgaaatggaataagggtattatgactgtagacttcacttatttattgttgaatcttgtagcttctgtattaaaaagaaagaaaaaacacttttattgaagacagtatgtcagaaaaaacatggattttttttttttactcaaaaagacttgtgtttaaatataatttgtgccacttattagctctgtgatcttaggcaaaatattgagatctctgagtctccattttttcatgtataaaataaaaataataacaattcctgtaatatactgctattataaggatagttagctaatttatgtgaagtgccaagcacagtgcctaatagtatttgtaactactatttattgaacccttactatgtggcagacactgtctaggtcaatggttctcccttggggacttgttagaactgcaaattctttatcaggccccagcctacacctactgaatcagaaaccctgggggtagggctcagccgtctgttttataagccctcctggtgattctgatacacactaaagtttgcaaaccactgttctgagtgtccaagaaattgaatgtatgattatcatattcatattacactacagctaataatttgtgctgaaacaaatatagatatgtcctcttctattttgtttgatgacagccctagatttttcccaccttagtcatatctgtgaccattccttacaaggagataggcgacctggaaaacccaaatatcatacctccttctccctcccgagtcctctcttcctcccctagcgggtctgcatcctgtctgtgtcaagcagtttatgaaatacctggtgagaactcagccactccagaaagaatgaatagctcctcctgaatgcagctccagcacctggagtcagtatctccctgacttgccattatgtgttcccattggtccccctgataaaatatgatctccctgagggcaggaacaacatcctaatgatttctgtgtccccagcacccagtacacttaatagacacctaataaatgagtggtgaatgaatgaagtgtcagccccaaatcagagggacatttgttcctggagcattcaggtgttaggcataccctagcagccagtatatttctagtcatggtgacaagtaggcaacgggattgcctagagacccatgaaatgttatctgagccatgtcttcattcatccataggatcagttctgtgccacaaggaaagctgtgtgacagtctcatggcagatcagacccacattaggaacagcctagaaaagcaaactgcaaatatccatttcttttctctgtcataatttgttttcccagttgctggcgaggttgaaattagctctgtctgttgacaatttggatacaataacctttctgtttcgtgaattctgaacagtgaaggactgaattctgctctgggctgcagaaaaataacaaagcactcagtaggatagatgggaatggagcacggacttagctgaggaagaatttggccctgctctggagctctctttgaatttattattcctgccttccatgtcttttcatgctaggtgggtgtagaaagccatcctgctcaccactttgtcccccacccactgccacctatgctgtcagccattcatctaacccacttagaagaaccagaatgaatatagatttcttctttcacacattaatttatggagccttcctatttcttctcattgcaatgttcctacctgctgcagtcacattcaattttattgaaaagcagcagggaattcatcctttgctggaaaactttgacaattaaattcaaactataaggaaaaagttatcctagtttcagtctctctttaaatcaaagtgtagacagtatgtagtgggttatggtgaaaggcccccataatgaggagagcaggtaccctctaagagttgaggggaaaaatcgatgcagatgatatgagttaaaccacatacagaagtgaccctgagatctggattttaagtggatgatggccaaattccaatcacaactggtatgaatcctctaaagttgaatgtttgtcataaaactgccacctatttgggtcatattgtagcctgcttgaagaaagatctaactaggagagggtggtctgcatgacctctagaaagacaggagtttgtcggggtcttctgtgcagtccaagaagatagcatgaccagatgacatgatgtgtttatctgcaagccagatctattcccataatgggaggtaaatgcatttgacttagatagctccatgatgtccataaaaaccattcagctaaatacctttgcttcaactctgtgcttcccaggcaatattccattaagattatggcttatcatgaagactttcctccaacccaggcaacatggtgaaaccccatctctacaaaaagtacaaaaattagctgggcgtgatggtgtgcatctgaagtcccagctactcaggaggctgaggtgggaggattgcttgagcccaagaggtggaggttgcggtgagccgagattgtaccactgcactccagcctgggcaacagagtgagcacttggatcaaaaaaaaaaaaaaaaaaaactttcctacatatggaggctgtgttgccccacgcccataagtttacataaagtccacttggcattcctgtttctcactgttgggcatgtcttctacatcttgaaagtttgggtagtgtgagccagttcctctggttgaacccttctgcacataccatcaaattcaagatctggaccaggaaataataggaccacactccggacatggttcagtaaacatcctaggtaacaaaactcttgaattcaactgtgagaaggtgatttttcttccctatctctgtcttcagaagaccagcgttaaagttgactgataatcacagccttttttaaaaaaattcttactaaggtgacattgttaggctgttttgggcaatcctttgaagtggtttttcctcccaaattttctaatttttgttcattatatatttgaaaagaaattcaaattgcctgataatagaaaatgaaaacatgacaagctataaactctgaccttaaaagcatctctaatatagcatcataaaatataattagaaatccatttcaacatcacattacagatctatgacttacaggtaatttctgtcatttaaatatgagggtgagctgatggctgaattggattcttaggagaaaaacaatttcttctgcattaggagttattagtttaattgaataatatctggatcatactggtggtaatgttaatgttattacccattatcttggtgatggtcacaccactgtttccaggaaaaatatagcccattaactgaacagaaggattaaaataggaacaaagtggcaagcttttcatggcttattatgccagggtcaggacaaaggaatggccctgaccttgaaatgggacagaggacccagcctgagctaaatgcctcaaagaattccaagggaagtcctttcaggcatgacagagtgcatttggtttcctcagcatgtcgttctgaacatttctactcattaatttattcatttattcacttactcgttcattcattcaaccagcccattcatttattcaaccaacatattttgtgcatcctcctgaaaccatgaatggtgatagatcatggagagacaaagatgacttagtcaaggagagagggtcaaggcttattgagaacctgctgtatctcagacattataatgggagatttcagacaatatctgttttattcttctcgagaattcagaaggtaggtagagttgttatacccattttatacatgaagaaactgaggttcagacaggtaaaatgacttgtccaaggcctagaaagggaaggagtcagaactcaaacctaggcctgtcttaattcaaggcctaggctatttctactacacctggaatttggacttagaacataaacacatttttaaaacattataatacagtgtgatgaatgggatacacagtcatataaagcaagacagctgccacggcgaaagccagatttccactctaagtgactcatccgacgtttttaggtaataggaaatgtctaggtggccctaatatgtcctccaaatctcttcttcatcctcagccccacacccagctctccctccatctccttcttatcaatggggggttctctgctccccccatcttcacaagcgaagggcatttgttcttccacaccccacatgatgcagggcaagaggaaaggtcaggctccacctcattctcatcacctcctcacctctcattagaaccgtgatcctgtgagcctcctaatgcccagccattaactagcatctgtcctcctggtctctgctacctaccagccttctggtcactcccagccctcagtgaagatgttggccctgggatcactgtcttatccaacccaagtagctcttcctgggactaggaccactttcagctgctgtgaatactggagtcatgttggcaccatgagatattttatcatcctatgaactcatttgggaactcaatgacaggtgatacaatggcctaagcccatttcaaagagtatttctgacaaagctttgtgtaagtacaaaaaaaattttcagaccatgctttttcccattataacatttcataatctcttccttgttttgtccctgcacctctacctccattaaccaggtctcatcaagttgtgacataagccaggtttcatcaagttgtgacaggtgacagaggcgtcacatgacaggggacctgattaggaaatccatatcctcataggatgcactttaacatcttcttgagctgtcttgatattttgagacatacggcaaagattccatatactgttccagtgaccagtgaccttgagaacatatttaaaactatagatttctgtgccccacccagagatcccaattcagtagcgctgaggtgggatctgaacatgagtagacttagaaagcctctagctgattctgaagcacagctagtttggggagcactgacatatagccactgcccatgaacctggatgttcctaaatcttgataccaattgagtgacttgaatcctccctcatctgtatgtataccatcatcaggtcggaaaaatacctccagcttccagcttaaggttgccctctcctttcccaccaccagtaacatgctagtaaacatttaacaataggctctcagaaagaaaaaaaattaagccctgatttataatgtttgccagtttccatggtgtaaatactctcaccagggccaatttccagctaccaatgtgatgccactgaacgtagaggtgggaaaagatgcatgtaattaacattccttagacagaagtcagctccagcacatcactgtcccacccatcctttactgattcccaaagatcaaacaaactacacccaagaaacagaggggtctctctcagatcctacagcacagccagagcctctcagaagtaaggttgtctccattttttaaaaagctctggcatattaaaaagtggaaaagtgggccgagcatggtggctcatgcctataatcccagcactttgggaggctgaggcgggtggatcacttgaggttaggagttcgagaccagcctgcccaacatggtgaaaccccttctctactaaaaatacaaaaattagccagtgtggtggcacatgcctgtgatcccagctacttaggaggctgaagtaggagaattgcttaaacccagaaggcggaggttgcagtgagccaagattacaccactgcactccagcctgggcgatagagtaagaccctgtctcataaataaataaatagtggaaaaagtgctactgcaagattggcaaaattggggtaacgctttaacaccaaaatacgatgcaataaaattgtattaatctcaagattatttataagaattataaaaatattcatttatacttcaccataaatggggtcaattggtagcaggacatgtggaaagccgtaagatgaatgtcattcggttctgtcggtgtatctctgtgactctggagaaaatgccagactctttatctgaggcttttgtgagtgtgaaaactggggcataccccctcaccactccgaatcctgtctccacccttctacctcccaccctcacgccctccccttcaatccatgagagaccctggacatagttttctccctcctaccttctgttctttgcctctcaagaatttccaaagctaggtgccctgccactgggtcttatctgggtcacaaaatagccaagtgacaagaattaaatgtaacaagaaaacactggggggtccaggtcccttctgcaccactgaggacctgcagttagttactgatgacgggctcttttatctggctccagtctggcaagagatctggtggagaattctttctggctttcattttccttatttctctgagccatttctggcaggaatgttataagcaaatcaaattttgatcagttgaagactatttgaagactctaggagctgctgctgattcattcatttattaaacaaacatttatttaatacctcccttgtgccaaatcctgtactagacagtggggaagagggatagagagaggagatgaagagcacacagttcctccccttgaagcacggagagtggaggaaatggatacatgatatgtaagggggtaacagcagtccctgaggcagatcccatgacagggtgcaacgtagggtaccttggaagcacagaggaagggtggctaagctaaaccaagcggtcaggaaagccttgaactgcattctcaaggacaagtaggcattacctaggtgagaaagggttaaaaggattaaaagggagatggtagtttatgcaaagaagcttaaaaaaaacaaaagctatgtggttcgggaaactgcaagtagaatatctttgatatggaggaccctgggttcagaggctggttcctttgcttattagctgcatgaatgggactgaatttagcttctctaagctgcagtttcctcagcaggaaaccccaccttaaaggactgttagtatgcagatgagataatgcatgtagcactctcatatctagcatagaggccatacccagtacttgacagcttggtgatgaggatgaagatgaggatggtggtggctggcataaaggatacacataagggtgaaagactgagggagatatgaggccggagaagtaggtggggccaaagggtgagcccttgggctccatgctgaacaaaattgggctttacccctaaagccaaaggaagaatttcaagagtggagtagcctgatcaagtgtctgttttagaaagttctgtctgatggactgggtgcagggagtaaaacgggaggcaggaactgattttggaggctcttgcactaatgtaaagacagtgaaggcaatagacatggcacggatggagtgacggaagcctctccagggtgtggctgagggcgccattcctttatgatttctcaggctatggatgtgaattttcctaagccaggtctgctcactcacagcagggcccagctgcatggaggaatatagaatccagggtattatcattagaattaagctgcttcgttgagtccataaatgtcacactcgggcataccagcatgtctttttttctggcttacaatgtaaaaagtaacaatggttatctgtgggtagtgggattatgaattgtttttatattattccttttgcctgtgtctattttctaagtgttctacaaagaacatattttgtatacggaaaaatttattataaaaatgtttttttaaaaaaacaaaactatacatagtttcgatccaaacagcatcctctctccttactgcctgagtaaggaaatgcttgattgaattagaaatgggaggggaggttgttgataggatccaacttcaaacttctaagctatttattttcttccttttgctttggagattgtgctgtgccaatgaagatagactgaagacgtgaatagtcttgagtttgaaaaataatcgtcgtttttattgttacagcttcaggcatggattatttccatcatttatatttcaggaaacctcaagtacagcaaaattgcccaatagttagagaagatcggattattgatactctctttttaaagaaaataaaatatcttatcagagagaagtccaagtgacaataatatcaccatacgtctacagggttgcaaaagtaaggagttgaaaggaagctctggtttaagtacgtgatgtttaagagaactgcagacaggggtctaacagctgagatttttcagcaccatgttctaaagcactttcttgctgggcctaaatcaaatgtttgtctatataatgtcttagacattgtatgcatcatcgggccatcttcctaaaaggtggcattttgattacaatcttcaatttggatttttaaaaatttgtaataccagtaatgataaatagtgcacatagttgtatggttcataaagtgttctaacatttaatctttacaactctaagtgtttgagttcactttagtccattttagagatgaagaaggtaaggctcatagaagcttactgactggcctgagatcacacagctaggaagtagagagagaggattcagatcaagctcttcggacttgaataggaatgccctttacactgctcccttctaatgacaggttttagttacagatgcctctttacccaccatggggttacttcccagtgaacccactggaagctgaaaatatcctaagtggaaaactgacattttttaaaacataatgggatgtgaaaacacaaaatacaatatccaaaaaatgctggcaacacagtacactgtacagtatcggttgtttacccttgtgatcgagtggttgactgggagctgtggttcactgttgctgtccagcaccacaagagtatcatatcacaaattgctagcctcagaaaaggtcaaaattcgacgtacaatttttactgaatgcatatagctttcacatcatcataaagtcaaaaaattgttaagccaaactatcttaagtcagggactgtctgccttttattttcattagactcactaatcaaaaaggcaagcagggcccataggaattatatccattcctgttgctgttgtaacaaattacccacaaatctggtgccttggggtaacacaaattggttctcttacagttctggaggttagaagtccaaaatgagtcttacagggctgaagtcaagatacaagcagcgctggttccttcgggaggctccattgcacagtcagtggctgccagtcttccttggcttgtggccacatcattccaatctctgcttccattatcacagtaccttcccctctcctttagtcaaatctccctgtgcctctgtcttgtaaagacacttatatttagggcctaccctgataatccaggacaatctccccatctcaagatcattaacaatatctgcaaggcctttgtggacatataatgaagcattcacaggatccagggatcaggatgtagatattttggggggccgttactcagcttaccatggcaatattcgtttcattcatttatttagttattatttagttatttttgtagagacgcagtgtcactatgttgcccaggctggtctcaatctcctggcctcaagtgatccatctactcagcctcccaaatagcagggacttcaggcacaagccactacacccagctttatttcatttattaagtggtccctaaatgtaagattccctgaatttaaatttaggccatagctcttcacagttttctattttaacctttcacttttgtgtgccttgaggccttagtatttgtttgcttgcttgctggctggcttttaagcaaatttaactctgactttctattgaaaataactcacccaaaacccctcctcctgctctctgtcagggatggatgcagaccactgactttttccaggccaggcttggaaagggcttacagagaggtgcattctttattgttcggcctctcctaactactgccatttattgagcacttaatatgtgtcagaaactttgaaatcattctacatttatttacagctcatttgtaccttggaacaggcctgtaaggtagattattatccccattttaccaatgagaaaatcaaggctcaaagagttaagtaacattcccagggttacacagttaagccacagaccctccaaaacccagcctcttaataccatgcttttgcaaaattaaataattcccaaacctgcgtaatgtatagatctcttttaaagggcaaatacaagctcacaaacacccaaggttgagttataaggattttcattatcatattatttaaatatgtgcaaagataaccagatatgaactccttatgcttatagctctcttaagatgataaaaacaaaatagtgatactaataataacacaaataaaactgcaaacactttaaatgctaattaagaacattgctttaatgtgatgggtgatgctgttttgctgaaattaaatgactgctcacaatctcgatgcaatgctgaccctcgtagcctgggtccttccgagtttggtatgcatacaccagggccctttgggctaactcagttctcccactgttcttccaaccactgacaacacattgttcaggcagcagcacacgtatcctttgggctttacctagtcaaaatgtctttgatttgttaactctgctttccttttagaacccactctctttagcagctgggttctctgggaaggagacctgcatcaagattagagtgcaggaagttaccaaagaatgttcttgggaaccacagctgtgggaggcaggggaaggaagcaggatgtgcagagggagaagttgagctgtgtcgcaggcccaacaaagacctctaccaaccaactcactgggctgggtggctcttcagagttgtcctgccttggggacaagagcactgacctttgtgcccctggaggatcactggatgagggtcaccctggaaggaagtttgacctcacattaggctgtgttatctagccaatgccaaagaactgacagctaagagcaaccttttaccatcatccctgcagctgggaagtaagtccttcactcctgaagagagatctggacagagcgtcacattgtcttccacactaacgcacaataaagttgtatagggcaaccgtgagatgtgaaaacaaatgcatcccagccactgaactgcctggtgatgcttgactagatctttgagatgatccttaatatgtacacaatctattattttattctcacaaaaatataaatataaatgtttaaattcccacagagaactaagaagactctaacaacatatttacaggcccctagaggtcttcagaacctactccaagaaagaggaaggttaggaagcttccaccccagttacctctgctgggaattgctgcatatacctgtgatatctccgtggtgtgacaatcacaaagttttacgaatacttctttgggtggcagtaatcatgatggacagatcctctcacaattcacatgtaatatttgggaataaaaacttgattgaacattcattcaacatatttgatcaggcacatactatgacgtgggtactttgctagacacctggtggggaagatacctttatacgagtgaacaaataatcatggacaaagaggatctgagagtcttgggtcatcagtaagccttttcagaagaggagtggcttgaggggacaagggcaggagcattccagacagaaggatccaatgcaaaagcatgagcctttggtgcgtgggcatgacaggtgatgtaggagatttggtcaaaaggtgggtcaggcagtagtgagaggtcgcactgacagaagcggagtggagagcctgccagtatgattaagtcatcagaggcacccccttcattactattcacctggccctgactgataccgtctcatttaacctccatgcactgtgattaacccagtagggaacaagctccacaagggcagtctgtctggtctactgccctgtgacgggagcccagcacagtgtccgacccagaaaggagctcattaacatgtgttttacagacaaagagtcaggttcagagaggacagcactttccccaaacttgcgcagcatataagtgaccaagccaagagctgaaccctcggtctgcctattccaccataccgctcttcaattcctgctccgtgagccacgaaaataactaaaagagcgttttcacagtcagagaaacttctgttaccatgggaaacctggaagagaggccagcctgtgtgtgtgtgtctgtctgtctgtctgtgtgtccgtgtgtgtgtgtgtgtgtgtgtgtgtgtgtgtgtgtgttctcaaattcctagaacggacaccctttagtgtctgccacaacacaaaatttctcctgtcatctcccaagtctctccccaaacctcaaatatgtggggtactcgagaatgaaaagggttaacctttcacagcttaggagagctgttactttgcatttaaatagccgcatttaagaaagcagcattcccaggatccttatttgatactaatgtgctgaacaccttaaagcacacttacttctcccccattcgggtcacttggagcttcattacttaataatttgaaagctttttatggaaatcagttgataaagggagatgatgaagtgaaatgttattacatttaaagacccagcaaactaggctgccagaataacacctgcgtcagacatttctaagtaaagaaagagaaggagaaggagatattggtgtgtggatgaattctcatttcttttgaaactgccgttactttaaagatactccttgcctaacaaagcctaacactctttaaaattgtcaagtgaagaactcatcagctatcttatgaattctacccctgccatggcgctctgtccccctgcccaccttcccagccgctgccttggcttcaagcccattgggtctagaggtccgccctactctcctccacaggcagggtcagcctcacacagtgcccacctcaaaagccttcatgactaaccagttgagaaaaccctgggaaacaggcttggatgcgaccttttctttttactttccatttttctttctctctctctttccttccttccttccttccttcattttttcgtggtggtggtgagacagggtctcactctgtcacccagactagggtgcagtggcacaatcacagctcactgcagccttgacttcctgagctcaagcgatcctcccacctcagcctcctgagtagctgagtagctgggactacaggcatgtgccaccacacccagctaatttattttttatgttttatttgtattatttgtagagatgaagtctcactctgttgcccaggctggtctcgaattcttggattcaagcagtcttcttgccttagccttccaaagtgctgggattacaggcatgagccactgtgcccagccgccactttttttcttttttttctttttttttttttatttgagatggagtctcactctgtcacccaggcttgagagcagtggcatgatcacagctcactgcaaccttcacctcccaggttcaagcaattctcctgcctcagcctccggagtagctgggactacaggcgcatgccaccacgcctggctaattttttgtatttttagtagagacagggttttaccgtgttagccaggatggtctcgatctcctgaccgcgtgatccacctgccttggcctcccaaagtgctgggattacaggtgtaagccaccacacctggccccagcctccatttttttaatggcaatatattcacatggtttgaaaatcaaaagatatataataaggttacacagtgacaatcctcagccttttgcttgctccctggttacctagttcccttctcctgaggcaactgatttttgtaatgttcttatatatccttccagagatactttatgcaactagaaatatatacacacacaattttctttatccttaccacccctctccacaaaggtaaatagattacacaaatagattactatacaaactgtactgtagtttgcttttaacatttaatatatcttacagatactcttacttgtgacatgacttttttaatggtgaatccaaagactatacagcaatgtctaaaaaaaaaagattcaaaagtatatacgtgtgtgtgtgtgtgagttttgtgcataagttatgatgtcaactatgacaaacaaatgaatattgcaattgatgaaagctgctgggtaaggatggtgggattatagggtcattctttttgtttctctctcctcctacgccgtgtgtgtgtgtgtgtgtttgtctctgtgtgtgtggccaaaacatggttatgtttttaaattctaaagaccttatttcagtatgtgaggtatattttcattttggtagagttctttcctggccctttcatatgcatcagcatctgtttcttaaaatacttgagtcactttattggtgaaggcttcctccaccactctaaaattgcagcataactctctcaccccatcctggccctccccctcacccttcccggctatattttccccggagagctaatcagcactggacacactgtgtagctgttatgtctgcctcctcctccggaatgtaagctccttgaggacaaggatgggtgtgtcttctgttcagggctcattctccagcacgtggaataggcctggcacagactaggggctccatctatcattgctggatgaatgagtcctcaccatcagccccagcaacccaacccacatgctctctggctcatgcctgtaaccactaaccagagcacctgcagataaccagtaaccagagcatctgcagctctgtcctctgcttcccttttccctccccactctggcaactctggaagaccactcctccctcccaggtctggatctcaccttagggatccattcctgcaagtgcaccctccctctctcctgcaatatgagcttatcttctatattggattatacacttggacatacaaacttgccctcatatcacacatctttcaaaaaataatcacatgtccttcctgctactgccatttttctcaactccacagccgacttctcaaaaagcgctgtctgggcttgctggttccgctaattcacctctgtctttcctgaacctgcttccattgtattttcagtagtggccagtggggcagcggcggcagcagtgagcacatggcagggggggcagtagggcagcagtaaacagaggccgcagaggtagtggggtaagcacagggtttctgaagaggccctgggcaggtcctggtgtcctcctatctctctggccattataccttagtctgctttgctctcccccatcctctcctctgcctccattcactccccaggtaatctatcctgtggttttaactaccagtctctatgctgatgacttggagtttacgtctccagcctggacttctccgttgagctccggcctcatatatctaccttcctacatgacacctccttttggagtcatccttgacccctctttgttttatacctcacatccaatccatcagcagataacgctgagccgacctgtaaaatatatctgcatcccatgccttgaaccccttccattgctcttccctggccctatgtcgccagacacagcaatggcctcctgcctggggtccttgctccccagcttgccccactccagttactttccctgagcagccagcaggatcctttaaaaatatgaatcaggtcataccactcttctgctcacaaacccctcagccatgttccagtcccatcacactctgaacaacagcccctaaaccctctgggagggcagccaaggccagagacttcctctagcttattattaactaattgtttaattaactaattcattatttatcccttaaatattccctgcatacctctcacaagccaggctggtgctgaggatatagaagggatgcaatgcggcccctgctctaatgctggcttctgggacgggacctgccctgggatggcagtggggatgggaatcatggttgaggagtgtccaacactgtttctttttctttttttttttttttttttttgagatggagttctgccctcgtcgcccagtctggagtgcaatggtacaatctcagctcactgcgacctctgcctcctgagttcaagcaattcccctgcctcagcctcccaagtagctgggattacaggtgcccgccaccatgcccagctaatttttgtacttttagagatggggtttcaccatgttggccaggctggtctcaaactcctgacctcaggtgatccatcaaccttggcctcccaaagtgctgggattacagtgtgagccaaagcacccgacccccagtgctgtttcttgaagactacaggatgtgttcccatggggtagggttaggggtgctgaaaggggcactacccttacaggttgaggcacctccagtcagatctggcctggatcatgggctgggcttcctcacagccctttctgtttgaaggcagacagcccttgcttgatgttctctcctgtttggatttggcatcacctacgtgatgttcgaataccttctgctgtggcccccttttcccttctttgctctggccttggcactaaggtttttctgactgctgaaggtcaggtagaagatggggaggcggaccacggaagagcaggtcctgggggctggtgggatgggaggcaggcatgccccatcagcctcttctgctcctttgctcactgattttactcaggggagcagcagacttgtgtgagcactaaaaagaacataataaaaatgcagaaaatgaggttaaatccaggatggtacttcagttaccaaaggacaagctaagtaaatgccgatggccagtgccagcacacagaaggtcatagggtgatgtgagtcctcagagctcccacccaccggaggcagcccttgggcggaggggcagtggggcaggcccggaacagctctgatggtcccttcctctctggcttcagaaatgccaagctgcttccacaaaaccatctcaggggaaaatcattatctacggacattatgcaattttcccatcgaaattacaagctgtgtttgaaaagaaataaaaagaaattgaatttgaaatgcttctgtgcaaacgcatcatcttctagtggatctgctaatgggcttcagatactttctcttgctctaaaatagttgatcagacagcagcttgtgatggtggctgcttcccggggaacggggcatagaatgagcacttatgaacggccagccagcccacctgagccaggttcagaacctgtgagctctgaccacggttcccaaagtggtcactgtatgctgtcccttcccctcctctacctggcagtgctggcacggctctatgctgggactctcactgctcctccagcgcctccagctgacacccaggtcgatgagtgtcacttcacactgcgctggctccatcctaggtccagggagtgcccacggactgggcctcggaggacaccagccccttcctcatcacagcctctcattcacccaacaagtattagttaagcgtgttcccaacacagatctaaacactgatagtacagcagtgagcaaaacagacaaacaccctcgccctcttggagcttccattctagcagggggagatagacaataaaaagtaaataaggcaggacatggtggctcacgcctgtaatcccaacactttgggaggctgaggcaagcagatggcttgagcccaggagtgtgaggccagcctgagcaacaaagcaagaccccatctctacaactaattttaaaactaactgggcatggtggtaggcacctgtagtcccagctatttggtatgctgagggtagaaggatggcttgagcccaggaggtcattctacagtgagccatgattatgcccctgtactccagcctaggcaacagagaaagaccctgcctcaaaaaaaaaaaaaaaaaaaaaaaaaaaaagtaagcaaaatgcacagtcaactggacaatggcaaatgttatgaagaaaagatagtgggataaaggaatagggatgctgagtcaaaaagggggcagggacctgccatggacatcaaagtcctcactgagaagttgacatttgagcaaagacctggaggaaacaaaggagagagtgctctggtatctgggagaacagcattccaggcacagggaacagcaagtgcaaggtgtgcctggcatgtttaaagatacataagaagtccaggatgccgaaacccaggttgtggaagagtagtaagagatgaggctcaggaggacaggcagaccatggagggtgtgggggaccagagcaaggtcctgtctgctgtgagatgcaaagccactggaggattttggccagaggaatggcatgatatgactgctgcacgaacaagagtctggaggaagggaggggaggtagagagacctgctaggaagcaactgcactcatctagctgagcgatgatggtggcttggatcaggatggaggcaggcaggagacggaaagtggttggatcatgaagatattttggaagtggagttgacagggtgtgccgatggatcagttgcagggtgggagagaaagaggcatccagggtggatggaactgaaagtacggcattgccatgtaatgggatgggaagaatgaaggaggctgggcttagggaggggaagatcaggagtttggtttcaggcacgttgttgagtttgagatgccacttagatacccagatgaaaatgttgagtggctgatatgcaagtctagagtcagaggctagtttgcaatagaagattacagcttaggaatcatcagcatatacacagttggctttttaaggcaggggactaaatgaaatcaccaagggagtgtggataaaagagaagaccaaaggcttgagccctggggcacttcaagctttagaggaaagtgaataggagtcagcgagggagactgagaaggaagagttgatgaagtggaaagaaaatcagaggcagcaagtcccagagccaaggagaaagcttttcaaggcagagggagtgagtgaccagctgtgtcaaatactgctgaggggtcacaagagctgagagctgggcactgactttggctttggcacggagaggtcactggtgaccttgacgggagcagtgagtctgctgtcagaggagaggtgagtctcagttgcctcacctgagaaatggggacaccctcctgccttcctcagagagcagcagtgcagaccatgggcaaactgcaaagtgccaccaaatatgagctgttttatttatgacctgagaagcccagaggctgttgaaatgaggggaggctactgttgggcacaattggttttaaagatgcttacagccccgttatcacctcataaaatggctcatttcttgctactcatcaccagaacactcacccaggcatgaaaaagttaccttcagaggtagaagctgtcaggatggatattttttgtgcatggcaactgggaaagagaaaaagcaaataatggggccaaatagtgctcaccggggtctccacgcaagattccagacactgctctcccagagggaaccccagtgatcctgtgcctcaaagcaagggctccttggagaaagccaccaaccagggtcagctgtgctctcactgcaaaatgagcaacatgggggagggaggagagaaggatggagaagaaggacagtcagggaaagtggaaagaatgtgagtttggagtcagatacacatgcgttggaatcgtggttcctgtgtggtcagcaaatgacctgactcctctgagccacagcttcctcatctgcagtggacagcgtgatagctatttccaaagctttctgtaagaaacaagctgttgaatgggggaatgcacactgtgtgtgtggctgcgtatcactgcatttgcaattagtggcactgggttttcccctgtttagtagcagacagtttttcttcagcccaaggagcctgtgccttcccggcttcatcaaaccggtcgtcagaacagcagtaactttcagtgttgtgaacatggtctgatattcttccacgtgtggctgtgatatgcagaactgaaagtaggctaggacatgcccttaagagcagcagaagtaggaggggtgggcctggttctcctgggccacagtgtgcactttcaggccccatctgcctgggttcatggtggcaacgggtgtggcctctagaatcagactgaggtctaaactctagctcagccagttaactaactgtgaaactaatttggccaaataaatgtgtttctgaggattaaaacgtatatatccaccttgcaaatgtgttgtaaggattaaatcagatgctgtctattaggcaatttgcaaggttagcaagatgcttagcacataaaaaataaataattattgttttattattgttgctgtttccacctgtttctattcctttccctctctgatcatggattgcatcccatttctcttcctgtggggaggagagatggtaggggcatcaggcaagttggccaggctgactccacactgaggtctgagcctcagtgctaccagcagcaaaggaatgtttaggatgaggaaatggcttgtggttcaggactggaagacaaagtcaaaaagttaggaagaaaggggcagggggatgtgacagactctggccttctgctgtgggcacagctgggatgtgtggagctcttcctcattgggtggctggctctggagtgcagaggagggtcagcgtggggtaagattggttcagacaccagccccgaccctagactcacagtcttactttctgttctgctcagaccaccctgtttatctcctggtattgatgtaattgctgcctccagaacagatctgtcccagatctgttttcattccacatgaacccgcttccctccagacctgacctcagcccatggcctgttaggggatatgctcttcccatttggtaccagtaactgtgaggtacaagtacagctgttgtatccccacaatatgcttacaaaagcaaaatggaagatgaatatgagtgacctgtagtatctttgggttttttcctattttaattggtatgtctttagaaaagtgttggcatcatccaaatgaaccatgaacgatggatgccctgagacactttgtttgaaaagggtcctgtgggagctgagaaggggctctaagtattcttgaaagttcctgtctgtgccttagagacttgttaaaataagcttttcatttaagtctgaagtgtgggttgcttactctgaatttaagtccttcattcttcagaatgtgaaatgcccagggccctagtgcccccatccaagctacataagccttccatcatatgctccctgggactcagagcttggctttcaatggaggcaagttctcctgaggctttgtgggtttgtacctgcaactgtgtgctccagtctctgtactcaggcagcgcaagtcaattctgatatgaacttaccctgaatgtaagtaaaaataagaatgatcagtaatttttgtggagcacctgctatgtgccaggcacttcattgccacattacatgagttgtcatttagtccccctaacaagcacatgcagaagatcctctttttaccctatttcacagatgagaaaactaagagaggtcacaagacttgccaaaaaacagagtttggcagggcacggtggctcacacctgtaatcccagcactttgggaggccgaggcgggcagatcacttgagctcaggagtttaagaccaacatgggcaatgtggcgaaaccccatctctacaaaaatacaaaaattagccatgagtagtggtgcacacctgtagtcctagctactcaggaggctgaggtgggaggattgcttgagcccgggaggctgagcctgcagtgagctgagatcgtgccactgcactacaacctgggtgacaaagtgagaccctgtctcaaaaacaaaacaaaaacacagagctagtaaatggtaccattagcatatgacctcaggtatgattccagagcttatgcttctcaactatgctactttcctgcctgctggattcataaacattaaaaagatggatagtatcccgtgtgccctaaattgagaacatgggcacatacacatccttgctgggagtagaaattagtacagacatttggagggcaatttggtagggcagaccacagttttaaatttgcttcacattttgatcactcctatgactcaatgatacaggaatccttggatgtatgagcaaataaatacgtacatgagtcttcatcacagcatcatttatgaaaacaactaaatatttactaatggtgccagtggaatcaattagagaacatcccctgctacataactctctgcatacatcaaagagaatggtgtggctttgctttttcaacaatctactgagcggccgtaggcatggtgatatggccatgaatgagcaagattctctctgatccttatagaagttaagttctaccagataacttgctgcttcaacaaaaatatttagctttttaaataaatgtggtagaatgctcctgctttcttgtttcatttaactcaaatgatcaccaaaaaagagaacaataagctgttgaccctgcagatgttgtgtaaccactagatgaaaagatttacagcaggaagctgtcatgcccacacatatggtcccaccatccttggagcctccataggtctaaatggagtttcatcaccataaataaatggtaatgtaggttccaaactatacttgtggagttatacatttgatcttggccaaaaggccaagaagcaatattgtgtgtgtgtgtgtgtgtgtgtgtgtgtgtgtgtgtgtgtgtgtgtagttatatattacaaaagcaaaatcactatatcagctgggacctgtaaaccagaatttaactgtaaagcaaggtgaatctgcatggccagctaacttggcagccaccttcactccacccacattgattttattttctagtgaaatatttcttcaagagcaaacagactgtcatcagacagtatctcattaccaggatctgatatcttggatttcctttttctaagtcttgacctggcttgccataatttgaagatatccaacactttaaaaatcaaaaaagagagctaagatatatagtatatagtgtacatagtatgtagtacgtactgatggaaagtttcccgtgatatgatattaaggaaatattttaaagtcatggtacagaacaagatattcagtatgacacagatttggtgggaaagctaaatataatgcctgcacacacacacacacatccttacatgtgcatcgtagaagatctggaaagatacacaccatgctgtaatattctggaaacggagaaggagacagaaggcagggttgctgttgaagtagactgtgttcaacatttacattgtgagtttctgtgatgctaaaattttccacaatgtgtgtattattctggaattaaaaatcaaagaaaaaaaagtggagcagaactagatgatgaggaccccataagcaaaactcaggaagtaagaaattgtcatggaagttgtgaggagcctttgaagggttttggcaggagacagataccgtcagatttgcagcaagtggaggatgaattgggggaagcaagaagatactggagatggggtggccagaggggagactgtggaaggaggtgaacacaggaatcctcagcctgactggtgtcgggggtgaagggagctgctggtgtttggcacccggctcaggcacgcctgagctgtgccttcaacccaggctgggctgctggaggaggagcaggactctgaggtcagaggaagggctcagccatgaggcatatgagatgactggaggaaaaccaggtctggggagacatggagctggcactcaggagacagataggttgtgttccatatatgacttcaagataaacaacttctcggtcattcaacagatatttcttaggagggaagaagggatacactgtaaacaaataaatatatttctcagagcatgagaaatgtaactgctctgttgggaaatgctttgcctgcagacatgtgaatgttggggtgtctgtgcatcccaagatttttttcatctgatggaaagagggtaccccggggagcctgagcctaggaggaggctgcaagcttcctgggtggctcaccgccgctgccctgtccttgtgggcccttcccctcacccaggactgtctgtaggagcccagaccacgctgggtctggctaagccaacttcctctgcaccaccaccacccagcagccccttcctgcatggtaaatgggaagccatggaccagaaagctttttataacctctgggcctgagcctcagagacaccactgtcctccttcctttcagtttccatggggctgtgggattttctaggcaaggtacccaaccagggagaaggtcacaatgcattctaactgcattctaggcgcctgctgccaggcacgactctaaggactgtagccttgtcgctatgagccagccaagcaagtctcttcccctggaactcagggatctgttcagttggcaacaaagcccttccttccccagctggtgacattctggagttttccacacacaatggactattgtgtctgagcactgctgggcccaggccagggaaaggggccatacaggaccagctgactccactctagggaaagccccccaccagagctgaacttggacctgtggaggcctccagccttgcaaagatcatggcacccctcacccgcagtgtgtaattgaaaataaaaacccaaccaaacctcaaagttgagcaaaatcaacaaagttctgatttttgccctatgaagaccattcagtgctttccttcaaaatgttaattatcaaattattcctcaaaaaattactttagtttccccagttatccctaaaataactttatggtgctttattcaccatccaaagcaaaacagagccagagaacctgaggggcaccacgggtatggggccttggctttgtgctggcctcctcgtccaagggagtctgatccagcgcatgggtctcaccagcaggacaggcgttgaggggacagtcctcagggccaggtgttagccacattgcaactcctgctgacccagctggcctggagcaggccccactcagttgctggacacagagcatggctctgccctctgaaatggacatgacatgggagtctggccaaccaaggcagaatccaggccagatctctgctctagtggggaagggatgggctgagctggaaaccaaaggtgtgactcagtggcccttcagtgtccaggacatacctggacactcagtcccctctcccggtatcactgaggccccagggttcccccatcccagagagaggtggctgtacacccaggcaggaaaagccccaacagcaggtgagggagtgggggtgaatggtgtcaccaggtcaaagccctattgttcccatgagcccagctctgttcactaaatatttgtggtccttttttgcagagtgatgaggtcctcaccgtcatcaaagccaaagcccaatggccagcctggcagcctctcaacgtgtaagtaacacaagtcccttgcctggcctgtcttatcctagccccttctcaaagccacctacctaatggccaccacataccagttatgctgttgaagttagcactacttctcagttaacaagcaggcaagatgctttctatgtgcagagcatcacacctgccccatcttctcaaggatgcaggctcaggctctgttttcccccaatggctttaataccacagccagatgtgatggctttaataccaactcagatgggatgattaactgttctgtgttcactcatgctctcagccacaacagaccaaacatgccctcaccctcagagcacacaggtgtactcatgcttagccagtctgatgtgtggaaagccagatttaccctgggttccattctcagtcccgtttcttttctgtctcctctatcccagagagattttatctgcccttgagtcaggtgaccaagggtatgctgacagtccccaaaactacctcctgccaaatggatggatacagtggtatatccgtcaggtttttggacagctctccatggatggtccacctggaccttaaactcatcatgtccaaaatgggtcccatcaccttcaaacaaacctgctgttctccatgtggagaaatattgaaagtacagtgagtgtcaaaaccctgtggattctgccttctgggcagctcacaaatcagtccttacttgattctcctccccttccttcaagccatcaccctttctcacctggaccacgtcacctttttcctttgctgtagtctccctcagtccaattcctcatccacagttactagagtgatcttttaagaatccaaataccggccaggcgcagtggcttacgctgtaatctcagcattttaggaagccaaggcgggcagatcacgaggtcaggagatcgagaccatgctggccaacatggtgaaactcagtctctactaaaaatacaaaaattagctgggtgtggtggcacgtgtctgtaatcccagctatttgggaggctgaggcaggagaatcacttgaaccaggtaatcagaggttgcagtgagctgagatcgcaccactgcactccagcctggtgacagagcaagaatccatctcaaaaaaaaaaaaaaagaatccaaatcctccagctagcctgggcaacatggcaaaaccctgcttctactaaaaatacaaaaatctaactgggtgtggtggcgcatgcctgtagtcccacctactcaggaggctgaagtaggagcatcgcccgggtccagggagtcaagcagcagtgagccgtgatcgcaccactgcactccagcctaggtgatgggaataagactctgtctcaacaacaacaaaaaagaatccaaatctgttgtgtcctctccttcttcatccctctgtgacttcgcttagtctcaagatcaagtccacactccttagtttagcgtgcgcaggtgggcggaacacacgtcggggttcatctcttgtcctccccatgctgcacctcatacaggccaccccgaatcctgggcagttccttgaacaagctttgattttgctcatcctttaaagacgcaaggcctggagactgaccccaagaagatggtttacgaagaagccttggccagcccctctagggagtagtctacatccattaacacccgtattgaagacagcaacaatgtgaggaatgtgtgagatgctgctcagtgggagaaaaggcgaaatccacaggataggaagggaggaaagtgctggacattcaaaaggaagacgccccaggatagggcagtgggagtgagggaggaggcacactcatagctgactgcctgggagcagggaagctacggcgaggcacctgatacctgctcatttaaccattcagcaaactaatggctcatcccctactgtgcgccagccctgcacatgcagtcctagctctctggaacactcagccagagaggagacagacaacagaccaagttgggccactccaggttttccctttgcacaagtccaggcagcaccatataacctgaatatataaaatataatgtcatcatggcagccttgtatactccaaggggataaatgttagggtgaggaatggctctggagccccagagcaggggcagaaccctctcctgctgtgtggaggagggacatggggctgtgcctggaaggtgttccttgtgctggtcaggactggcccaggcttgggtggagctgaggctctgagtggaggcctgaggagggaaagagagactagcactcagacagctggcccagcgcagcccagctggctgcatggaggccttttctagcctgctgtgagctctaagccttgctctggatcctccctaaggaagctcacaccagggcaggagaaaacccacccagcccaggaaatgccttgccctccaaggagaagcaacacgaggcagggcctacccagggcactctcctggcaggtgcacctttgcccatctcatccctgtcctaccaaaaaacaaggatgtgaattcacaaaagcccttggtgccctttgcataattaacatcagttaccagtcaggtcaccctgaatctccttactctgctgtctcttcagattctcccagttccttggctcccagaacctatgtgtgaagaacccctcacttctggtcctctaagtgggcaggggatgaaaggcaggtaggggtggggagagtttgtgggtaccaatttttacaccattaaggagtctttataccagttttctcttgaggagcctgggcttaaacagatgtaaactgcaaatcaaagcacattcaggaaagagataggaagggagggagagaggaaagagagagcagtcctttttaccttcagcatccccttgggtccaagtaggcgctgacatttattatcccttttaatcctaataaccatgaggtaggtattgcaatgtccattttaccaatgaccaaactgagactcagaggtcctatgacagcaagggtggatatagaatgccaacagtacccagctgattctaatgcctgtgcttttcactataacacgatccttccaattaagtaacaattcattcattttcccatgtctaaattaatcaagacatatatacctgccaatgagccttctgattggcatgaaattaacaatgtgaccacaccaaatggtctcacacctaccccaaaacaaacaaaatcttactttcacttaccctgtatcctatcaaggaggactgaaacatccttgataggagggtccccccaaaaaaagtcctgtgaaaggtgcttagggcaactgtggtgagcacagcacagttccttatggagattacaattcagtggggagagatatttactaaatgatcacacaaataaatgtgacatgtctatgaaggaaaggcataaagtgccattaggggggttagagatagcttccccctaaaaaggcaatgaagctaagatctaaggaagcagtaggagttaactaagcaaagaagaaaacaaaggggagaacattttagaaaatctggagagaccatcatgtatctgcaaaggccctgtatgaggagggagtagagtatgtctaaggcactaaaaggctttggtctaactagatccagaaatcaaagatgagtttggtgtggggccaagccatgtaacatttgaaattttttatttgaatttttgcattaaaagtcatgagtaagaccaggtgtactggctcacacctgtaatcttaacattttgggaggtggaagcaggaggctcactcgagcccaggagtttgagaacagcctgggcaacaaagcaagacccccatctctacaaaaaattttaaaaactagccaggcgtggtggcttgtgcctgtggtctcagctacctgggaggctgaggcaggaggatcactttagccgaggaggctgaggctgcagtgaaccatgcactccagtctgggtgacagagcgagaccctgtctcaaataataatggtaaatcattgaagggttttaagcaaaagggtgacatgatcatatttgcattaaaaaataaaaagcaataacagcactcggcccctgtgtgaaagggtagatgcgggagcccagtgaggggggctacttcagaaaaccggagagaattaactgtgacttcactaggatggtggtggtggtggaaaaggagagaggtacagagatgtgtgaggcacgtaggaggtaaaatcaacaggctgtggcgataggtggagtaagggggtggagaaagagcagtcaagatgtttcccatgtgtctggctggcataatgaaagagtggtgaagccactcacaaggctgaaaacgttagatgaagttcagtgggaaagatcatgggatcagttctaagtgtaagttgttaagatgtattcaagatttccagttagaggtgttaagtacatggttggctagatagctctggaactcagggcaagaattctgcactgagatctaaaattgggagccctcaaggaatgggagacaatgccaagggcataagaataggaatcaagggcttaggactgagttccaaagatctctactattgaatgttgaggaatcttgcctgcaaaggacacagcaaaggagcagcaaagaaattggtaaggaagcttggtaccgagaaagccaggggaagaaagtgtttgaggcgggtggttggctgtgcccagtgcagccgagaaaacaagaaagatcaaggctacaggaagccctttgggtttatcgacaggaaggtcatcagtgaccttacggagaatcctttctgctgagtgatgagggggaaaaacagcccggagcaggtgagctgtgaacagagcatgaggttatggagtcagcaagtacagaccactcttctgtgaagtttgctatgaaagaagagaacctggctccaaggggatgaaagagtcaaaggagcattttttttttcttttttaagatgggagagactttctgaaaaactgaaatgaatattttgggacaccttcccacatttcacctacccctcagacttcctgaggcctccgtggaacaaaattaattgatggcaaacactcagacctcccaaacacccaaaacctctgcactcggcgctactggcttgttaagggaaaagaattttcctttgattttcccataccccagtctcccctttcctcttccaaatctcattaggaagtcaaattaggaagcctacatgcagccaagttttgttttgcagaaacagccttgcctctctttgctgagcctgcctgattgaggttaatgggattccagcctccctcgccgcccagtggaaagccagggtgacctactttgcaaggtcctgcccgttgaaactgacttgtttttcaatgatctgcatctttatccccaggaccacttctcaaaggacagccatgaatgagcaaattagctgctgacttgtttagctcaataaatcaagctgtggctccgacagcccagggtgcaggtagagacaggaaaggcagactctgaacaaaacccacatcctttcctagttcctccggtgcctaagtagaaaatgcccagatttcctacaaatcaattctgaatgtccatcatccagttcctccaattgcatctgaatgctaagaattactgggacttttacaaataacttttatttccttccttaaaatgaatcctgcaaaccactgtcaccaccttaaattattcccagccactctgccggattaacattgattagataaaggtcgtgtttgtgaggccagtggagtagagacatggtcaccttctccagaaatccaaagccatgctccccaggaggccagagatttcccttaaattgggccggaagagtcagggctctccctgcctcctgcaacacctgcacaggtccaccgatgtcctcgggatgctaaaggaagatgggctttggacagagaagcaggtggtaggtctaagcatccagatggacctggagtcctagatgcctcctggttataaacacagcgttttccaacgttgcaggaacctccctcaaacctttctccacacacacccctgcagaacttcagcctagtgaatggcttgggcgccctctcgtggccaaattgagtttttgcaactctgaaaattcagattattgaaaactcaggatgagagacaacacagcatatgagtgttttaggaaaccctcctgagtctcactggtgtggatctgtaatttaggaggggatggtaagtctctagaagcagtatcaaaatcctttcttacctcttttcttttatggtgttttggaacattttgtttggaaaagttgaatgagaagaaaatcaacctctaccaagccctgttatgtgtccctcacaatgataagcagttttctcacaataaaaccttggggtaggatgatgatgctcccatttggcagatgtagtaattgcaaagaaaggtgaggtggaagccctcatcacatagctattaaataaacagctgattcgaatccagctctgactgtcaccaatgccctgggttctttcctccacaccatgctgcctctccaaatgtagaaaaaggaaacatttctctgggtcttcatatctgatgtgaattgtctgttcataacttttctttatctagtgggatcattgtctttttctacatatttggattaactctgtagataatatagatattaacactttgtcagtcacactcaatggagacattttttgccagcatgtcatttttctctccaattcagtactgctgttttcattttacagaaggtcttcgttgatagataattcaattcttttctttataattgcttttattgtttcaaagttgaaaaaattaatatttctctagtagatctgaaagctttatttttttctatgatctggttattttctatttgactctgggtctgttttttttttttcttgtgtggtatattaaatgtgaatccagttttttttttattacagttaacttagcccaaccccacttgtcgcacaatctttcctttccccctaatttgaaaagcctattttgtatagtccttatctatagtttctgggatctccagtctgtattgctgatttatatttctatcttacctgaatatcacgctattttgtctatcatgctttatcatatactctggtatatggtatggctagatcaactctctgctagaaaacggatacaaatctaagtcccaggtagaaagatgaaaccaaattaacaaaatatatcttggaagacatggcatatacaaaagcataaaaatttttatgacagtttgaacaaattaaagcactccagtcctatctagcattttctaaggaaaactcatatagattcttattcatttaattatttttattatagaataaatactttgaagtgatgcttaattaaatttgaaggtcaaaggaaatacaagagctccatgttcatttcttagattaagtcatttacttcaacaaacatttgaagagaatccatggcatgccaagttctaagccagacattgggatatagctatgagcacggcagaaatggtcctcactctattggaacctgatgggaaaggcagatattaacaaaaaattccaaagcaagagtgagttcagcatgctatggggaggtagaataggagttctaagcaatttggggagaggtcaggaaatacctcctccaggaaatgttacataaatggggtcaaggagggattctccagtcaaggataagagaaagctgcagggcatatctgaaaatgctatcaaattgttctcaggcccttatagattcagatttactctatcacccaagataagtcagccatgtgacctcatagtcaggaattggccgccccacgtttcccacaccttgaaacacttaccagggtctagagggtatctcgcttcagctacagatttggatacaacagattgggccaaaatgcatttactgagaatgatttccacaaggccttggtctcagatggttacacccattggctgggcaggttccagggtaatgtgttagggtggcagttggtttggtttctacagctctggattagaactggttttgtccccttagattgtcattatgaatagtcacccatggggtacaggatatgaatgactaatctggccccaaatcacctacttaggaagacaggaaggcaatagatggagcggtcagtctctatgacaatggaagaggaaacctgcctcccaggggactgctggaccaccccagaggacagctgcacccaggtgccagtgctgtctgctcagcagttactagaaggcagaccagaaccccgtcctgtgagtccctaggcgaggtaatgccacacctccatagactgcaatccttgtgtgaaccaggtctttaaagaagctgctaaaatcactgacctacatgccagaaaatgcacacgtgggaaaaggaaattaaatcccctgatttgtgcctaagtagctgatgatgtcattgcaatactttagcagtttataaagacttcctaataaagcatctcatttgatcctgacagcaacactgcaggtatgtattgctagatgaagatattgagacttgaagagggtgagcaacttgcccaagatctaaagctagaagtggaggagttcaagtcatcatacgcatatttgttcagtcggcccactggacacctaggtcctggggtacagctatgaaacacagagttccttcaaggaactcccggtctaagctggggagagggaacagtgaggaagtgattacattcatggggtctggctatggagacctgcgcagagtgggaatccagcgctatgtatctgcctcagccgaaggcaagacctgcgcagagtgtgggaatccagcgctatgtatctgcctcagccgaaggcaagacctgcgcagagtgtgggaatccagcgctatgtatctgcctcagccgaaggcaagacctgcgcagagtgtgggaatccagcgctatgtacttgcctcagccgaaggcaagacctgcgcagagtgtgggaatccagcgctatgtacttgcctcagccgaaggcaagacctgcgcagagtgtgggaatccagcgctatgtacttgcctcagccgaaggcaagacctgcgcagagtgtgggaatccaacgctatgtacttgcctcagccgaaggcaagacctgcgcagagtgtgggaatccagcgctatgtacttgcctcagctgaaggcaagacctgcgcagagtgtgggaatccagcgctatgtatctgcctcagctgaaggcaggcagaaaggctgctggaagaggtgacatgacctgaggcttgaaagatgagtgggcccagcattctcaagcttgaggtgtattacaatctggagggattattaaaacaaattgctgggtcctaccccaagtctctaattcagcaaatatagggtggggctcaagaatctgtatttctaacaagttcctagaggttgctgatgctgctggtccaaggaccacacttttccaatcactgaagagcttgcccaatagatgcaagtacaagtggaacctgcagctaacctgcaggtagactggcctgtcagggcccagggagcttcttaggtagcaggtagtgtgggataagggagggggtgcatgggaggcagcaccaggaccttgtcaatcgacggatgccaaagccaaggctcaggccaggttcttctccactcctgtggcagaacctagactggcatcaggctaaaatggaaagtccattcaggaaggcttttcctcccacctgtcccctttctgatctccatacgatcctacagtacttctctcagtaacactaatggtaataagagctctagggccaggcaatgggctaagtactgtctgcaagctagctcatttgaaattcacaggaaccctttggagtagacgtatgtgatcaccattttaaagatttggacactgagacgcagaaaggtttgataatctgcccaaggacacacagctgtaacaggtgataccagagcccaaggggcccagttccccaggccccagtcgggtctgcagtcattgctttctggtgccaggtgagggcagccagaagcagctggtcccaacagagggcacagggacttccagacagctgaggcagaccagctgccagctggactgaacagaacagttggtctctggccaaggattccccatgattagcagccttggggtgcagagtcaggccaagctgccttcaagcctcagccccctcctagctgtgtctattagttcattaaccacttattcactttcatggcctctctatgagacaggataataattctaaccccacaggattgtcatgaggggaaaatgaaataatatgggactgccacccgctgtgtgctttgcgaatgtgactctttcctttccagccactctgagtggttgctgccatgtatctcacatggtcccagccactcctgagaatctgtgtgacacaaagagagaggttgaagagcggcctctgatagcttagactcaggatgttattcccagcaactgggggtgtcggccaaaggtctctgactctacagctggtccctgcttcccagctgtgagctgatgggtacagtctggcgctggacagtgcctgctattggcagccttctgagggcaatagaaacaggaagctgggggagatgacccctctgatgggaggttgaggtgcaaggatcacttgagcccagaagtttgaggcaacagtgagccatgatcacaccactgcactccagcctgggtgacagagcaagactctgtctctgaaagaaaaacaaaaagagaaactggatagggtggtagtatatggttctctccacatttgttcaatggatgggctcaggacagagaagggtataaacccacagtggccaaaggcagaattcagtgggagaccacgaatgtggatactctctgtccctctcattcttcataatccaggcagatttccctcagagtgaggaccaacccccagaactctaatataatggtctctgtatttcgtttccaggagagcagcaccttcagctgaattttccgtggacagaacgcgccatttaatgtccttcctgaccatgatgggccctagtcccgactggaacgtaggcttatctgcagaagatctgtgcaccaaggaatgtggctgggtccagaaggtggtgcaagacctgattccctgggacgctggcaccgacagcggggtgacctatgaggtgtgtgtgtgtgcctggagtggtgagtggctccttgcctacccgcttcctgagtgtcctggacacagaggggatctgtcccaggctctgtcctaggtgaactttcagtctggctggggaggctggcatggtcgcatcatcacatatggtgtaatttgggctctgggaactgtctgtgcagtggccaggagagcacggagagggaactgctaaagagcagttcccaggtgagcaggggacagcattccaaagccatgactgcaagagcgaaggtttctggacagctgggctaaggagtttgcattctgtcctgaatgtcatatttctctgatatgatctattgcattgaaatctggagccatcagaaaaccaatgggagaacaatctagaacagacatctgcaaactatggtttggaagacaaatctgccctacaatgtgatttgtcaataaagttttcaaagccagttacactcctccaagtacatattatctgcggctgttttctcactaccacagctgagttgaatattagcaacagacacaatatggttcacaaagcctaaaatatttagcatctggccctttactaaaaaagttttccaatgccgggtctattagaaagagtttgggattcaggccaacctggctcagccgtttcctagctgggatggcctctctgaaacttggcttcttcatcttagcacaatcctaccatggacatggaagaattttaaaatatagttctagaaatttctcagcacagtatgtggcatgaacacaattccataaatataaatagtagttatgcttgttaaattcctatcaaggactttgctctgatccatataacaaatggcttttgtgggttttcccaattttatttcttactctctacctctgtatgttttcttgcagtcacccaacaaacccaccattccccaggagaaaatccggcccctgaccagcctggaccatcctcagagtcctttctatgacccagagggtgggtccatcactcaagtagccagagttgtcatcgagagaatcgcacggaaggtactgggttagaacccactctggcatcgacctttcccggtaggagtgccagggagattgtacacccttctgctctagaatcatagagtcactggcagaaagcacctcaggatatggaattcctgggcctccccaggtttctaacatgcaaattatttcataagatgaaaataagcaggccaggcactgtagcccatgcctgtaatcccagccctttgggagtccaaggtgggcagatcacccgaggtcaggaattcaagaccagcctggccaacatggtgaaaccccatctctactaaaaatacaaaaattggctgggcatggtggcagggacctgtaattccagctactcgggaggctaaggcaggagaattgcttgaaccctggaggtggaggttacagtgagccaagattgcgccattgcgctccagtctgggtgacaagagcaaaactccatctcaaaaagaaaaaagaaaaaaaaagaaaatgagcaaaattaactcagcagtgaggcccagtgctcaaatgaacaatttgatccaggcaaattgctttcattgtgagttctgcaattgattactaatatctgccatgggccaggaactggggagtggtggtacccaagttatgtatttatcatccctggttagccattcctgctttcttggcatttctttctcaggcagattgtaaatgttggtccagaactttgccatggcatacgatttgtatacagaatggcgattagattttagtcctctttcaccttccccctacacattcccttctttctctcatgtgagccctccaagtaaaattcctttttcagggtgaacaatgcaatattgtacctgacaatgtcgatgatattgtagctgacctggctccagaagagaaagatgaaggtacgttgttttcttttgttgcaggtggcaacataaattgacataaccctttgagaaagcaatttgctaacctgttttaagaaccataaaccatgtgctttgacttggtaatcatatctctgaggatttctcctcaagaaataatcaaaaacaaggccaaggttaggcccaaagcataagggaattggtgaagatatgacatcagaatatatactcaacaacatcaggcctttaaaacaatcatgtaaatctcattttaatgggcttcgcaggattcagaccactctctgcttcgattctcaggccagcctatgaggcaggtgtggatacattcactttcctagcaagcaaagaaaggcccagatcctacaatcaggagggagcgacagagtcatggttcaagctcaagttttcttatgggatctggagccagacaacctggactctcagtagacatgtgatcttgggcaagaagctaacctttctgtctcagtttcctcaacagtcaaatggggataataaaagaacttgcttcatacagttgtcagaattaaatgggataaaacatgtaaggctcttagaatggtgctggtacatgatgagtactcaatgaatagcagctgctcttattcttaccatgacaactgtgtatgggatcattgggaagatgaagccatggcatgtaaataagccttgagcttttcaaaattacctacaatgagcctgcatgtgtctggaaacaatgccaagatgagggactgaaaatgagaagacgttcatgtgttgagaggaagggataataagaatcattctgcttatttagattagatatttattagcaagatgttaaactattatctttaaagggaagtggatggctgcttccatcccaggagcacccaggctcactgaagtcagtctggcagcatggcttttcttgtccccagataagctggtatggggagagggccagtggcagctcccataggttcccagggaaaacatgtcaaacactctttccagatgacacccctgaaacctgcatctactccaactggtccccatggtccgcctgcagctcctccacctgtgacaaaggcaagaggatgcgacagcgcatgctgaaagcacagctggacctcagcgtcccctgccctgacacccaggacttccagccctgcatgggccctggctgcagtgacgaaggtgaggagacaacccagaccagccaggggctggcaggagttcaggaagggagggtctgcctagcagtcagacagtgtccctggtgagggcacaaggaccctgacagtagatgtcagtggggtccaccttgggcaaactcctatctgcaacagtgtcttgagggctctgaacacagaatctctcttatatcaaaggaattcttgagattgaccaccccctccttcttttactgaagagctaacaaacatagatacaacttatgacaagttacagataacacatagcctgcttctgggccttaactccaatctcttcttaaggagcctgttaacagtcagcccagattgaatctagatccattgccctaattctgtcatttacagcccctcatctgtgttccacctcagcgtgagtcagagcactctcacttctttgtgtcaggacctttgggctgattgcagaaattctcagtctatttgcaacagtgcaaaggtcagcctttaagtataatcttgcaacacctatatcatgatggctcaagcttcaagattgcactaagctgattgctgtgcaaaggtcagctatctgcttcccaagccatgacccctttctctgcctgatagatctacgctattctgccctgatcttataggatgccataaggcaatgggaaggcactgtataggctggactggtgtatggcagggaaaaaaaccacttccaagccgaggataaagaaagcaagcttatcccatgcaggtcattaattccttggctctgcctagagggaggctcttaaacacctctcccagtgttgcactttcacgatggtttattgctagctcattttgcccacaataagcactttggaggggagtaaaccctccccgtagactaagtcattcctacaaacaggcgggaggaaagctgggactggcctgtcaacattgaagcctctttcttggggctgggactggggagctaagctgaggagctgaggtccttaacctccccttccacagggaaggattgttcctcatacaaatggattatgatttatcttaaattatatgtagattaaattatatcttatcttagatatatgcgtgtacattttttaaacaccatcctttccatacaagcatctttcgaatgtattttcatgagataaagagtaattctgagtgtcccatgcacctggaaaagaggcatttcctcttagagaactttgccagtttaaggatttagacctcttaggtgtgcagacaacctcaactgcctgactcctcttgattcccgctggcgggaagttcccaccgcgcagcctggcaggcgcccctgccaccgtgcactgctgcagcgttcactcggtgtgttgcagacggctccacctgcaccatgtccgagtggatcacctggtcgccctgcagcatctcctgcggcatgggcatgaggtcccgggagaggtatgtgaagcagttcccggaggacggctccgtgtgcacgctgcccactgaggaaacggagaagtgcacggtcaacgaggagtgctgtgagtgggggccccgggcgggcaggcgggcaagtaggtcggggaggcagcaggtgcgactccaatgccgctggcctccccagctcccagcagctgcctgatgaccgagtggggcgagtgggacgagtgcagcgccacctgcggcatgggcatgaagaagcggcaccgcatgatcaagatgaaccccgcagatggctccatgtgcaaagccgagacatcacaggcagagaagtgcatgatgccagagtgccgtgagtgagagcgggggtggacttggaggaggccactggggacaggcgtggagggccatggcatccactattaccaccataaaggtcggaggctgagcagaggaaagcatggcccatggtccttgctgggcactgctgggagccagatgagagacataggtgtgtagacatcaaccagacccagagagagtaacctccactgggggacattctaagcaatgctggggtggcaaactggtggcctctggatagagaattcacctgcagctgtgttttataggagtgtctttcttgcagtggtggggaggagggccaatacatttaggcgggacatacattacccaggtccagcccactcctcccactcctgttgtacattggacttggctgatcccataaagcatgacctcccctgctctgtgcacaaatgcatatgggcctgcccacacattagtatgcagatgtatacaggcacacaagtatatacacattctagggaattcaggacaatgtccaaaaatgcatccctgagcctctcctttagtgcctgattcttagtgagtgtgggatgtttctgtctctaggaagaccctgctaagatcctcagtggcctttctagtggggacttatgtagtcatattgctaccctcatgtcataaccatcggggggggtcagcagggagatgaaagagagtgaaaagaagagcagtaggctgctgagccacttcttgctccatagatttcactcttatttgaacccatgggccaattccactttattccaggggccaaagcaggggactcggtgtggaacactgtggggtcagggagatcaacgaaaacaaaaggaacctgttctcagtggcaaacctggttcttgatctagacaccatcccatgcttgctgtccccatggtccgagtggagtgactgcagcgtgacctgcgggaagggcatgcgaacccgacagcggatgctcaagtctctggcagaacttggagactgcaatgaggatctggagcaggtggagaagtgcatgctccctgaatgccgtaagtcctggagctcctcaaggcccatcacttctatgttcctgagtccagggagccccgaaccagccagtgctaatactgctagatcctagaataacatggtttgctggggaagagtttggggtttggctttcagtgtttgcagttacttaaacactgcagtcagtttcattaataaagtgagaatcccactaccgtctacagaacacccaaagttaaggttcctgtgaagtctaaatgacagacacatacgaaaaacagcacaaagctcaataaaccttagttctttccctcctctcccccaacaattataggcttgcctgacccatggattttccaagcattttaattctattttccctgtgaccattttaattccccatgaccagaggctggacattaaatcaatgactcctgcagactggtaagaaaaccagcaagaaaacaagccaagttctcaaaaactcaccccaccccgctccactcccagtcctgttttccaaagtctctgcgatcagctgtttatattacatgggactaatctccaagcagagcaagccagtttccttggctggtcttccaagagctgcttttttgggtggtaaaagggcaggcacactggctgtggctctggccccctccagcatgtacttgcagtcgttcatcctccctcccctagctagtaaccttcagccgatgactcagcacctctgttcctcagtttctccatctgtaaaatagcaggaaatacttcctaggttgctctgaggatgaaaccaagtaattggtccaaagtatgagcactggacatggcaaggataggccttacttaatccctgctccatgctccagctcctgggttgttttaggagactcagccatgggtggaggtaacttggaccacccactagagaaagcctggggttttcagtaactaagattggcccatggttcaggccagctcaccagagttggggccccatagccttctgacttagagtgcctggggtccactgaagtaagggagaagaaaatgaaaatttatggagcacttacagggctgggagcatctcatttaatccttacaacctaatgaaaaaaaaaataccatgatccccattttgcagataagaaagctgcctgagcttccacaggcgggataaaagaactgaaactgttgaactaaatgaggacatctaagtccaccaccctgactttggccttgcaagaccaacagagagcttggaataatttacctccctgggacacatcctgacagtcaaactgatgtgttattttcctttcacatttatgagatgctggcttagtaagaatttactggatctcgataaaccataaagcaccacttgctcctgaccctcttctctactgaatgtcccatttctggctcctgtgttttttgcatagaccaccatatatagaacacaggatgatgttgagaatgaaaagctgccagggtgtgttagaaccacaatgtccttggtattggtccacaagggtcagccgcctttagcttgttgacttgttctctccaaagagcagcagggggcttgctggccttgctctgaaaaatatcaccagtgagtttgggactgtgggaagctattctgtacttgaggctgatctgacaatattctagttcacagagcagggcaagaggctctgaacacatcctgaaagtcctccaaagccttcttgagtcatagagggagcatagaatgggtgatgacctggcaccaatcctgcctctgctgcttaccaaccacacgggctgaagtcagcctgcctctttggagcctcagtttcttcttctgtaaaatagcatgacacagcacctgctttgcatccctcataggcttgttgagatgttcaaaggagagcgtgaccatatcttgtttcagacatgtgatacactcatgcccatctgtgtcttgccagccattgactgtgagctcaccgagtggtcccagtggtcggaatgtaacaagtcatgtgggaaaggccacgtgattcgaacccggatgatccaaatggagcctcagtttggaggtgcaccctgcccagagactgtgcagcgaaaaaagtgccgcatccgaaaatgccttcgaaatccatccatccaaaagctacgctggagggaggcccgagagagccggcggagtgagcagctgaaggaagagtctgaaggggagcagttcccaggtatggctcccaagtgtcagcctgggtggtctccaggacaggcagggttctgcactgggctaagtcttggacctgtttaaaaaaaaaaaaaaaaaaaaagtcggggagagtctgcatcttctggagtcttcaggccacattttgattctttagatccaagtttgttcccaaatattgagcaagcataatttataaaggagattggcggtgggggtcatttatcaaagaacatttagataacctaattacctgccaaaaataaattttcaagcaaagaatctttaggaattacagttccttctttacacacatataaaaccaataatgtgtccaactttgctcaaagtcagttatgacttagcaacaccattcactccttgcaaagagggaaaatgatacagatgtgtcaaaggagtcttgtcttgttcatcatttagggaatgttcctgagaacctcccagaacacatcatcttccattttaagggtgtggctcagacaaggcagccgtggcctgagactttatgatttttttttgcaaggctaaccagaagtttatcagcagtgtcatgtcagccttgagttttatttccccaaataatattgatccaagctgacaaataactaatagaacaatgcaccaagtgctcagggagctgaggaatgagcatcatcttacattgactggagttcagggagatgtcagagcagggaaaactagagtgggtcttgaaaaatctagaggagtttgccacttagaaaagtacattccaggccgggcacggtggctcatgcctgtaatcccagcaccttggtaggccaaggcaggccaatcacttgaggtcaggagtttgagaccagcctggccaatatggtgaaaccccatctctactaaaagtacaaaaattagccgggcatggtggcgcacacctgtaatcccagctactcaggaggctgaagcaggagaatcacttgaactggggaggcagaggttgcagtgagccaagagcacaccattgcactccagtctgggcaacaagagtgaaactccgtctcaaattaaaaaaaaaaaaaaagaaaagtacattccaggcagcaagaatagtcattacaaaggcacagagatgccaaagaccatgataggtccaagtgataggtccaagtgataaatgggatgcagatgaagcacagaggacaaggcaggcaggaaaccaggctgggaaggcagggaccagaccacacaaggccagtggcccaccaaggattttgggacctgattctgtaggtggttttaagcaagagggtgactgtatcagacctgtgttgactgatttggggatggcaaacagacacagaggccagataggttttatttgtaacccaagagaaagattatacatccccaaactccagcttaacttcagagttccaggacttcagaagaaaaagaaaatgcctgccagggacttcagtgctgaaggtgcccatgtaaaaaagtgaagattaacatgtacatcaagttttctgatttttaaaggcctattctttttgaagcatgaggatctccttgatggttcaggatccttatgattagggagctgtttgcatatcaaagtgctgtctgttctacatggtagtcagccagtcaacaaacattcattaaagcctactatgtggcaggtacatagttgtacggtacattcctccatgactcttagctgtagtgtggttaacaaatatctcatgtgtaaccataaatgtggtgggttctataaaagaggaatctagagtgctatggaagcagtaatcaaaagatctaacctaattaatctctggggtcagggaagttttcttggagagcagcatgtttatgctgagtaggaagaacaaaaattgtacttctctatacttagcatttgggagccaagtacttggggagtaaggcataagagaaagtggtttagtgttccttatatggctgctgcataagccatcccaaaacagtctttttaaacaatcacttagcaagattctgtggatcagtgatgtgaactgggtccactggatggttcttcttgggtctagtttggactcattcatgtggctactactagctggtggcacaattggaccagaccagcctcacctgcgtatctggggcctcatgagatggctggggcttctctgcacatggtctctccagtggtctagccaggcttgcttacatggtagtagaagggtcctagcagcttttaggcctgtttttgctcatgtcccattggccatggcaaatcatgtagtcaagcccagattcaagaggtggagaaacagagtctgccttttgatgagaagaaccgtgaagcatttgtggccatttttttgcagtcagtcacatacgacctaactgtccctaataacgactctaaccaatcattacatacttgagcagaggaggagcccagacaagcacatttcacagttctactagagttcagcatccctgttccgtcccgtttctgcgggcctaacaaggcattctcatgctttcaggttgtaggatgcgcccatggacggcctggtcagaatgcaccaaactgtgcggaggtggaattcaggaacgttacatgactgtaaagaagagattcaaaagctcccagtttaccagctgcaaagacaagaaggagatcagagcatgcaatgttcatccttgttagcaagggtacgagttccccagggctgcactctagattccagagtcaccaatggctggattatttgcttgtttaagacaatttaaattgtgtacgctagttttcatttttgcagtgtggttcgcccagtagtcttgtggatgccagagacatcctttctgaatacttcttgatgggtacaggctgagtggggcgccctcacctccagccagcctcttcctgcagaggagtagtgtcagccaccttgtactaagctgaaacatgtccctctggagcttccacctggccagggaggacggagactttgacctactccacatggagaggcaaccatgtctggaagtgactatgcctgagtcccagggtgcggcaggtaggaaacattcacagatgaagacagcagattccccacattctcatctttggcctgttcaatgaaaccattgtttgcccatctcttcttagtggaactttaggtctcttttcaagtctcctcagtcatcaatagttcctggggaaaaacagagctggtagacttgaagaggagcattgatgttgggtggcttttgttctttcactgagaaattcggaatacatttgtctcacccctgatattggttcctgatgcccccccaacaaaaataaataaataaattatggctgctttatttaaatataaggtagctagtttttacacctgagataaataataagcttagagtgtatttttcccttgcttttgggggttcagaggagtatgtacaattcttctgggaagccagccttctgaactttttggtactaaatccttattggaaccaagacaaaggaagcaaaattggtctctttagagaccaatttgcctaaattttaaaatcttcctacacacatctagacgttcaagtttgcaaatcagtttttagcaagaaaacatttttgctatacaaacattttgctaagtctgcccaaagcccccccaatgcattccttcaacaaaatacaatctctgtactttaaagttattttagtcatgaaattttatatgcagagagaaaaagttaccgagacagaaaacaaatctaagggaaaggaatattatgggattaagctgagcaagcaattctggtggaaagtcaaacctgtcagtgctccacaccagggctgtggtcctcccagacatgcataggaatggccacaggtttacactgccttcccagcaattataagcacaccagattcagggagactgaccaccaagggatagtgtaaaaggacattttctcagttgggtccatcagcagtttttcttcctgcatttattgttgaaaactattgtttcatttcttcttttataggccttattactgcttaatccaaatgtgtaccattggtgagacacatacaatgctctgaatacactacgaatttgtattaaacacatcagaatatttccaaatacaacatagtatagtcctgaatatgtacttttaacacaagagagactattcaataaaaactcactgggtctttcatgtctttaagctaagtaagtgttcagaaggttcttttttatattgtcctccacctccatcattttcaataaaagatagggcttttgctcccttgttcttggagggaccattattacatctctgaactacctttgtatccaacatgttttaaatccttaaatgaattgctttctcccaaaaaaagcacaatataaagaaacacaagatttaattatttttctacttggggggaaaaaagtcctcatgtagaagcacccacttttgcaatgttgttctaagctatctatctaactctcagcccatgataaagttccttaagctggtgattcctaatcaaggacaagccaccctagtgtctcatgtttgtatttggtcccagttgggtacattttaaaatcctgattttggagacttaaaaccaggttaatggctaagaatgggtaacatgactcttgttggattgttattttttgtttgcaatggggaatttataagaagcatcaagtctctttcttaccaaagtcttgttaggtggtttatagttcttttggctaacaaatcattttggaaataaagattttttactac

SEQ ID NO: 37241 - DNA, 305113 bp, Homo sapiens; identical to SEQ ID NO: 37240

SEQ ID NO: 37242 - DNA, 22522 bp, Homo sapiens; identical to SEQ ID NO: 36985

SEQ ID NO: 37243 - DNA, 11641 bp, Homo sapiens
ctcagctacgggacacagtaagtaccgatgccgcaaagggaggtccccagggcttgagggcatgtgaggcgaggagaggatggactctagagttttggggtttggggtctgcaaagctctgaaggagtctcatctctgcagtttcaggtatccaaggcagcagaggtgagtgggtcccccgagctctgtgaccttatgctccacactaactctggcagagcctccgtttcctcataggtaagatggaaataattacaccctctggatggtgtgactgaagattaaatacagcgggtgctctcactcagcacatctggccatgtctgcagacacatttggttgccacaactggaaggggggtgggggttagtgacatctagaggccagcgatgctgctgatgatcccacaatgcccaggacaagatcacaaagcatcatcctgttcaaaaggtcaacaggatcaaggttgagagaccctgaaataaggccatggggacaaaatgtcggctggataggaggtgctcagtaagtggcagcttctgttgttttctgtgcctggagtcttgggcctttagaaatcaggaacaatgatccaatattatcggcttccgtgagataagggcatcttgcctggaggctgccacccaggccggtcatggcagctgctcatgaaggacagtaacaatttggcagtttgttaaatgaacaaaatgtagaaataaagtaagcagaatttttagtttttctgaaggtagggcttttggccagatatgcagcaataaaagagcaaactgcttccttgggccagtgtccttgctcatagatcaggaaaccgaagcatgaagaatacaggcggcagatgcctgaaggtaacggacgtgttcatggtgctgacggtgatgataagtgacagatgtagactcatctccaaacttgtcaggttatagacattaaatatgtgcaactttatgaatagcagtcatgtctcaatcaagtggttttaataaagaaataataggaagccagagctgagagacagggagggagttgttcaaggtcacctggcaagtgagctccggggcggggagagctcagctctgggtggccagcctggctttttccactgctcagtgtccagcttgcagtctaatgtctctgaattacagagaaggagactggtcagttcattcattcattcattctacaaaggtttatggagcatctctcctgactgcaagctcttgaaggtgagagcagcacaaatgagggtcccatggagagagaggccggaatgaaaaatgtcaatgacaaatgcatatataaaggcacatgtgtaattgaaagagctttgagagaaagagtcaagggactgttccagagaatagccatggaaggggaaaaggtccagtgtgataaggtattgcaaagaagtgacatttaagcaaaagcctgcagcctatgcagaagttggcctcagtgagaaaggttgggggagggttccagtagagagggaaggtatgcaaaggcccagagttaggacagaacttgctgtgtttgagaaactgggaaaagaagagtgagcctgggggtatcacgtgatccagggcagagcaggtccaggccaggtgcagccaggtcacagcagccctagtgggttagagcacaaatcaaagtttagcatttatctgaaacacaggagttggccatgagtttcttaggcgaggaagcgctgtgaccatatttatgattgaaggagattcttttatatgctgtatatagaaagcctttcagggcaaagaaaggaagctactggggtagccctgggggagatgaagggagcttccactgggggcagtaagaaagccagggaaaggcggcagctttaagacctgttttggagatagaacggacaagctttgctgatgggctggagtggaacaggaagtcaagattacttcttctgggaagttctgttcctgggtctttaggatctagaggaagctgtgactttgtctctcatctctgcctgggctccaagcctcacatccctttttgtaattagaagatattggacagaccgtcctcactaacacaattcccacagctgagtccagggtagaactgggcaggacttcactgcccaacacgggaaatatcagtcagcagatttgggtttcggggatggtggtgggccagcgggaagactgaccagggcctacccatcacatccccaccacctcccacctcaattcaccttggcctgagatgacaggtgaacatgactgatcctctctcttccctctgcagaaacactaaagccagggaccaggagaggggcagcccaaccaagctttcaaagcactcagtagaggctggtctgggggatgggaggctcccagggcttcacctgtctctgtcaaagccatgtatttccaccagaggcccaagagtgcgatggcaaaccctggatttgaaactaagaaacgtaaaacaagcactgaggactccactgcctcttgagtgacctctctgaccctctgtttcttctgcactgttaggataatgatactaactccatgttgttgtagagaagtataaatgagctaatacaggtgaaccgcctggggataccaggaggtgaggtcgaggaggaacgaggtatcactcctcagagccactcagagacaggctgtgcacgagtcagaggaacctggattttaattccggttccatcactcagtagctgaaacaagctattccacttcacttagcctcagtctattcaatctgtaaaatagagtgagtttacttttggaaaactctgtaaaatagagagcttacttttggtgaaggttaaacatagtaatatttatggagtgtctagtatgtctttaataattagtggttttactgaaaagtagagagagttggcccagagggagcaagatttctgggtctcaaacatgtagcccaggagagcctaagtgaacctggggccctctccaaacagatcctgggggagactcagtgcacacccggagaagcagctcctccccatcggatctctagtgcttggcagggggcggggtcttgagggggtgtccacaacacatggcagactgcagatgaagaaactgaggcccagagggggtgaggcttgcccagggtgacctagtagctgaatagatgggagaatggaggccagggcctcactgagactctctggtcagctgcccctgggctgtatccaataaggaaactcccctgcttctgaagctgttctcgaaattatcagctcagtgtgaccctgtggggggttgagccacattgtttctttagaagcatctccatacatggctggttccaacccttggcaggagggaccatattgtgctgtaaaatagactcatttagagaagccggagattaaagcacccacctatgtccttcaaagctctccaggcaagtgccatggtgggaacaggtagggagtgtcagtggggggaagcccagactctgctcactcattatctgcagattagggctattgttggtggctactaagtcagggatttcaaaatcaggaagatgcagccaggaaaagaggaggcaggactctgcagaggaggcaggactctgcagagtcagagtgataaccgagtctgagtccaagctttgccagtgttagcaagcgactccatctctctgaacctcggattacccatctgtaaaatagagctagcagcaagatgtacctttttgggtggtgcagggctgaaggagttggcacagtgcctgaaagagggtgcgggcaatgcgcccaactgctgtggctgctgggtttggtgccaggttcgattctgcaggcagaaacttctacatgaggctccttctcggaaggagctcaggacacaatttggaggctgggctggcaagggtgacctgctggagctattcaacttcacttaaagacaggcctgcagtccaagcctgcccaattcctgagaccattctctctccactgctgagccccacggccactctgcaagggatttcccacccacctgtttggggccctttggagtttggttttaattgggtcacgggatgctgtgacaggctgcccctgcctggtggggatctggggtcactgatgacattgtgcccatggagagagcccagcagaaagggattccctccaaggcgacacacagggcaaagctcacatcagaagccaggcaggccctctgcacctggtaattagccagcctgggtgctgtcaggctcacacgtgtgtgtgtgtgtgtgtgtgtgtgtgtgtgtgtgtgtgtaaagcatgtaccctatggtacagttgagaatatggaggcctcagatggggcttttgccagaaactgccatgcctactgctcacacttccatagcacgtgcccccaagcaccccatggtgtaggtgctgttattatcactatcttacagttatggagcagtggctcaaggtgtaactgacttgcccaaaatcacactacaaggacacagcagggctgagatttgaacccaggcagtggcttcagagcctgagctgtttcctactgcagagggaggaggcaagacttctacccgtagccagatggggaggcatgggcacaggaacggctcttgggtgaagtggagggaggaagaggaggactgaaggccaaggccacgtcaggagtgatgggagaccccacaaaggcctccctgagaagagctagagacaaagatgagtgcctcctcatctggaagatgaaaagatgtctttgcctgcatgggctgctgtcacaaagtcccaggggctagggggcttcaacaacagaaatttctttctttacaactctggaagctggaagtctgagattaaggcaccagcaggatttgttccttccaaggcccctctccttggctcacaggtggctgccttctccctgtcttcacctggtcttccctctgtgcatgtctctatcctgatctcctctttttaatttttgtgtaaggacgtagtcatattgggttggggcccactctagtgacctcattctaactcagtcccctctttaaaagccctatctccagatatagtcacattctggggtattgaaggtaaggacttcagcatatgcattttgggggcacaattcagccagaacaggaggacggtggggatgtccacatgaagaggttcaggcagaattcctttaggaggggaagatgtctctctgtgggacaagggtggcatggagcagcccctgggggaaggagaaggggacagtttgcatactggtattctgcctaccccagggtggacactcactcagcgtttgctgaatgaacagggcaaggccagcagtgctgatggtcccaggcatgtagctggtctgagttcatagaaggaccacagcgccctgccatgtgccaaaccaggacaccagagtgaaggccagaagctcacatggaagcagcttagttccctggtaacctcgagatgctgatgagacagagcagagcagagggaaccctctccctccatatcccatcctccaaaatgtgtcccttgatgtggatgggtagacaggattcctgccctggcagccagacccctgccttgggtctgcacctcctctccctccttcctctccccgtcatccctaaatcttgtcctcgagccactgccaccctgtgtaaaccctcatgcccagtcttgcgggtgccatcccttctctttgaagctgaatggaccaaacatacccattgagtgttgggtggggacatctctggaaagtcagcacctggaccagctccacccctctctgaggacaccttctttccctttcagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagagcatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccctaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaaggtaaggcccttgggcccaaacctgcactttctttggcttttctgctgcttttatctaaagaatacccaattccctcacatacataaaagacggggagtacgttaagttcttttgggtgcctgttgagaaaaattaagtaaacaagcagccagagaaggtaagatgaatgccttcttgctgtggatgggattagtgaggctgagatgctgtttcctccacggaggaagagctggttgctgtcttcgggcccctggggacatctgaagccccagctttctacaggctctgaagtatgaacccattgtggccaccatggcaaagacaccaacaccttagccactcagggcaggacacagaccccagaagggcttaaagggcatttcccagtcccccgtatccctcagatcttggcccctctgccctcatagaggccaagactccctcagacaaatgcttgttcctctgaaatgcctcctcctgactcctcagcaagagctgacctctgcttatctccccgacactccttgtaagcattcctgctcgcctctgcagctcctgccagttgctgaccctggggaaagcaagagtggatagagaggagaagagaggagaggagagggtgggaagggttgcgaaggaaggtaaattgttaacacctccccttcctatggtcacagatcatgagtatctttggccatttgggtggctataacaaaataccataaactgggtggcttagcaacaacaaacatatatttctcatagttctggaggctgagaagtccaggatcaaggcactggcagatgcagtgcccattccttggttcatagagagtgccttcttagtatatccttgctggaaggaggaaggcagctctctgtggtctcttttgtaaggacaccgatcctgttcatgacagctccacccccatgacctaatcaactcccaaaggccccctgtcctaataccaccaccttgggggttaggtttcaacatatgaacaatgtggggacacaaacattgagaccacagcagtgagtgtcgaacttggactctgagatttcctatcccctggtgcagggcagtccccattacaccagattgctgagggcagctgggaaataagctaaggacggtattgactggggtcttccttcgataacgattaagaagttggaaacaggccaggcatggtggctcacgcctataatcccaacattttaggaggccgagatgggcagatcacctgaggtcaggagttcgagatcagcctggccaacatagtgaaaccccgtctctactaaaaaatacagaaattagccaggcatggtggtgggcgcctgtaattccagctacttgggaggctgaggcaggagaatcacttgaacctgggaggtgggggctgtagtgagccaaaattgcgccactgcactccagcatgggtcacagagcgagactccatctcaaaaagaagaaaaaaagaaaaaaaagaaaaaaagaaataaaataaaataaaaagaagttggaaacaatcacttgtagcgttttgttcagaagttcccataggaaggtcagagaagggtcattgaagacttcccaatgggaaaaaccattcatttccaggatccatactaacttctttctaaaatttaaatcaaaatattggaatgaaagtgcaaacagagaagttcacccagatatcaggtagcattcacagccagccacatttttcaccctcttcacttggagatttggtcttgagtaaaacgttagagaatcagagaacatcaggggtccagggcctctgaagatgtgaaaaccaacctccttgttttgcaaatgtggaaggaaaagtcccacgaaaagtccaagaatgtgcccaatgttataaagagacttgccttcatattcaagaggttcaacagtcactgctctggggctgccataaagatggtctccgctggctatctttactgtcttcactccttttatttgcagctgagaatttctaattctgacacaaaattctttttcatttttcccttttttcatctttagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggtactttcagactaccccagggccagcctaaacccacacagccccagggagacacacacgccctaccagggccacacagcactggtgggaaggactcacccagccaaggagctgcctccaggcccagaggcatcctgtgacatccaagtcctgggggcctagcccagttggagggacaagagctggaaactgggttccttagggtggtgccagagtgggcagagacctctgggcagcccacgtccaagtccagagcaaggggaggctcatcctagaaaagaggccagaggagccataaccaccattgttccttgggttaaggagtccttttttaaaaccatcaaaactaagaatccagtgcattatgaatccaaggggtgaggctcagtgtgccaatgccccagaacagtctaagaaagctccttttccctttccaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgaggtgggttcagaagctcctatgcatctgcttcccaaggtctattctgttctattctttctattctactctaccccatttcattccattccattccactcaactccactccactccactccactccagttcactctattcaattccactccactccactccagttcactttattcaattccactccactccactccagttcactctattcagttccactccactccactccactccagttcactctattccattccactccattccactcctccactcctctcatccactccactctactcctccactccacatctccactccactcctccactccactcctccactccactcatccactccactcctccactccactcctccactccactcctccactccactccactcatccactccactcttccattccactccattccactcctccactccactcttccactccactccattccactcctccactccactccactctattctattctattccattccattctactctattctattccattccattgcagtcaactccactccactctctactattctattccactcctctcccctccactccattccattgcagtccactccactgcactccactcctttattctgttctgttctattctattctattctattctattctattctattctattctattctattctattctattctctccctctccctctcttttcccacaagtagtgaaagtttcactttgtgtcttatccttcatgtaatgggaagccatatccaccactgttccttgagttaaggagtcctgttttaaacaatcaaaactaagaaggcacttcctagctatgtgatctccaaaaaatacttgactctctgagcttcctttctctcttctataaaattgaagaattacaccttgctcaaagatgccatgagaattcaatgacagacacatgcgaagtcaccccccagcacagtgcctggggcagagtagctgctccattgttccatttcctacttgctccatggctcagttgaacagatacttagaggttgatgcccataggcagaagctttgccatttgctatgatgacttcacctgcccctagtggcctggtgatgcctggtgtctcccctgcagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctaagctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattaacactgagatccagagaggctggatgacttgctcaagttcaccagcatggtagtggcaaagagaggtccagagtcctggcccttgatgcccagctcagtgccacaaagctcaataggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaatgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtatcagttgcaggtgccaatgactaactttttgaattctatgttggcattaacaataaagcattttgcaaac

SEQ ID NO: 37244 - DNA, 23410 bp, Homo sapiens
gcacattccggccagccccctccccacgaccccccttccccggccccccttgcggctccctcgggcccggcggagcggcccggccggagcgcccccgcgagctcggaccaggtaagccgggcggacgccgggaggaggccccgctcgggagaggtggtttggttggtcggctgggctggctgggggggcgacactcgagggggactgggtccccgagctattgtccagccggagctggagccccggatcggggtgccgggaagtttagagggaagggggaaaatctctccgggaagccccgccccccgccctccccacccccccgcgacggggacgagttggtccgggaaggtggggaagccggggagaccgtgtcccctgtgccgtcgcctgtcccgccgtccgtgcttggggggtcggggcggggatccgggggccgcacagtgtggagggcctgcctgccaccctggagctcatatccggggcgcccagtcccgggccccgccgccctttggactcccggcccgcgcgctcccggagcccgcccggcctcagctccacgcaggcctcgggcccggcctcccagcgcccaggccggtttctgcgcgcggtgccgcggctgcgctgggttgtggagggtgtctgggaccaaagccgcgcgccccggccgtgtgtcccctgagaggcagggaggggctcacgttcccttcagttctgccgcctgcgtcggggtgctgattcagagttccagccctgagcgctgtgagcttggctcggaggggtctggatttggggccttttcttccccacacttgctcagggcccttgtttagacttgacaaggtttgagggtggctggtctcccgcttcctaccccggtccccaccattgtctgtcatgccctttattcctgctaggggagggagggctgggagcgctggtctggatctgttttccagcccagctgggccctggggcagtgtcattgagaccccgctctgtcaactttcctggtgaggggccctgatccagggctgagagattctttcagtgcgagggggaaggaggccttggggcggacttctcaggggctgtcttcttctgtgtcttccctctttccaggtaggggcagaaccaggtcaggcctggacttgttgtccggaagaacagggcataggggtaggggctggacacagctcagaggggctggtgcccatagcggctctgcgtatccagtctcttgtggcctggttctctgtacacatgttccaccccagtgctggggccacctggggcaaggaggggaggctttcctcaaaagttggagatttgggggaattatgtcctctcccttctagactcctgtagcccccctcccaccaagacccctctcgtaggggcactccctaaaggatgtggttctgtggtcttctgggtccctgctcacccagtgggcagagtgcacagatcttccaggacaaggctgtccagtaagggtaacttcaggggccctggatgccccctcctcagggagagggtaggagccagtatgagtcccaagctcttgggccttcccctacccccccagggagggaacgtcattaatgctaatgagcgcatctgggctggggaatggcttgttagagtggtcagtggttgccaggacagagcagcacattaagtgtacagaagcatcacatgggtcctgagccctgctcccatcctcacccaaaggtttgtagaccctggcactttctgccaactgaaggaatgttaaaaccgggaggatttgatattctcaacaatatcaaaggagaagatatctcaacagaggtggtcaagaaatagggatctggtcccctccggacctttaaccagttgcgccatcttggcaggcccctttgggcctcagtttccctgcttggaatgaatgacttctcaagtcccttttctctgagctcctcccagagtctgtctcccagtttgccttccttctcccatgatggaacctgaacttggtggggtctggagaggcgggtgggtgatccagtggcccaaagaagaaggcaaggacaaaccaaggggtgactgaggagtagctcagccagatgaacagggctgaaaaggtggcggggggcaggtgtcaagggacaggggggcttggtggattgggggatcttgcctctgaagtggtcatgggttctgttagggctgaatggcacaaagggtgctcagaggccgcttgggtggctctaccctctgccccactcccagacacctgtgggggtcccagggctcagtgtggaaatcgctggtcctgccctcctcctcctccccgcccaggatggggagaggagcccaggggtctaaacgctgcagctttctgtgaaggggctaggaggtcgcagcctcttcttcccacatgggggctgcagaagctgtggggtcccaggggtggccctgaggatctgcctctgggtagagctggggaggtcagcaggtcacactcggcactgtccctggggccttgccctgccttccctcccctcccctcctggtgttgtgccagccctgggctgtctgcagaaggggccacttccctccagggagaaccctgccagggaaagggctctgcctgtcttccccgacccacaggaggttgaggttagggccagagaggttcatccccctgcacatccctaaagcctcagcccttggggtttcctagagtgccgattgtttcctgtgctccctgccaggcctgaaagggcaggaagtgttagagggaaatgagaatgcaactgtgtgtgacgctggatgtgtgtgagagaagccatgagtgggacattctatgtgggtgagacttgtcttctgtggggctggatgtgtgtggaagagaaccttggtcagagcaacttgtgcagggctgggtgtatgcaggagagaaactgtggctttgtgacattcgtgtgtgtgacagatatacacgtccataagagaaactgggtgactcttcatgtgtccaggtgtgccgccacctctgtacctgagaacctgcatgggggatgttctgtgtgtgccagggcatcacccaggatgtgccgatgaaggaagctggctgcctagccatctgtgtgtacctggagatgacactgggtgtggctctgatgctcaagtgacctgcgtgtgaaggacaccgcactcgcacgatgctgtgtgtatgtgagcgcgcgggcgcgtgtgcgtgagaagccggatgagtggcgatctgtgtgatgtgttacgctgtggtgtgaccacttgtgacctgcatgttgtgacgcagcatgtgagatggcctcaggtttgtctgtgtgtgacttacatgtgacactacatgcgagtaaaacaacatgaccagctctgtgtcagtatgatgtgtgtaccagcaaggtgggccccatccgacatgtgccaagcatgaatatggtatgcggtgtgtgggtgacactgagcaccagaaagcgacaccgtatgtgagagaaaccgtggggcgtgactgatgctggcgctgtgggtgggtggtcactatctgagcgtgtttgggactctcgggtagtgtgggtgacacccccagggctgtgccaggcagggcgtgtaggaggctctgtgggatgcttttgggggcctgtggtccctgacgtgtggcatctatgtggaagacaatgagaaagacactgataaaaacaaagaaggaatgtaattaatgcctctcaattgtacacttagaaatggctaaaatggtaaacttgatgttatgtatattttatcacaataaagacatttttaaaaacccagcaggagagagatgcgggtaacagtgaatgagcaggacagtggctgtgacgcaactgtgtatgcgagcgagaggaagggcgcagaggaaacctatttgttcttagatgacaccgtgactctcatgagggcactgactgagtggctggtgggagcccagtgggcgacccagagtaccaggagtctggcatggtaactgagaactgagaaacccagtgaccccctatagtctgtctctcactggatacctgagattcccaccctgggaccaggacaagatgaggagataagtcagtcccagggagggggtgaagggaggtctggaaactgggcccttctctctacaggggacttgagggctgagtctccaccctcctacccgctatactgcttcagggagcaggagcgtgacaacagatgagatgagctttgcagaaggaggcctggggggactatcccaaccccctctgctccctgagaaagcccctttcccaagtagtgtggggaggaggggcagagaatctccagtcccaaattggaagcacattaataagcagggcggggggtggggagagagtggaggggcccccacctccctcctagtgggctctgcaaattgcttcctcctgtaaaaattgagaccctgttccaggaaggagggaagccctccccagcctggcagggtgtggctgcttggcagggtccctccggggtccttgggctggaggtgggggagacagatacatccctacttgctctgctgccccagagcatggctacttctagggtgggagcttctggcagctggagaacagctggcccgctgtggggcgggtaggggaggagggaggaaaaggcagagagggtgggagcctcccttagccctcctcagctgccctccccatcctcgacccccccggctggtcagcccagctcaggtttgagggcagagatttgggaggaaactgctgatttcactgatcttgccacattttgagtgatgttctcactccaagtgagaatgctttgggggctggggtccctgcaggggtggactgctggctgctagacccaggaaggtcacagctcagctcgtcctcccagcagggctggtgcaggggaaggggtaagacaggaggtgcccactcacccagactggctttttctgtgcctcctaccaaggcagtggctctggggcccctaaagggagctacagggctgggtggtctggaggctgcagggtctgtgggggtgggggaccagggcctctgcagcggccccagctccagcctgatccctggagctgtccagccagttcttccagcaggtcttgccccagggtgggggtgggcagcaaggtgccccttatcttccccagggccccaaagcctgctcacccagcctcctagcccccatccctgcctccacccagaggccttctgagcctgaaaggctgagggccctgggagaggggaagcgggtgtggctggtcaggatgagggtgaaggcagactgagtcccctgggggtctgcagcctgctggcgggtttgcaggacaggtacaacaggactcctctgcagaggcagatgggaggggttctgagaggaggtggagggtaggagcccctgagatgggagtgggggtgtcctggatggtggccagccccagcccctggcagtggcctcccttgtcactccctccctctgttttgccttggcctctgggtctctgtccttgtccctgtctttttctttctccccatcccctcctggtctgcccctccctcgatgcctatcatatctgagtttctggtctacccctctctgctgtgtgtctctttctaggtctttgttggttgccttgtctgtgcccctcccctgccctccttctccccttctcccttcaccccccaccggctctgtctgtcagtctgtgggtctgagggtccagcactcccccgccctgcctccacatctctcctggggtctctcccttcactctgcggggctctggtctgtcccccactgggttgggctttctgtctgtcactcactgggactctcctgtctctggtctgttttctctctgggttcacctcagcttctctttgccccagactctcccccagcctgtctcccctgcccctcctgtctgtctcaggccccaccccggccttggtctccctccccttgaccctcacttgggtctcctctctctcctacccctcttcatggcacagcacagcgaggcagagtttctagatacctgggcatcatcagccagcagcccagggcttgccctctcgcccgcagtcagctttctctagatgtcccacccctccaccaagccagagtcccacatttgccccagcccagcccgcacctgtccagggagccatagcctcctctctcagcccggcctgggtcccagcagttagaggatctagggagaagaaggcgggcacatgctggtctctaggagaacagagcagccagtgctcacgcctcctgcagactcccttccactgagaccccggtccagcccccagacgggggcagctgcctgcccacgactgcccatgtgtgtgcctcagcttgggggtgcacattctcacgtggttgtcctcccgagcactcgcacagcccctctgcacagtgtgctcctgtgcatggctgtgtgtggggagtgccacttgcccctgtgttggtgcctctgccccaggagcgttcctagaaagtgagtctcgcatgcgtctaggagccagccgaagggagggacggtggtcctattctctccttgacacgtcctttgggccgtcccccctcccctccccctcaccagctgccagcggtcccagccaggggccgcctgccccgcccccccagtctgtcccagctcccaagcctgctgctgtgttcgccatatttggccacagtgctcccgcggggggcggggcggggctgacatcaccctaagaagggggggccacagcctgcttgaggggaggcgggcagggacttgggggaggcaggaaagttgctttaaaagtctggggctgcctgggccgctgctgctcgagggaggcctcgggaaaggggttaagaggggccttagctcattgtagcccctcttctccctcccctctaacagctctgtggcagtgtcagactgacacctgtggacaggccctgcatcccaactatttcaacaggggagtccctaggtgcccccacccagctagcacacccctgtccccttaattttttctttttgtttttttaatttaaatttaatttttaaaaatagagacaaggttttcactatgttgtccaggctggtcttgaactcctggcctcaagtgagcttcccagagtgctgggattatagtcgtgagccaccaccccccacatttccttatttatttatttatatttattttgtttacccctcacatttctattccaagaattcccctctcgttgaggagtagggcctggggctctggatccagtttcctggggtgagggacaggctgggaatgagggcatctggcccctctgacaggtcaggggcacagctccttctggccgcccactggccatgggagagagattcctggtggctctggaggcatcacagaaagggctgtacggcagtgcgggggtcttcaagttgctccagttgcttgggttgagggggacctcctgggcagacttagggcagttgctgtgacagctgaacctcctttctctctcaggtggtggggtctctcagcaccctccctataaccttcctggttataaaaccgaagccagcttacctgggttcagaacccagccctagtacttacttgttgtgtgccctaaggcaagttgcttaacttctctgtttcttgggttcctcatctataaactaggaataataatagtatctgccccatagggttattgtgaggattaaatgagtcaatgtgtgtgaaatcccagaacagtgcctggcatatgacaggtactgttagtagtagtaatattaagtctagactcaatagtttagaataattacaataactagttgaatagctgaataactaactgaataatagtttagaataatcaagggccgggcgcagtggctcacgcctgtaatcccaacactttgggaggccgaggctggcggaccatgaggtcagaagtttgagaccagcctggccaacatggtgaaaccccgtctttactaaaaatacaaaaaattatctgggcatggtggcatgcgcctgtaatcccagctacaggtgcgtgccaccatgctgaggggggaggctgcatgggagtctgaggcaggagaatcgcttgaacccaggaggtggaggttgcggtgagcagagatcgcgccattgcactctagcctgggcgacagagcaagactccgtctaaaaaataaaaaacaaataaaaaatttaaaaaagaaaaaaaataaccgaataactggctgacattcagacctcccaggccctccccacctcattctactagtgatcccctcaagcctccctaagcaaacaggtggctctgcagagagagtccaccccgactcaagcagcaggacctggaattcatcttcctctccctggcttctgacggtgtcccctacatctccacccctcccctttccctgctgcccagagctaagtcccaggatccagccatcatgggctcttaggtttccaggaccctgaatacattggacatgtgggttctggggctgaaggggatttggggtgagtcttggggttgtgagtgatagggggcctggtggggtgtggtccaaattaatagcctggcaggttcagggcactcacagtttacagagccctggcccacatgtaggatgggccagggcgggggcgggcgtgttggtggtttacgggctgctgtggggcctggaggtgcgggaacaggaagtgggatagaggagcgggtgaggttgagccaggctgttggccaagcaccttctctgctgctccctcaccagttccctttttgtaattcctggggcagttcctgccctacattaggccccttggcagagttctggttagttatcgatttgggggaagataaaatggtgcccttctgggtcagggactctccttgtcccctgaggggtccttagcagggttgcactgatgctggggcgagagtgaggggtggaggtccctgactggggatgtggacactggggaggaggagctgacagggagagctgaggaaacacagccctgctcctctgctcctcctctctgtgctcctcagcatgcctttggcagctgcgtgaccttgtgagccttagttttcatctctggataatgggctttattccctaccttccctgctttagtgttttttgttgttgttgtttgtttgtttttgtgtgttttgttttgtttttttttgagacaaggtctgctctgtcacccaggctggagtgcagtggtgctatctccactcactgcaacctctgcctctggagttcaagtgatcttcgtgcctcagcctcctgagtagctaggattgcaggagtatgctgccatgccctgctaatttttttttttttttttttttttttgaggagtctcgctctattgcctaggctggagtgcagtgacgtgatctcggctcactgcaacctctgcctcctgggttgaagcgattctcctgcttcagcctcctgagtagctgggattacaagtgcgtgccaccatgcccggctaatttttgtatttttagtagagatggggtttcaccatgttggtcagtctggtctcaaacacctgacctcatgatccaaccacctcggcctcccaaagtgatgggattataggcatgtgccactgcgtccagacctgatatatttttaggtagagatgggttttcaccatgttggtcaggttggtcttgagctcctgaccttaaatgatccacccacctcggcctcccaaagtgctgggattacaggcatgagccatcgcgccggcctagttttgtgaggtttgaatgaatatgaaaatgccttttccctacaaaagtgctgtgttggtatgaggcattgttgttaccgattacctatttcttgagtattatgagctgggcatgtggttggtactttgtcatgagctcatttacattttaaccctcacaacctcaaggaggtctcctcaaggagacccttttctcgttttacaggactgaggcctagagaggtgaagtagcgcgtgcatcccaggtcacacagctctgaacaagctgtggttgttcctctggttacctccgttccacctggagcacctgctcctagggtgggcttggggctgggggcggagctccagagccagcggctgtgggataggagattgctgtggtcgaggaggaccctggtcccagttcctgtctgtctgtcccccaggctcagccgcccagtgggctcaggcccagagcccagagcaaccagcacaatagcgtccaacagctggaacgccagcagcagccccggggaggcccgggaggatgggcccgagggcctggacaaggggctggacaacgatgcggagggcgtgtggagcccggacatcgagcagagcttccaggaggccctggccatctacccgccctgcggccggcggaagatcatcctgtcagacgagggcaagatgtacggtgcgtgccggggggcgcgggcgggactgcggcccttccccctgctctctgccctctcacccaaccggtttggtgacgtcggaggccgccagccgctggccgggcgagtctgggcgcgcaagcctgtgtgtctggatcctcctccgcgctcctcctcataaacaagccgggctcgccccctaaccagggcgcagcccacaccttggcacccccgcctgctcctcctctcctccccgctaccggcctggaggtttcgaggtgactcagtgggcccaagaaagtgggtcagcccagtctgcgccggtcgaggcccggaacggggtcccttcccggaggaggatgtggaaaggaggcccggtgatagtcgcccggtgactcccacagcccgtatagttctctccagtgcgggctgtgggaggtcgcacggggacaaaggcctgcgttggggctgtggggacgcgttccctcctcagtccccttccccactccttgggtttgttggccctcctctttgccatcttgcccatttccagaagggagtgtcccctcttgtccagccctgagagggctctcccagagctgcatttttgggataactcgacccttctgggcctggttcctggccagctcccctattcctcccagcagcccgtggctgagcgaggcaggcccagcccttcccagggcgcgcctgtgggaagggatcaggtccgctccgtgtcccttggccacgcccacccagccccagagccccaccttgggggcaggcagatggtccagggtgccttccacagggtgggtgctgtctgcccccactgctgcctcccaggctggggagccccacagggtatttttagacagggtggagagagtggggtggagaggggctggcgggagggaggagcaatggggctggttcagtcatcggaatggaatttggagaatttggccattctggggaggccttgggttggagggcagagagcctggatttgggggtagaggtgtacaccttgaccatgctgacttgggctcagccgtgtggcccaggcatccccctttcaggcccaagtccctggacactggcagcttttgggccctcagagggtctgtggtgcagaacagaccccgcaccccaaggctcacaaggctctcacagggtggagagacactgggaactggtgacatgggggtgacaggcacaaggacatggcgacatgctcagtgacacatcttgacacaggccgccagtgtaggaggcacattggaggcggtcagtgctgccttcctgtccttcctggtcttttaccagagaagggaagggacttgaccagggtaaagacagagcaagggcaggacatccacctggggcaggctcattcacacgcccccacaaatccatgcactaagagtactggagctggtgacacaggcaggaagcactgctgggggctgggaggatgggcgtgcctggccaggacaggccctactcagctactgtcctgctgacctgtaccacagccacccggtctgtctgcagggaagcctgtcagggtgcctagtgctgctcggccctccttcctcctaccctgcagcccctcatgcacccctcccctgaagagcagcccctctaggtcctggaggtggtaggatgcagctgtgactccccagccacctttgcatgccctgcatgtgcagcttggggtgaagagagtgaggaacagaagagcagtgttttggggagggtcctggagtggcttcccggtggggtgggggcctccagcctctggctccaccctttgcccactcctcattttctctctcaccccaatctaggccgaaatgagttgattgcacgctatattaaactgaggacggggaagactcggacgagaaaacaggtagagagacggtttatgctgggcctgccacccacacactctgtctcagctgccccggtcaaccccttgcccctaccctgcccacctcctcgaggctgcccctgacctggactgccaccctccttgcctcatcacactccccttaccccctcgattttacaccctcccacccccaagcagctccattcacccttcccacttctcttggagagatggccccactgtcctctctgaccacctactaccctgcccagggcctgtggttcagggaccacagataagcccacggggctgctgtggctgctacatggtccctgccctgagtggctcactcaccagccagggagccagatggtcagatggatgggtacagagcaaggtggcggggctgagagagggtgggtgcagggcaccctgggacaagcagccaacccagacaaggctaggggagtggggagagagagctgggaaggctccctggaggaggtgacactcgggatatatttttaagaaggaatgggagttcgcaaggcagagaaaagggagaagacccttccttccaggctgaggaagttggatatacaactaataatcatggtaaacccatacagagcttcctttaagttaatttatttcatcctctcagtaaccttactagataggtacagtaattgtcttttttactatgaggaaactgatgcatagggaagttaagtaacttcttcaagccccccaggcaggaaagagctgtgcctgtgggcagcctgatgtggtggagggagggtggggactgctggggtaggggacactcagcaggagacatgggggacaggttccccaaggggcagcggtgggctacaggagggtatggagcagggagtgacaggtggcagctgttgaggaaggccctcaagcagccgggacaatggattagagagggctggctggagacagagaggctggccattgcgggcataagcagaggcctagatcaacagtgccagggcctgggatgagggtagtggtggtgggagtggagaaaaatgatgatgtaagagacagttagtggcttctgatccagggaaggtggcagtgtagtgacagaaacctgaaggggagtggatgggagtgatggccccactgcctgggggagaggccaggctggaggcgggacctggaggaatggaggccagtgctaccctcacactcccagcctcctgtcctggtgggatttggacccacagatccccatggtgcatatgtcaagtctggcctgttccacctctttctcaaaggaaggttctgagcctccctacccagtgtaggggtggcaacgatccctcattcattcaagcatttatgaaccaccctccctaagtctagctcatgcagcaccaaatttattcacttagctaatgattgacctactgctgtgttctaggcaccagggataccacatggaggcgtgcgccagagccctgtcccctggagcccttgggttcaaatactggttctacctgggagtgggcagtagttggcctcccagccttgcatcctcagccattgaattagttaacatgtgaagactcttagaacagcgtaagcgctgcagaagaatttgctgctgctgttattattattccagacattattataaacagaaagccgttctgagctcagaagcgaactctcagcgggtccttctctacccagaagaggtgttcataggaacctgttagtcagagtgggaacgggccaagggtcactaggtcactgtttttttgttggtttttttaagttttataattaatataaaaatggggtctcgcgatgttggccatgttgttcttgaacttttggcctcaagcagtcctcccgcctcagcctcccaaagtgctaggattacgggcacgagccaccacatccagccaagctgggtcactttgaactgaggccagggtggattgcagacgtggggcacatcccagcccctgaattcagggtccaccatcacacctgctcctgcctagcatcctgagagggctgcccagaaaagagcttttacaaaccagctgttgataagctcagaattttagaaaccactgtcttcattataagggcataaggtacaaggatgaaactccccctgtctttactctttcttagaactctgggtttttacatcccagtgaaaggggatctgtcctctggttgtgaggacaaggcatgtctttatgtgttaaaaagagtaaccactgacaaggttttttttgatccttttaaaatttactttcgacctgtaatcccaggactttgggaggccgaggcaggtggatcacttgggttaggagtttgagaccagcctggtcaacatggtgaaaccccgtctctactaaaaaatacaaaaattagctgggtgtggtggtgtgcacctggaatctcagctattcgggaggctaagacaggagaatcgcttgaacccaggaggcagaggttgcagtgagccgagatcacgccactgcactctagcctgggtgacagagcgagactccatctcaaaaaaagaaaaaattacttttggcaaagaaatgcagttttaggtttttacagatacacacatgcagcaattcgtagtaagcacaatgcctccatatggacaaaagagctaaatattaagttagaatgaagctctgtgtgactttcagctgttacagagtcaaccatctggaggcagtcttctgagctaagggtccaagtgagtcctggtaacggagcttggtggtgagtggagtcagagtgggctctggagtcagaccgcctgggtttgaatcctggctgtagcactcagccgtgtgacagcttaacctttccaggctttagtttcgttatctgtaagtcagggatattagtacctaggtttttgtgttgctgtaaagatcaaggggtcagtatgtataaatgcagaggacgatagtatctgtgctcagtaaacgccagttactgtcacagcgtgaagtggtcagtaattttgctggacaggagtctgattcctgggctcagtgaggcagtgtgaggagcacccacccaggtcctaaccaggtggtatcacatacttactcactgtcaggctgtgattaaagagaaaaacgagctttctttgtgggagtaaaaacaactcgcaaagaaagccaattgccaatgctgaaagcgtgaagcggcgtcaaggatctgtgtgtttcctggggaaaacagtgacatttgggttctctgtgcctctgggtcagatctttcacaaggtcaagggtctgtggtgtcagctgggcacacagcccagggcacacacatccagacagtgattagctcaagtttgcctgcggaggctgcgaggaggagatggctagagaagaattgcaattaagagcacccactgagtacatatatacacactagcatatattagcccaagcagaaagaaggtatattggggggaaaagttatgggagcaaagcaggagggccaggcctcgtttcataggctggggctgtggttggggttgacaggaggactcaggcggtggtacccgggagatccctggtagaggatgtggccttggtgtataagctagtggccaacaggagcaccatggccgttgctagcacctgtggtgccaataagaaaaaggttgtctcctctgaggacaccagtgagaaaaagtcaccctttttgcggggaggacagggttaggcacagccttgtacaaggacacatagcttgggcagcagaacttgggctggatttcagccctcactggtgccctttgggccagtgaacaacctgtgcagctgtacatggtggccctggaagccactgtggctcttgatcatgataagaccaaaaagagaacagaattggcagtgtcaagaggtgtctgaaccgggcacaatggcacatgcctatagtcatagctactcgggaggctgtggtgggaggatcgcttgagcccaggagtttgagatcagcccaggcaacataaaccctgtttcaaaaagaaaaaaggtccccccatttacatgtagttccctagagatgagaggtctgggatgctccttgcccgcggccaccccatggctgtgcctcctcactgtctatgttttcctctctggcggggcgcggggcggcccctaggtgtccagccacatacaggttctagctcggaagaaggtgcgggagtaccaggttggcatcaaggtatgttgggtgcctggcgggggccttcagccctcctgggcccctcacccacggcgctatctctgcatagctcaggcctttccttggccagctctccagccccactgtgcctcttttctggctgaagctctgtttctgcctctccttccgctctttctgttctttttctctttctttctctctctacaggtctctagccacttgcaagttctagccaggcggaaatctcgggagattcagtctaagctgaaggtacggggcccctgccacctggcctggcctgcccagcaccctcctgggtgcaggcctgtcgctgctctgtggctccagcctgggacaggcaaggggctgagaagctgtgagggggtccagaaagaaacacaagtggcagcaggaagcccaagggccctgtcagtgagggagagggagaccatctgggggccactaaggcccacccctcctcttctctgtttttctttttctccttcttcctgactgctgcttactaactgcatggggacttccgtgggcagggaggaggccccggggctactggccggcagggctattgaggtgggcatggcagttccttgcagagctggctgtcctgcagctgcggatctcagagtctggggttcatgactgaggcccttctgagggcctcacgctggccgtgtgctcttctccctgcccacagcggtgcagcagagggggcctcttacccccaggcccccatgcccagagcctagttccagaacatatggacagacccagagggcaccagcttgttttccctcactctgccctttccagggcttgccccagctggcaggcactccctctgtggggacggggagggtctgctgagcttccttgggctcctcggaagctaaaacccatgggcactgggtggaggtaggcgcaaagacgtccctcagcccacagccctggtgctgcacatgtcctctaatctatcttccttctctccctcacaggccatgaacctggtaagtagcacagccctccccagtgggagtgggggaaagggtcttaacacctaatacaggattttcaaatgacagattatgaaaccaacttaataggtgtgcaagcctcattttaaaaaaacgaaatggctgggcgtggtggctcacgcctgtaatcccagcactttgggaggcagaggtgggtggatcacaaggtcaggggatcgagaccagcctgaccaacatggtgaaactccgtctctactaaaaatacaaaaattagccaggcatggtgacgaatgcctgtaatcccagctactccagaggctgaggcaagaaaattgcttgaactcaggaggcagagcttgcagtgagccgagatcatgccgctgcactctagcctgggtgacagagcgagactccgtctcaaaaaaaaaaaaaaaaaaaagaaaataggagagtacatgacatacagtaagaggaaatatcttgacatatattggcctttggaataaaataatttcttactgtggttgtggtcagcggtgatgggcacttgggggactgagaccaggaaggtgcagagactctcccaagatcacacagcagagctggggctggaatccaggcctggatcttcaggaacacctgccatcctagtgctttggactctgctggggtcatgggaggggcgctaaagcaagcctggcctcatccagcgtggccctggcttcatgcagcctcctctccccaggaccaggtctccaaggacaaagcccttcagagcatggcgtccatgtcctctgcccagatcgtctctgccagtgtcctgcagaacaagttcagcccaccttcccctctgccccaggccgtcttctccacttcctcgcgggtacatgggtcccaggaggtgggctggtgtgggggtgtgctgtaaaggatgagctttagtggggttcatggatgctgaggggcccctgggccttgtctcatccctgcagttctggagcagcccccctctcctgggacagcagcctggaccctctcaggagtgagtattgtggctcatcatcccacgccctcttcctcctggcagccgcacagggcttccctcccatttgggctccagcaacagctgagcaaagttttaattcaaaaatagagggatgcaggctgggtggtggctcacacctgtaatcaatcctagcactttgggaggccgaggtgggaggattgcttgaggccaggagttcagaatcagcctgggtaacagggcaagacttgctctctcaaaaaaaaaaaaaaaaattagctgggtgtggtggtgcgtgcctgtagtcctagctacgtgggaggccaaggcaggctaggattgcttgagctcaggagttccagagttccaggctgtagtgagacttgattgcaccattgcaactacagcctgagcaacagagggagaccctgtctctgaaaaaagaaaaaaaaaagctggagagtggcaacaggacagctgatgcgctggctgttcactatgcattctctcatcagcatgcatccacttgtcatccatctctttgtttactttctgctcagtttctgaggcagtctctcagttaacaagtcaggtggtcaagtgtgctggttcttcaactctaaaacaactttcatcaaaagaccctcagcttaaggagcagcttttcagggtggggggtggggaaggttgaaatgaaatcctacactaaatgggcagatcagctgggagacgcagcaggatttcacaaaagctaaaatgtgcagaaaacaaaaagcttgcgagttagcttttcagcatgcgtttctgggcctcagcagaaaggctgggtggcttgctcctggggtcttggaagaggggctgggccaggtggaaggtagggaagagggaaccctctcaccaggctgtgctcctgtctgcagcatcaagccctttgcacagccagcctaccccatccagccgcccctgccgccgacgctcagcagtaagttccccacacgaggtgctctcccttggcacctgcacctccactcaggagagctggggtccaactgtgtgtgtttgctttgggagggagggggttgcgacatctacaggagattgggacaggccaggaatagcccctttaccttgtacaatgttgcttccagatctctggcacaaaaccatagccaagccaggcgtggtggctcatgcctgtaaccccagcactttgggaggctgaggcaggtggatcacctgaggtcaggagttcgagaccagcctgaacaacatggtgaaaccccgtctctactaaatacaaaaattagctgggcgtggtggcgcatggctatagtcccagctacttgggaggctgaggcaggagaatcacttaaacccagtgggtggaggttgcagtgagccaagattgtgccattgcactccagcctgggcaacaagagtgaaactccatctcagaaaaacaaaaaaaccatagccaatacacagctacaagcacacaccaccaaaacctacatttacacacatctctatggatagaaaactccccataaggaaatgcactgaaatcttaacaagactttctctttctagatggtgggattctgggtaattgttctttcccttttttacttctctgtgttttctgtttaaacacacaaggaaatgtttttgatatatactactagggccaccacgtatggttgtgcaggttgtacactgtacaaggacacatagtaggggagtcaaaatccaactcatgttccttcccaaaaggggcacctttgcaagctgggggcagctttgtcagtaagcacctgcatgcatccatgcagatgaaaatctgtctcgccctcccaggttatgagcccctggccccgctcccctcagctgctgcctctgtgcctgtgtggcaggaccgtaccattgcctcctcccggctgcggctcctggagtattcagccttcatggaggtgcagcgagaccctgacacggtaacgtgtttgggggtgagggtgaggctttgcacaattgtggagaggccggccgggtgatccagggctgcaactcaggatctgggggttgggggtctggcctgttcaggaagccctaggcaattctatacctgtgcagtgctcccttccccgcccccgggcctgcaagcctgagtactctcctgaccctgtctgggccctccccacagtacagcaaacacctgtttgtgcacatcggccagacgaaccccgccttctcagacccacccctggaggcagtagatgtgcgccagatctatgacaaattccccgagaaaaagggaggattgaaggagctctatgagaaggggccccctaatgccttcttccttgtcaagttctgggtgagtccccctggccttctctgctccaagcccccttccccaccccagaggtgcaacatccaggcccactgcattgacctctgaccctgctgcatcctcatggcttgtgggcagagtgccagagatggatccttgggcaggactctgatgtggtgtggcgggaatacttctggtctctgccagcacctaacaccccccacccccatgcccaggccgacctcaacagcaccatccaggagggcccgggagccttctatggggtcagctctcagtacagctctgctgatagcatgaccatcagcgtctccaccaaggtgtgctcctttggcaaacaggtggtagagaaggtggaggtgagtgggggctctgggtggcttggtggggctgggagcaggcaggccgagtgacgccttctccatattctctgcagactgagtatgccaggctggagaacgggcgctttgtgtaccgtatccaccgctcgcccatgtgcgagtacatgatcaacttcatccacaagctgaagcacctgcccgagaagtacatgatgaacagcgtgctggagaacttcaccatcctgcaggtatgggggcagcaggggtcgtggggagtcccacaggccagggcctccaagttgggtagccagacacatcgcttggctgagaggcatagatccggaaaggagaatggtctgttcagccccctgccccgtggcccttttctccctgacctcctgaatctcttacctgctcaccccccaggtggtcacgagccgggactcccaggagaccctgcttgtcattgcttttgtcttcgaagtctccaccagtgagcacggggcccagcaccatgtctacaagctcgtcaaagactagggtgccctctgcgcctccttaaggatgcagggtgagcatctcctctccacacctgcctggcacccctgggggggtccaggattgaggattcatctacctgccaggcctcaggcccaggacccaggaggcctccccacctaccccagcacacacactccctgccactgttctgcgctttaattgtgggagaagagaggagaggagggctcagcggtggggcagcctgtccggggcgctgacccaccatcaccctgctctgcccagcctcgcgtgacctcagagaggtggggataggggacaccttcagcctccagcatgtgtggccactgtacccccacccacccttgggggagcatgatgggcaggtgagggcaggatggagaccaagggagtcagtgagcagaggccctgggagtgtccggttggggttggactgaggacagaggggcccacacttccttgcccctttgtgtcccaggcctggtgcccagactccttgcatggcttgtgtggtcctcagactccgcacagcgagcgtaggtctctgggtttcagatgaagtgcccaggctccaggaagttgagggacccacaggagaggtgggcagagctggagttctcatccagggctgcttgtccccagagcccaggtttatactacctccctggggcgggggctggccgcagggtaggggagaggctctgcagtgtggagtggagcctcatcgaggggcgctgggttaggggagcacctgtttcagactgggcatgaagaagggagcacagcagctactagaccccattagcacctcattagcccacaagccagccaggggccccaggaagatggggcaccccccagcaccctccagattgagagcaaggtagaggaaggagtcccagcctctgggcagaccagaggcccagagggagagagtagcagaaggcttttgatttttctcttgcctgaggcttgaatctgacaaacccttggtgggcactgctcccttaggttcttccccacctcaatctacctgcctagagtagcagctcccagacccagttctgggactgaaggttaacccttcacctgctgtcccttcttaacacccaggcccccagagccagctgggcctgtccagcagccacctgtgggtatttatgagtttcatatgaagtactgtgccccttcccttcctcatcccgaccctgcccgagcttcctgaaggtcctcactgtttgcatatcgctcaggccacctccaaaccccacctaggttttataatgtatattatatatttttttgtgtatttttaaaatccagctgtgatgggttatatcataaatgcagcttggggttggagcaggggccctcaaaggcccagctcctgctcaaaaaaaaaaaaaaaaaaaaattaaagttatttgtttgtgggtcagtcatgt

SEQ ID NO: 37245 - DNA, 116452 bp, Homo sapiens
gagtgcaaagcgctctccctccctcgcccagccttcgtcctcctggcccgctcctctcatccctcccattctccatttcccttccgttccctccctgtcagggcgtaattgagtcaaaggcaggatcaggttccccgccttccagtccaaaaatcccgccaagagagccccagagcagaggaaaatccaaagtggagagaggggaagaaagagaccagtgagtcatccgtccagaaggcggggagagcagcagcggcccaagcaggagctgcagcgagccgggtacctggactcagcggtagcaacctcgccccttgcaacaaaggcagactgagcgccagagaggacgtttccaactcaaagtaagtgagaggaacgtacgatttctcggagggctcttcgatcgagtttgccttcaccctgtgccacttttctgggtgccagcagatgatggtggtaggggtgagagaggctgcctggtgtctttgctgataggactgctttcaaaactgacttgctccagaggccaagggaggcatatttttggggtttcaggttaggttagttcgggtgtgcttaggtaagtgaaaggaaagaagtttttgtgatgttaagcatgtatttggaccgtgttccagctaccagctggagagcaagacagggtgggctggagagtgcatctttgctttttgtaaaacctggagctttagtaggtgtgtctctggctgggtaggtgcaaagaaagtaaggcagcctgaacaagcagctctcattttcccagcctctctctgattctctgattgccccagagcctgtcagcccatgactcttagctggcatttctaggtaagctgtgggggcttgttcctcccagtgctagctgacatgaaacgtctctcacggaactactggcacccgtcttcccacctgacagcccaggaatggttccagaaatggttaggtccaaagtttagaagacacacctggagtcccatctctcatttgaatgcaaatttaaagaactgcccagtacatagacccttaaacttttaatttgacccacataaatttaggatatatttgttactaatttactagatatttagagtttctgagttgttgtttctaataagttaagaaaacattttttgagaggaatgtattcaactcctttcttaatagatggaaagtgaaacctcctctctcctctccatacacacacacccctttctccatgacataatgtgacacaacacacacacacacacacacaggaacacacacatgcagtttatatacactctagtgttaactcacccttgtgtctgttaagagctgctttgtaagtttggggacacattcagaaaataggaggggtaggggtgctaagaggagaaaatattaaagctgcggtccttgagcatctctcattttaagagttatcaggcattttgctttagcagcttgagaaaggggtgatgtgtgtgtgtgcgtgtgcatgtgcgtgtgtgtgtgctagagagaggggtctgggaggagatttagaaatcaccaaaaagagctctggactaataacataatgaaacattttatgatcctaggcaaatgtggaattgatgaaacagcagggcccattttagccccttaattatccgggaatgcattgatatgtagaaatattgaaagttaatgacaatgaaacaaaagagaagtctcccaacacagaaaataaagctgtattttccatcttcattatgtttccttttaagtaaattatgcactttaaaggccaagtcgtttaaaaaatatagtccagttaaattcagaggaaattagaatgaatatttttttcttcctttgggacatgagttatttcagactggcaatatttgtactttttcatttaaattagaagatgagattttaaaaaattatattatttaaaaaaaactctaatgccatccttttgtgctttaagaaacttgggccttaagttctctaattgtactttaaataaatagaaggtgatcttttttctgccactgctcactggttccctttaggacatctttttctgcatttagtgaaaagccactataaggaactcccacctgaagccacatataacagcattaggtgctgtgttccagctgtttgcttctggatgcaaatgcattatgttctcaaagctagagcttgagataaataaaagtactattagatacatgactttttaattatctgactttaaatgagatattatagataattagagtaataaggtatacctaactatatttatagtctaatgtattatatgtattatatataattctctgtttttttagacccctttccatgagatcatgagatttggtttaataaacgtattaatttattgatattttccatatgccttatttgggcttcacatatagcaacacataacaagatctacatttctttttaatgagcattttcattttttaaaaaaatttcagtcaagccaatggcctggtttaaaatttcataaaagcctagttgttgaaaacaacagagagaaataagatccccagatagttgaatcactttttttagtaaaatcaatcttagatatcaaatattttaactttaaatattttatttttcctttgaagatatttttgctttctcacttacatggcattctcacatgaattctgaccatattcctatttgtcatgtggtgtttttaattactattcaaaaatttcccacaaaatcgagtttacccggctcgttgaaaatggtgtgataaattaacaatagattgagggcctgaagtcagaattcagaatacaaattccagttctctaaagaattatgctttttaatatggcggcataatgatatggggagttgttcttgacttctctcaggaaggaggtgtccagactgagaccacccaatgtgatgagtgcaaacatcctccacacctgagtgcacctcagcccagtttgagatgtgcttttctctggagcatgaggctgagtgggagctctccaatggcctttgttccatagctttgctagtgatgttgagttgggcttctccataagggtgaggaatgtttttagctctggcttctgttctaaatgaatagtcgaagagtttttgcctccttctggcacaaggtcatgtcactgctgtgggaggcgaagtaagatgatactcagatatgaaccttctttttatgagctgggcttgcttttttccatccagagtcaattggcttaagtggaatttgggccatggcctcgtggaaagttgtttttccttctgatgtttatggacaattcaagtttccacccactgggctatttttccatccacttcaagccagtctagtgtgcggcatagttttcatggtgtcattacaatatttctagattgtaaaatataacaaacctctttttctttctattttggcatttagtaaataagaaattaaaacagtatcttaaaagggtagctatgatggaacactatcagagggtattataaatatgggaatattgtggacttaattatgtagatcacattcaccacaaatctctatttcttcagggtggacaaggaatacaatgactccttcatgtttgagatatttttagggataaaatttaattcatttttctaggctttatttattgaaccattttttcagagtgggttgagataaagtgatatctcaaacagaaaaaaatcatatccagttttctaaaaatagaagtcttagatttttttcaacttcacacatagtgtaacaaaaaatcaagcgctgtatattaatcttgaaaaaagtgactcatagtaactgataattgggctcttaattctaagaattgctcttagcaaaagctaaaacataattttaaaacacaaatagcattctgtctctaaccctttgctcccttttcttcctgcttttacatttacctatttctccttcttttctctcatttctccattaatttggttgccactatttcccacccaacaggtcccagaacgtcttgcccaattccctcttgctatgatggcatacatttctctatgtacggatgtaccaggaatgcctgcccatatgttggcattcttggaagcttggaccttcctagctgatgttttcaacaccagtgccctctctactgattcaatggcatttttcccccatttttttttttttttttgattcaagaccctgcctaagggtcaggcaacattttcatcactgcaatgttgacctcattctcttctcagtttcccaacatcaatgtagaggcgcagctggagttactcatgtccatcacatcgtctcggggtcctactccaacaatacaatttttcttgctcctgtggccagccaatttaacaatatttattgtacgtatgttggatgcctaatactacattgtgctggacaatgtagcatgtttaagaaatagaacatggtgtctatctctatggtttcacaatatctaatactttgtgtttggtacgtggtgtgaacttgtgaaattctttattagaaatgtatttaaaggagatctcaattaaaatccattataccctcacccatctctggaaaagatgctttaaaagtcacagattgctaatcccaacattttatgattatctcatactgtaacctccttgatatgttattgtcttaatgttttcctaatttctttgggcactccttttttcatgttttgttttgcttttttttttcttgtcttccaaatgtgtacatttatttccaaatatttcagtttcccgccttcctctctcctctccaaatgctttagtattgtcacaactcttctttgagctttaactccttcacaaggaaaattctcagatctgaagagaattgaaggaagattctctctaatgagctctggactcacatttttaatattttttcaatgaatactgaaggaaatcattcaggcacaattctatttggaggaggagattgaagtaaaggacttcctgttattttatttttatccctaccagacttttacgcatagtgactgacatactatatggtaggtagtgtgatgagggaaacaggacaaataaatatgtcttcaagcagctaatgatctactcaatatatatgtaagaacattaaaacactaattactacaacacaggttagaggaagatatgtacaattgttgccctaagcagttccaatgacaaagggatcacatttttatgagaaaaaggaaagtggagctcacaaaaggctaaatggtacgcaacgtctatttcaaaagcattatgtctgtttgttcctttaatgctgtttattctggaagggaaattgaactcctgattccttcgtgttttcatttcacatttgccacataacgtagcagaaacaaattattggaagtgacaacttaagaattcagactgagtttatttagaatcaatataatttttaagacatggcactccctgtagatgtccttttcaggaaaatttataccagaagagaagagtgtcctttaatgaaaacatatacatgaagggaaagaaggcaaatccttgtacttcagctgtggaatttgggtgaaatcttgagtcggaaattgaaggcaccaaaggttttccaaggcaaatgccccctctaggtggagctatatttcttcccttgtcttcgaagtctccccatcaccccttatagtgacttcagctcctcctttctcaccatttgacaccagccccaccccatccaacctgtgcaccctattaaggcaagggctgtctctcattctctcaagaaccctagcatatttagcatagaaccattgaagatggcaaatgagtgagaaaataggcagctctaaatgccattcattctctttgcccatgttgttccacccaccttgaccatctgtgttctatgcctaatccccttgccttaccaaacaacctggtgccaatttcctgtttaagcccaagcattcccattctcaactttgaacctccagaaacttctcccactctctttccttcactcccttcattacaaatgtcatataggcttgctggttctctacagtgtcttcctaatcatatttcaccttgataattttaaacttttcatagttgccgattcaagactacctccagaatggagaaaaccttacttacctcttctttaacaaaccatattattcaaagtgacaaagctagtaatttgaagcattattttcattataacttctatgtagctataaggcctgtttttaaaaatgtttcacatttattttttcatcatatttttgtaactctactcaggtagattgagtgggatttttaaaaaattgatacagaaatgcaggcttagagaagttaagggggccatattcaatgacatacagatatgaaaacaaaagtcttaaaattcctagtttgagtttattcctctgtaatataatgccatctctttcttaggctaataaatagattttatctcccatttgtctctcatgtcaaaccccaaatccaatgtatgtacagttagaggtcaaataacctacagcagcagttccctgtcttcaatgtttatcagattaactagcgtcatgtgtaggttccagctgcctggagcccatcttcagcagttctgatttaagaggtggaatcaaggaccctggacatacgacagggcatgtggatacggatgaaacattagaaacagtagccttaatcgctcaatatttgagctccaaggtccaaaatactgaggtataaaccactgcacttcttagtagctctgtgaccgtgagcaaatattgtggtctttcttacttcagtgttttcatctctaacatgggagcacatacctaccttccaggattgacgtctgagtagtaattgagaaaatcaatgtgaagtactgaacatagagtctgattgctgggagtgtttgagcaggatggtgaaaatgatgatcatggtgaagcagcaccagatgcaagtcctcacttcttccccctcctgaattgcttttctttctcatgcccacttggcatctgcaacaaacatacaagcaaaatcctaggtggaattccatgcttcttgaaaggcctcgcccctccacatgctcataccattttcttccttctctctaaatgcagattgaaaatcctttcttctggaagaaaacatacggagcatgtgatcatgctcaaggcctgggggttgggcaggcaaagtctccgatgcagactctttgaccttatcccttcccataaggtataggagagcattttgcatacagaagactcccaatccaagagacaggcactttattgctgaccttagtgatgctcataaccacattctctctgacccctgctgatagaggcttcagtccagggaaggagttaaggtttggagtcaggaaccagcatctcaccacagtccgcctgttgtttggtatgggctgctggatgtgccactgaatcttctgaaatcttaggttttttagctctaagtgggaaatgatgatgatgttacttgttttgccaacctcataggttggtggtaaatgtcaatggtcacgacgcaacatctgtaagctctaaactgttatactgaacatgaactgaacttaataaagtcagtggggcaagttctgcctttctggtttcccaatcctgctattgtcattgtcattttctcaggacacacagagattgcctaagttgcttgaaggtaagtttgactcacaaagtgaggaggaggtaagatgtgcgacaggaatgaagaaaaagaaatgagtcatactaaaaaaaaaaaaaaaaagcgagaagacatcttaaatgaggctgaactgaaacaggcatgctttcttttacctcagattatgttatatttccttctgaagtgtcttaaaagctacatgtcacattttttaattggttattctcactaaatataagccttagtaattggctaacagcagttcatttacatgatagctggataactgtgcttctcaaactttcatgttcataccagtcacccagggtctttgccaaaattcagtaggtctccaatgaaatctcagagtctgcttttctgccaagctcccaggtgactgcagtactgctagcttggcgacctctctttgagtagcaagccacaacagtttaattcaacaaacttgagggaacaggagacaaatcagaatgctccagtcatgatgtccatagcttaataaaaatgatgaggatcattgtcaatatgttatatgcaaaagcttctaaaacttacatctttgtgaccaaataatatttacaatgtatgattatttatgaaagaaaattgcagacaccacctgatttgctattgacttcactgaagttcccttaagtgtaaaaagcccctggccagatgttgcacttgggcctccttaccagtgcttctgctggggtctttctcggagagggtgtaagtgatccaaatgttgccttcttcatttgctttaaaagctaatgaaaagtgtttagaaaacttcattcttttttttttattattattatactttaagttttagggtacatgtgcacaatgtgcaggttagttgcatatgtatacatgtgccatgctggtgtgctgcacccatcaactcgtcatttagcattaggtatatctcctaatgccatccctcccccctccccccaccccacaacagtccccagagtgtgatgttccccttcctgtgtccatgtgttcccattgttcaattctcacctatgagtgagaacatgtagtgtttggttttttgtccttgcgatagtttactgagaatgatgatttccaatttcatccatgtccctacaaaggacatgaactcatcattttttatggctgcatagtattccatggtatatatttgccacattttcttaatccagtctatcattgttggacatttggattggttccaagtctttgctattgtgaatagtgccgcgataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccatcaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgttattttcttgtaaatttgtttgagttcattgtagattctggatattagccctttgtcagatgagtaggttgtgaaaattttctcccattttgtgggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtattgcctaagttttcttctagggtttttatggttttaggtctagcgtttaagtctttaatccgtcttgaattaatttttgtatgaggtgtaaggaagggatccagtttcagctttctacatatggctagccagttttcccagcaccatttattaaatagggaatcctttccccattgcttgtttttctcaggtttgtcaaagatcagatagttatagatatgtggtgttatttctgagggctctgttctgttccgttgatctatatctctgttttggtaccagtaccatgctgttttggttactgtaggcttgtagtatagtttgaagtcaggtagcgtgatgcctccagctttgttcttttggcttagaattgacttggcgatgcaggctcttttttggttccatatgaactttaaagtagttttttccaattctgtgaagaaagtcattcttaatatgaaaaagatatatgtaatatatttacttagtgttaagagtcttcccttctttcacattttaacgtctataactgcattagactctttccttccataccataatggaactagaccaggaatcatccatctttgtgacttccttgaagacggtggggctgcccagagaaacagccagggctttttgcttcagagtccagatttaattaataaggaacatattgtggtaacagtcttaggtaacacagaaaatcttcactcaggctagaacaaatagaagctatcttagtctgttttgtgttgctataaaggaatacctgaggctgggttctgtgtaaagaaaaaagtttatttggctcatgattctgctggctgaaagtttccagattgggcatctagtgaaggcctcagatggcatccactcatggtggaaggtgaaagggagcaggcatcacacagaaagagaggaagcaagaaagacaggaaggtaccagactctttttaacaatcagctcctgggggaactaagagtgggaactcacttacccaccctcccaaaacccaccagggagggcattaatctactcatgagggaatctactcccatgacccaaactcttcccatctggcaccacctccaacactgggaaatcaaatttcaacataaggtttggtggggacaaacatccaaactatagcagaaaccatgtaaaactttagaacagtgttttcataatggctttcttatttgatgtgaatatggcttttttcaagacctagccgtggggtcattgtgcccagtagcagaattatctctgaggttttaacatatggtggccttaatttgtgagcttatgaacatcagattgttggcttaaaaaacatactttggtcttgaaagaactggatttcaagggtcaagtcagctcctcaaaaaatatttattacaaaaaaaattgccctctctgtgcaatgtatttctttagatatgttccagggaattcaaatgagccagccagaagctgctagaggagagaaaacaggtaggttattagattatttttaaccggtgtctatgcttaaatcttgaaacaataaaataaagcctttcttcccattattttttcttatttacaatatacatttcattattgaataatgtttctgggaatatgcagaatctcaaatatagctcaacgcaggtcaaatgtgtgaaaagtttgattaattttaaccatgtgaaaaataatgaaatatttttttttccattatgatgtttcttattaggaaaacacaaatatacctgaagaaacacattatttttcccattctagaaaaatacatgttcgtggtacaagatattcaaattttatagaaaagaaaacttacttacaattcttgaaataggcaccactgttagcaccctgatatacctttacggtttttctgatgtaacttttaaaaatagttagatgcgtaattgggtgtcctgctttttaacagtgttactgatgcatgcaatatgttttaacagctatgcacatattaacatatgcacttgattctaccaaatgagccaattaagatggaaattcaatttatttagctcggtatgggtaaattagaatcataaaaaatgctaagtaaattaatgttatgaatgctcataaaagagccagcactgggaaaatgcaagcaaacaaacatctcataaagcaaacaaacaaataaaagtctttgtccttgcagatgtgctgtttagatgggaacaaataatcctggagaactcagtgtgtgccagttaaaggtcaagctgagtacacaaggtctttctttcttgccctaaaggacccttccatatatctaagggtaaaagtctccccagggaagacacagctgcctggtcccacccaggttggatctaaccccttagctcctctcaagagcctgagaagctttggagttgctgtgaggcccaagggagtgggcctgatgcactgcaggtgggtaaactgcaagatcagcaaacctctttgatgcgtgtcgctccagggcttggcatccttcagggagttatttgctctgttattatttggaatgacgagtgaacaactggctcgagtttaaagtgagtcagatcaaatttgggtttgaccaccacattcccgatcgcagaggaggagtgaaagtcaaatgcgtttagtatctgtgccagtattgggattcccaccaactttggcctgaagtgatttttagcctttttaaattgcggctttagtctgatggttagggaattacagtttgccttctgatacgtgatatctggggatttgaagatgtacttcaaggctgtaataaatgaatttgatttggagaagcagattagaagcagttcagcaggaataagggggtagatgtggatttctaccaatttctctctaaacagacagatccacatttcctaaaagcaggctctgtgggtttctaatgtctcatccagtgacattctttcacaagatgttaaatggaagccctttatgtcaaaggcagcaagaccaataagacaaaagaaacagcatggacttgaactgaggctttagagaaaacatccaagaatcccatagatagaagccccattcctggacagaggaacttcagacctcacataaaattctattagatagcattgaggcttctgccactaaaaaggaagtattgagcatgccatagggtccttatggcccatctggctgtcatggtgtatcctaaggagattcctctagggtggatttgccttctttgttttccacatctcctcggctccaggtgcctcttgccataaaagtcccatgaaatcactccagctctgtggagcaaacctggtcctcttcttgtttttctcagagggagtgtttcaagacaaagcaatatctgctgttctagtgaagagttccttcccaaaacagggcctgaggaatcttgggtgcagaacctggagttggacaatctggtccctgaagccaactcttccataaacctttctaccgtctaacgcattgttttcattcatgtcctccccacctttagtggtggatcataaaagcaggagactaaagtgtgctttttgtgggctggagcacaccagggttccttcagccagggctttgctgcacatgtgccttctagatttgggggctggctttctgccttgattgctatttgctgtaatgtgtgatgttcaacattctgtttcagttcagaaaaaagtttaggttgggtatgtctcttcttcttcttctccttctccttctcctcctcctcctcttcctccttctctttctccttctccatcttcttcattttttttgagacagggtcttgctgtgttgcccaggctggagtgcagtggcacgatttcagctcactgcaacctccacctcctgagttcaacatttctcttgcctcagtctcccaagcagctgggattacaggcccatgttaccacacctagctaatttttgtatttttagtaaagacggggtttcaccatgttggccaggctgatcttgaactcctgacctcaggtgatccacccacctcagcctcccaaagtgctgggattacaggtgtgagccactgcacccgaccaactggcattattttcatgtggaggtttccataagaagctacttgaattgctaatcttgcattactgtcttttatacttaaaggaagtcactatattaattttgagtttcactggctatgtttcttgttgctgaacctcattgttcctacgattgtgtctaggtctttcactttaccacttcctgaatatgcattgagtatggatattcctgaaaatgatggagtacccactatatgccagttgcagatagtactcaatccatgcttattgttgcatagaattggagtaacattttactactttctattcctctcttgtcccatgtctggaccttcagaaactctggcaagaattaatattaactggctgccctagtgcaaaattgtgacatgagtaatcattttctttggcatctcctgcttttttcttctgctctgtcctttgtacttagatgatggttccctcatcagtgctcaggtacctggagccaagctcctgctgttgtctgaagccataccttgtcctctaccttcaccctggacagtggcgtccctaacttcccttgctgtgttttgaggacccatggcaataagtcaaaatcaagacctgccagcacctctaaaacgttgctcctaggaactaccaagagcaaggagacttgctcccttatcaccaactagttctagaagctgaaggccttgctttctgttcttattatttctcatcatttaaaatttctgagcacaattcaccagcattaataatactgtcataatagctgatacttattgagtgctttctatacagtggacagttcaatactagaactttacattcagtgctgggttaaatgctcccaacagccctatggggtaaagactatttttcttcctaaatgagggaaatgtatctcagaagtaacttgtccaagatcaaaagctagtaaaaaatagaactgagggtgtagtccaaatatttctaaccacaaaattcttaaacgtcatactcttctacctccattcccctattcaatgtcaagggtccagtgagtatttgaagatattctggttcatgattcctttcttccctctagccagtatccaggaatatttcttcatattatgtcacttatttctacctccttatgatcaagagattaccgtgtcttggataaggaatgttgctgttagattaccctccttgattgcatatgattgcccattgtttaattcccattgttttctcaaacaccagttggcctggcatggtgtttcaacatgcctgcgctgaggaaagggaccgctgggagtacaagcaggagggtgtctaggagctgctcaatctgtttctccagcctgccatcacctgactaaattgtttgttggattgctgtgttctatcccttggggaggccacagtgccgggtttgtttgtgttgagagtctctggctttgattagcagctagctccagtgcagctgaacatacaatagggaccaaaggatgggaaaaaaatcctgctacagtttcccattggaaagcattcactgtcaagcttggacatccaacagtgggacacagatgaacagaggctgggaaaggttaggtgatggattctccatgccctgcagcctgttgtgagtgataggtcattcctttacatgagccttgagcctctatttctctaaaatgtcttttatgattcaggtttgagactggtattgatgtagtttgacaagaggcaaaacctagaaagctgcaaagcatgaaggaaccccaggattacaagagctagggtaaaagcagtgatctatcttaaagggctagtcacacagtaaaaatttttaaaagggtctttaatctggcagcatggaagaagttaaaataactgtaactgtaattctacagctgaaacagggaagtaagacatttttattttataatatagttagtgatttccttaccaaactgataatataatttttatttcttctcactgaattaaatattaaatctactgcaagtacccacacccatcatccagtagctgaataacaaggtgtccgcctgaagtcaagaacctctcatatatccttagagggctgcttcagttgtcaaggatttttaatcaatagaatatctgagacactgggcatgttccaacaagacactgtccatgatcctggcctgtaggcatcttagtttcatcctcataaaaggggacaaagcagacttagagctggaaaatcaaatgtaaaatgaaatgataaaagagtggtttagtggttttttttcagagaaggaagacattctggtctggagtggaaaagggtggctgcatataaaggataggattttcttttctttttcttttagagatggggtcttgctatattgcccaggcgggtcttgaactcctggcttcaagtgatcctcctcccgtcacatcccaaagttctgggaaagggtaggattttcaaaggcagggtggcattgtgtatggcagaaagatatggggaaagcatcccaggtaacacatgaagaaagaggaaagccaaagagatgatcccaggcaagacctcagagacagaaaacagaggggcctgatttgtgcagagagtgagtggccaagagtggaagcaacggttagaaaaaaaatgttaggagtgatagcaagacgcttcaagtgaaagctaagctgcctgaattatatcaagttagattgtaaggaatcactgaaggttctccacaacagagaagaaaagaattggtaaaagtaaggcataaaaatatcatttttaaagaagtaacagatcagaggtggagagaatcagttaggtttgaaaacgtaatgctttgtgtaccaacccttaccctaccccttgatccttttacattctggaaatcctgtgcatacttcaatggtttgcttaaataccgtcacgtccgtgaaaattttacctttattcccctagttaaaatgattacttacccctttctctgtttcacaactttctatggtttccttttatagtcattcattcattcattcattcattcatgtgttcatttaaaaatatgcaatgcacacaatgagctgggctctatgttaagtatcaggaatacagagatgaatatgacacagtccctgtttttgaataggacagtctaattggggggagcaggcaggcacatgaatagctaatcagtgaaatttcagtgcaatgaactagatatgcacttgtaaaagcccattggagagacattttagtcagctgagggtggattcaggggaggcttccaggaggtagtgtctcctaacttgtgtttaaagatggaaaaatataaggaagaaagtgtgagttctggtggaagcaacggtgtgaatgcttactcattcttatatgacagttactttaaatgactatctctccccacttcactatagatctcttagccaatacttcatacaataacagatgaatgaataaataaatgaattgctgatgccttggtgtaagtaggtagttaagacagattctttctggacatgccgtgaggtaaaataaaggctatctgtaatctagacattataatgggaggtgagtacatgaagggtgagtaaacaatgagatgttgacattgatcaatttgggagaattctagtgccattgatagaaaggggaaatgtaggggaagagctgatttggggtaagagagtgttgcaagcctgaaggaattgtggagagacaggattatcctaagaactgagcatgaactacgtgcaggcttctgaggtctcactgaactgtggacaccctcaatgcctgggaggccctttcaatgagaagtagcctcaggcttgtagcacttggtaattggtgactgggctcccatccaagctgcagatttctagtcccattactgtaccttcttcttcctgagcattcacaacatgctttcattagaaaatgtggtaagaccatattaacaatttttattttctgagaaacgtttttcattactttgcttcttactttaaatgttccttggatgcatcagctctcaagaaaactctataatcacgtctagacatttcacatgcacatggaatggtgtgaggccatatcttccaaaggaggccaattggccgaggagaggcttctataatttcagtaactgcattttagatgtgcactgattcactcatgcagagatgccagctcttttcttgaaactgcttgttttcctatgctcaaatgaatgaccttctgccaatcatacatggagtcattatttctgcagccagtggaaaaggtagttactcatgaaactcaaccctagggtgacagtgaaagccagattgttatggcttggtaaatattgattaaaatatgtggagaaaaacaaaatgctgggcttccatcagaggcagaaacagtctcttatgctccttgttgaaagggcccctgccctgggtgggtgttttgtgatggtgatgttgcttcttgctgtccatagtcagcacctcctcctcctcctccatgtgccctgctgggatgtgaagacactcccttccttttctatattttctttatcccactccaggcatccttcttcctagggagggcagaatcagtggtaaatggatcattttcagttttcttcctttaaaattattttttcagctttgctaaaagaaaagaatgctcaggaagtaaatattgtctggtttccaatccccaatttaattaatttaattatcagccagaagagacaggaaatgtcctggggacagagatcagacaagatcttttctaagaaagccatttaacacagggcatattatatttaatgttgttccagattcagatttagtcagcaattcctggtccagataatttggggcctgggagggtaaaatcttgcaatttcactgaagctctgccttatctgtttcctttgacaaatcaggaagctactgcaggatgagcctattacagtacaattaaaactcttttatctgcagataacccaattgatatttcatactctgtttcatactctgaaacaattcatactctgttttggctttccattaacagctaacatccatgtaatattttactattcacaaattgccttcctatatctcatcccattttatactctaaacaattctgtgagatccattttagtattattaccctttccatggatgagaaggaggaggttcccagaatggagacttctccaagatttcttcaaaaagggagtgtgacagttgcctcactgaccttactggatctttggagggaattatcatagcctgtgaaagtattttgcaaaaaaattttttttaaagttggcgttttgttattttctgtgtgtagattatttggcttaaaacatcagcttacacaatcgtagaacattgtctcttaaagaacaatttacctgttctttagaatctcatggggctgtggtcttaaagtgccccatactttatctatgaatcagaatttttagatgagggcttaggaaggttaatttatatatatatatatatatttttttttttttttttagagacagggtctcgctgtgctgcccaggctggagtgcagttgctattcacaggcataatcattgcacactacagcttgagcccaggaattcactcctgggcttaggcggtccttctttctccacgttccgagtagctgagactataggcatacaccacagtgcccagcttaagaatgttaatttttagcaaggccacagaactactttcagacacactaaagtttgagagccattttgtgtgtgtgtaatgtatttggcatgtatctattgaaaatacgacctactatggcactagcagtcttctagaatttgttggaatataatagattctatgttctagaccagcctctacaactggctgattttgtattaaatcacctgaatttttcaggcttctatttcttcatttgtaaaacgagggacctacactaaaagatctctaagatcccactaatttctttgattcagtgtctatgattttcctagattacgatctgtggattctcttctctctccccatggaatactcttctgattgtgtttaagttggtggctctgcagcatcagcttcacctaagaactcgttagacatgcaaattctcagctagtaccccagactctgagggtagggccagcaatctggccctttaatgagccctcatggtgattctaatacatgatcgagtttgagaccattgagataatcctgattagtaaattcaagcatataactacacaattataacattttgttttcttaaacttaggctatggctatgactaaatatctactgctgtctgtctcacagggaatgacattaagaaagcaaaatccctctttgtttttcatatgtgacttccaagggtaaaaactcaactttccatgttttgaaagtagcttctttcacacgttaaggtattcagacatcatttgaaagtttggcaaacaaatgaagttttaaattactgacagtcttcactttaccatagtaaaattaattcacaccagtcccccaacaacataatttattaatatattaactaaaagtatataaaatacttaaactgcataaatacaaatttcactgctagctgctcaatctacaaatcacgacatacataacaaatttgctttctagttggtgacccatcacatcccttctttcatagtctgtctgtaattggtcactgtgaatctgttattcactttaggcacaggcaacaaaccatgtacttttgttgtctccctgtctcacaatgataaattcacaagatgtttttcaaaaattggtaatccaaagaagaaattggacaacaaagatgaaagtgcaggcaagaaatgagaaataatttaacactggaagtgaaactcaagtcaaacataagtggagttacagaagtaactgaaggtaaaaacattgatgctgctgccacttgagagactctccatgtgtggccaaaggcacttagtaaaggcaaattaatagctataaataaggaaattggatatgactaagaggatgaaggtgtcctgagggaattgatgctggcagtaactcactttaatggattcttggatttattttatgacactgaaagagtgaagaataagtgaagttttggaagctaatccaaatctagaaaggtgtatgatgatttgccaaggcacggaaaaatgcttattctgtattgtaatgtgtaccatgaaaaaagaaaagcaagctgttctaatgactcttgataaatactttgcaaaaccaaacactttacatctcaatatttctaatgttttatgtggctgtatactaaataaatatcaattttacaatattttaatttttctatacatttatgaataacagagtttttaatgataggtcataaaaaaaaccataattttcctattgataattaaggttgatcttaaaacaaggtcagttttatggtcctaaactactatgcatagcaagaactgcctatgtatctcaagtttcaaatataaacactttgaaagcaagtgtattactccagaactcatatgtcactcctaaaaaataactatatgaactgatatgttttatatttttaaaatgggctatagatgtcaccagttgaaaacatccatccattgcttccctcaatcaaatatttattgaatgcccacatgttattcttctaagccctgatagcacaggagtaaacacctattaggtacctgctttcattgagctttcattctcaattaaggaaaagcaaataagtaggcaaaatttcagcaagtagtaaggaagaaaataaaagaggataatgagttagaaaatgagtctacgtacgagggaaggaggggtggtggtttaggaaggagagtgccagggaaggcctctaagcttcagctaaacatgtttctgttcctgggctgagataaaataacagtttcagtggttaagtccgaagttcttactttgtaacttattgtacactgtatttttgaaaattaaatatcaatattaaacttttttttacttatcctagtcacatacgggctattttaagtaaaacaaattttcaaagccaataattaatttataaatagaacattaattctaggctatggtaactttccataatttaagcattaaacaatatttcatttttgctgattacatatgtttaaatctggagccacatatttgaattccaaaggctgtggccatagcgctactgagaaatgattattaaatagtgctgtgacaagaagaagaaattatttctggtagtgattaaacagaagaaaagccacccaatcttcatatcaaacaaaaatcacattgtcatggaaaaattataaacctatatataaaatatctttgagcatctaccatctaagaacgtggcatcaatgataaacactattagtgccagaagaaatattgccactaattttgcaattaacacatgagcatgaataaagacattggattaccttttttaggtgatgaaatatgaactgtgagagggagaagtcaatataaaagatgtggttaaaaacggtattaaagccaaagaaagatgcaaaccatatttggtgtaaaggattttattctttcaaaacaaacatctctttgattcttagccaagctgtgagcaggtatagtgccttcccgtaagccagtttgacaactggtattaacctcagagttcagaggagagagaatgtggtgaacatgcagggtctttgcttgtttagctgcacatgtgttatataattcagtaccacctgcagcatgaaaacaagcttggcaatagcaagggagccctaatagctgttgggtcgtttccttaactgtccattagcctggatgctctgaacgggacacctgtggacacaaagtacattgttgaatattcattgtagagccacagcacagttgacctcaaagcttactttgagtctgtgaaaaataaagccagaagttataacacagagggttcttccaatcccagcttgcttggcaagatgaataaccaccatatcaagatgtgtgaagaagaatgacaaggtatcctgtagggcaggttgacaatgaactgcaggactagagaaggcagagcaggtttccataaggcaactgctgttaggaataaaattcaattgacaagccagtgtcagaaaatcatgagaaagcatataatgcaaacttggaaaaaaatccccaaacctattatgttataaaagttcatttttctctattccgtatttggaatccttttttaaaaaaaaatcaaaattttgctttaatcctctttctcctatctaaacaccttcccagggaatttttcccgtttttatttctgtcaacaatagctttaagtttgccatggagcaaaagtgctccaaatctctataataaatgcaagtcactgcatacttgattgtgcaaggaagagtatcaaattctaagaggaaagcacagtactaaatttcctagaagtgtgaaatgatccagttatagttgcactacagtagatgagtgagttagaaaatggagtcttcattttaaagttgacactaaaatgttctgctttagagaaagattttacagtcctatgtgtgggtcttactctttccgtcaggaaggtaagaagtaagtatgagcattgggaagagacagtgcctgtgaatgtgtgggcgaattatggtgaaagatgagtagaaacagacaaaagtagaagactgttttattctcccatggtataaaggtataagataataatcacacaattgaggatgctcaatgattgtcatttaaatatgaatgcgtatatttatgtcttccaaactagcagatacatatcgtgcaagggaattttggagctagaaagagagagagatttgttttctgcctttttgaatatcctgggaacatggacatacagacatgtggcctcttaattagcagaatacacgtggaggggattacttaggagtattgagtatggactgaaaaactgacctagaccacataagactccctttggcccttggatgttacactataagctacttgaatgctatcctaaacgtacaagaccataacgtcaaggagtcccagcaaagctgtatgaagctggagtgcaggtacccgcccagcccattccggcaaaagtattcaggtgttgcccccagcttctgggtctccaagccttggcagtttgtccggcttctcatctgtacaggtttgaataccctttgtggacacacagagacattttgagatcctgataaaatggaaaacaaaaccccacaggggagacatcctgggttttccatttcaatgactatagaggaagctgaatggccaaaaaacgatctgccagctaaacaaggaggactgtggtcttggtgaagtgacaaagagatgttcgctttcagccccttggagtgccttgattcaatgtcaggttttaaggaacgactccccaaagaactctcgggttgtgggtattaaagtcatgcccgctttggagacttaagctttctgagaacaaatggaagaaagtaaaaggttaccctttgtaatatctcacatttaccaagccggagactgataaatgctctatctttatgactcaattaattctcacaagaattctgttaagtgtggaaactaattaatcccattttacagatgaggaattcgaggctgagggatattaagtaaactgcagaaggtctttgggtttcaaatacaaacactttgagagcaatgatttcctattactccagaactcaagtagtcagcgacgatgtggtgtctgttgaactagagagcttaggtctttttaggcggacaaaaagtagagagtggtggacaaaagtagagagaaagatagatggatcagaaaaaagtatccctacagtaatttaaaaaggaagagacacgacagcagtcactaaaatgccagaaagcagacaaagaatcttggtgttggtgacggtagtggggagggagagtttattctacttattgagggcaatgcttaccgcttttacataccttatctcacttgaggcactactattccatttacaaataaggaaactgaggtctcaggcaggttaagtagatttctcaatgatttcagccagtaattagcaaaggctagatttgaacttaggttgtctgactccaaaatcaatgttgtgtttacaacttcatggtgaatgaaggccgacacccagaaagatggggaaggaagatcatatcattcggataatgcctgtagtcatttgttcattcacgtattaattcgcagcatacacatttacttgtctcatctttcaaagtcctggaaatagaaagttaaatgaaacttagagcctaccatttattttcttaaaattatatacgatgagcacaaatatataaaaaagttaatacttaatgtggagccacagatgataaaatgctgtatgaaagaatctgtaggattctacctggtttttctgctctgaagtctctggaatcgctggagttacaattagggccagcaagagagagatgaagtgttgaaatacctggttcattcacagccttttcttcaatgtgctctcagccactagattactcttttatttatctattattaagacgagtctcacactgttgcccggtctggagtgcagtggcatgatctcagcacactgcaacctctgccacctaggttcaagcaattctcctgcctcagcctcccaagtagctgggattacaggcatgtgccgccatgcctggctgattttttttattttcagtagagatgaggtttcactatattggtcaggctggtctcaaactcctggcttcaagtgatccacccaccttggcctcccaaagtgctgagattgtaggcgtcaaccacagtgcctggccatgattactcttgtaaagaaagggtcaagtctatcttgtctagaaaattttctttcagccctgttgcctacctggccacccactccttgaactcccagggtacttactcatcctgaacctcgctcacctgtctttggtcactcatgcctcagttgacgcatcttcctgcaaagactataaactataatatttgagagagggacgacgccttcccccaccccctgaaaaagaaaaccagagttctctacaatgcagtattgtttaagtattgaatgccccacatataattatcatttaagtacaggattctttccagaaggccctatacaattcagagacagaaagaaaataaacacacgatcaaaataaatacaacaaatgctgtaggatgagaacattttacagtttctgggatgaaaaggaactcagtaaagttccaaagtctatagaatttcccaaagatggcactcgcatgtgtgtggtcaggagatgtgaagtataggggttgccacatgggggatctctaggattcctcccacactctttacccacatacacccacttctcagttagttagaaaatttaaagaagtcattatgattttggaggtggttgggcatttataaaattcttgatattcaaatttaactttcactaaccacataggaaaaaaacctaaaaatcatattctgatttctgcaccgagggtacccaaaggtggaatgaagaaagctctccatggctggaggcaactcccaggagcagaggaagcagagcctccatctgaatggccagcccctgctctccctgactcacccaggccgattttcatcaagcctgacatatggagtgacagattcacaaacacagcctcagaaacactctaggtgactgatgtaatttctgattaagattgcatgcatttgtggaaatgagagagtaggggagagaaagagagagaccaccaacctgagagaaccccacctccaatggagaggccgggcttggggacagacaaagcagttaattgtgagcagttccactaaggggcctgggaaactccagcaccgaggggtggctgtgacccatttggcacaggcgccactgccttgcgtatttccacatcctagacggtcaaacacctgggttacctcatgagtgcagccctgttcttagagatttatgatgctcaccaaacccggcagccggctaatttgctggaaaggtaatgctctggcagcccagtctgcaacccaatgctccccaggagggctttcctctcctgcttatgctcttgctgaattgcctggccattttctgcagaaaggaaagtaatctccactctcttttgggacggctcgatcctctgctatctggcatgggtcattttcaaaatctgccccctcctgtttgaaaggcatgaggcccctgttattaatgaaaggtgaccttggcctgcctttataaagttctcttccattacaccacttgacagatgcaatcatgaaaaatgcttcagtctgaatttctcaggaacatttgttaggcctccaaagagactttcttgtaagacttatgttccctgaatatggacgatgccctcaagatcaaaattctcggggtagaaaatgaggtgtaggatttgcaccttgctccaagtttgcacagaaatgaatggagagactgagaatggagctgaggcagtttgagttcagggtcctcagaattttgatttctaacaagttcccaggtgacggtgatacggatcgtctgggaaaagtatttcagacctgaagagagaatcttggaatgagctgccttgagagcaacaacggccttaagagatgattctgttcagaggtttactgactatattcagtggagcctgaggattctgacgaggtgcctcagggtagatgcagcaggcaagaggagatcacccagttagcacaagaaatgatcagagcagatatttttatcagttgtgtattttggagttttagacatggttttatttgacaggaggtttttgctacttaaaataaaagtgaagctaccaatctagtagggtgcatttttttcaatatgcaaacccagtggcagaggcagagacttaggatcacagaactgcatacctaggccatcccagcatgtaatgccacctcccatcagctataccatgggatacttttactacattctagtgtcccagctccaaagccgcccttctatgctctaccctggagtgctggccatgtgaccctgccagagcacatttctgtttctcagttggctccacagcaggctgtcagtaaggggtgtgagacggaagcccagagtcactaggtggtttaagatcctgggtgttcgaatccggctagatctcccctttccacattgcaggaactccctttccaaacaatgtcccaacttgcccacgagagaactgatgaaactgtgacttcaacttaatttgtaattctgcaacacacacacttaagagctgtgcttgctgttcaataatatcagcccagaggttacaacagatgagattcctttaaggctaccaggtaagtcctcatctgtggtttgtgataagaatttggacttgagcttgcactttttttttttttcgtgtaagtgttctgggacattcaggagaatccatcccacaccacagtcctcatagtcatcattactttcgtaatggtcaaggacagcagccatctgggctcttaaggcattttcttcagtaagtaatttattacaatcaagtacaggtgttcatttgattaatggtgataccattgcatggcataattattagcatcctattttgcattggcaacgagcccatcaccgtcaagcccgagaacacagccaaaccaatccctctatcctatctatgagcgtctgactcctgaccttgtgctggctaccaatttctgtgtgtcaggatcagccaagaaatacaccacatcaattactttaacagagagaatgaacatgaataatagttaacaatgtctaaagtattaattatgtaactgaaataaaacatggaggagtcactagtatcacaaagcaacatgggccgggtgcggtggctcacacctgtaatcccagcactttgggaggccgaggcgggcggatcatgaggtcaggagtctgagaccagcctggccaacatgttgaaagcccgtctatactaaaaatacaaaaattagctgagtgcggtggtgggcacctgtaatcccagctacttgggaagctgaggcaggaaaattgtttgaacctgggagtcggaggttgccgtgagtcgagatcacaccatgctggatttcagcatgggcgagagggcgagactctctaaaaaaaaaaaaaaaagcatcatgtaaaagactgggtttggacctgagagataataccataaaaataggcataatgtatacggcacatctgtatatacaatttcccttgacttctaagcccatctaatctcctgagagtctaatattgtggcacttttcacttgcttctgccatgtaaactttgcattgtgctacacatatttttatatatgtctaccttccatcaattgctggtacctcattggtgatcttattcgtctttgccatatgctgtagtacatggaacaaagtaagttaatacatgcagaaaagagcaatgatccatgatactgctaaggccactttaatgcatggagtactcaatgtatgccctattctggaaagcctgtcttggggctgtgtcttttagggtactatagagccttccggaaattttagcaatgctttatagttgaacactgagccacaatgactctaaaaatagatattttcttctgcctttctactgagattttctagtcccgctcatcactcagcagctgaataatagaattatagatgaaaatataataaataatacataaaataaaataaaataggtgagattatcttctgctttccaaatgtgatttctcagacccttctcagaaaccagcacctgatgaaaaaggttgaataataaacctatgtctggcccagtctagttggtctgtgcatggtgaacatccaattctgaggagatattaaattccaagaaggtatacgttcttttgaatttctaagtggattaaatgaagcttatcggtacaacagataggatatctgtagtacattagctcttataaccttgtagaagataagagaggaccttgcctcatgattttcagattagttactcatgtgagttgaaattttaaaatcttagtgtgaatttatttaatcctttgatagttatgaaagtgttggctgggagcagaatttgataataagggaaagagtgagtataggtcaattttttaaagttgcaaacaataacatttcctccagctattatagtttaaacagtgagggatcgattaagggggagagctagctcccacaattactgggatagctgaatggattaattcaaagctggacttctgggaatagctcctaaaaacacactgcagagccgcagtcctcacttgcaagccagatgccacacaccgtgcctgtgtcccctcatgactcagttcccttatgaatgcatctgaacagcaattccctaagtcatctgcaaaacagttgtgagtgaggctgggaaatgtagttgttatttctttttaaaagtttgtttaattttgttttctgctttttgcttttccctttctgcttgctggaagagagttggagtggatattgagcaagccgagacacgatatatatttggaggtggggaaatcagaaggccctcagtgaaatgtctctctggagacacgtggggagtgagggctgccaggagggctcagtttcagcaagatgaatgagaggggggaacgagaaggaagataaaggaatctactttatctaggtacttgtaggaagtacctagaagtattttgtaacaaaaccacatataaataacacctggcagagtacataaaatattaaatatcaccatataaaattattttacagttttcattatatttagtcttttttctttttcatttgattatcacaagaatactgtgtggcaggtaaagagtagtaaattagtttgaattagttttaatatcacctaattcattcactacccaatatatatgttttatacatttgtcgtatgggtagttgttttaaactggagtgtaactttattgaaaatttaagagttttcaatttttttattttaaaaattggcattttctagcctttttcttacttttttgtctatttttggaccaggtgttgaaaatctctccagtggttaatagcttcacatttttcaataaatatgagagaggggtggaggaatggtaaagaaaaaaaattaaatggcaacaattttccaaaagataactgtttaagctgaattggaaagctgagaaagcgtagcttagaacctgtggagattgcaagtatgcatcaggtgaacgggcagaataaaccacccaggcaaattgtcaacaggcatagtgtgtctttgagcatcttctgtttctcattttagtaggctcccactgcttagttccttgtctcatttacctgctctctgtcattggtagaaaagcaagtaaagcaccattaagccaagctgttctaagaaatgtgcatcgcggatggattcatttgaatgcctcattgctgcacagtctaatttatattcattttcactggaaaatgattacaactgtataattaaaaaattggctttgctattggcactcaaaattgacaacaattaatatcttgtcctttaaatgtggagacatcacagttctctcattggcagtgtcaggtaggttttatggattcattagggattaggagttgccacctgtgtcttaaaaccaagtccatcaactttgtatgacatggtccattgatgatatatgggcatacctcattctgttgggctttgcttaattgtgcttctcagagattgcatattttacagatggaagatctgtggtaaccctgcattgagcaagtctatcagcaccattttccaacagcatgtggtcgctttgtgtctctgtgtcatattttagtaatttataccatatttcaaaatttttattaccattatgtccttatggtgatctgtgatcagtgatcttgatgttactgttgtaattgttttggggtatcatgaactacacctgtataagatggcgaacttaaaatagataaatgttgtgtgtgttctgactattccattgataggtcatttccctgtctctcttcctcttattgagcctccttatttgttgagacaaaatattgaaattaggccaactagtaacccaatgatgggacaatggcctctaagtgttcaaataaaaggaagagttgaacatctctcattttaaattaaaatctagaaatgactactcttagtggggaagggcatatcagaagtcaagataggccaaaagcaaagcctttcatgccaaacagccaaattgtgaatgcaaaggaaaggtgcttgaagaagattaaaaatattactccagtaaatacacgaataaaagcaaaataacctcattgttgatatggagaaagtttgagtggtctggatacaagttcaaaccaatcacaacattttttttcaatccaaagcctaattcagagaaaggccttaactctcttcaattctttttttttttttttttttgaaatggagtctccctctgtcacccaggctggtgtgcggtggcatgatctcagctcactgcaacctctgcctcctggggtcaagcagttctcatgcctcagcctctcaagtagttggggttacaggtgtgtaccaccatgcccagctaattcttgtatttttagtagagaggaggttttgccatgttgaccagtttggtttcgaacttctgacctcaagtgatctgctcacgttggcctcccaaggtgctgggattacaggcttgagataccatgcccagcctcttcagttctatgaaggcagagagaagagaggaagctgcagaagaaaagttttaagccagcagagattggttcatgaggtttaaggaaagtaaccatctccataatataaaagtgcaagtgaagcagcaaatgctgatgtagaacctgcagcaagttatccagaagatccagctaagatcattgataaaggcgactacactaaataacacattttcaatgtaaatgaaacagacttctgttagatggcctgcggtggtggctcatgactataatcccagcactttgggaggctgagacaggcggatcatgaggtcaggagattgagaccaacctggccaacatggtgaaaccccgtctctactaaaaatacaaaaaaagaaaaattagctgggcatggtggcgcatgcctgtaatcccagctactcaggaggctgaggcaggagaatcacttaagccagggagtcggaggttgcagtgagccaagatcacaccactgcactccagcctggtgacagaatgagactatctcaaaaaaaaaaaaaacaaaaaaaaaaaaacatggtaacttgaatttgaagacactgctcactgaccattctgaaaatactagggcccttaagaattatgctgaacctactctgcctgtgctctatcaaaggaacaacagagcctggatgatggcacatctgtttacagcgtggtttaccgaatattttaaactcactgttgagacccactactgagaaaaactatccctatcaaaatattattgctcattgacaatgcacctggtcacccaagagctctgatggaaatgtatcaggattttattaatgtttccatgcctgctaatatgacattcattctgaagcctatggatcaaagggtcatttcaactttcaagttatatgtaagaaatacattttgcaggctatagctgccatagatggtgattcctctgatggatctgagcaaagcaaatttaaaaccttctggaaaggattcatcattctagatgccattaaaaacattcctgattcatgggaggaggtcaaaataacattagcaaaagtttggaagaagtggattccaaccttcaagaataaatttaaggggctcatgacttcagtgcaggaagcaattgcagatgtggaaataacaagagaactagaattagaagtggagcctgaaaatattgctgagttgctgcaatctcatgatcaaacttgaacagatgaggagttgcttcttatgggtgagcaaagaatgtggtttcttgagatggaagcttctcttggtggagatgtgagcattgttgaaatgacaacaaagtatttagaatattaataaacctaggtgataaagcagtgggaaggtgtgagaggagtcgcttagattttgaaggaagttctcctgtgggtaaaatgttatcaaacaccatcacatgagacagagaaatcattcatgaaagagtgaattgatgtgacaaacttcattgttgtcttattttaagaaattgccacagccaccccagacttcagcaaccaactgccctgatcactcagcagccatcaacatctaggcaagaccctctgctagcaaaatgatcatgtctcattgaaggctcagatgctcattagcatatattagcaatacaatattttaaaattgagataaatacttttttaagacatactgctattgcacacttaataggctacagtgtagtgtaaacataaattttgtatgcactggggaaccaaaaaaattgtatgacttgctttattgtggtgttcactttaattgcagtggtctggaacccaatgtgcagtatctccaaggtatggccgtacatcagtttcctcggccattccaatcctccaggtcacagagaaattgtatctaaccctcactctttactgtgctctaggatctatttcagtatgtactttgcatcctgtctttcttattttttctttcagtcccaacatcaaatggtcatttgaactggtagaataagtgaacctgttaggtttagaggtaacttaattttcatctgggcccgtcaggggtcaaaatgtcagtgtcagacaatttagggaaaccaagtaagtttagggttatctgattgattcaaatcttcctgtccctgcttaatatttacaatccctagaatagtgtttatgccccagggaacttactgagagccagtgtgctgtggggagatggagacgtgaagactggatcaggagcatctcgtccttggtcatcatctgcctgccataaaggcttaatcctcaccacctctcaggatatagactgtgattattaccagatcaccctaccctgatattaatatctgtcacaaaaattcaccttaccaagctctgaaccccaacacccaatagcagcctggcagaatctaccacgaaaaagaaagaaagtagatggataatcccttgagcagtttcaaaaggttttagtcatccaaattgagaaactagtcaccactgtagtttgtatatatgtatgtacgtacatttgtatttctgtgacatagtgatgttaaatagtaggattcattctgtactgatttttcttttcctattggtaagtccagttttcctataacctttcttcctttggatggctagacaaaaccataatttagttctcaagagagggcagagcacaggaaaagagaataaaattcatgacttttgagtaacaattcatgacttttcagggcataaaatttaaaaagataataaacaatgagttggctcagtgagaagtagttcttcctctctctgggctagacaaagattcacgccgtaagaaaatcaagtcagaaagagtaagattgcaaggaaataggtgtgcctctcagtagggctcctgtacccttccctttgaataaaagaggacagaaaatagaatcctaggtgctttagagatttcatgaacagatgaagctgtttctcccttccaaagaacaaagaaaatcttgtaatatcctttccctctcactcatggcatttagcatggaacaagcgcaggagtagaagcagctgtggagggggttggaaacagagtacaagggtacattctgcctctggctctgcccttcatcagtgactttgggcaaattacttcgtctgcctttctattgggcagggttgttggtattggtttgtgtttgttaaagcacactatcaacttgaatctcagaatcataagccatattacatacggaaaacaacaaaatggattactcacattaaatatatatatgtgtatacatactgtggaggtaatgtatatttattaaatacatatatatatatagtcatagacatatttagtttgagttcttaattatggactgaattttaatgagctgtttgtggtcagaaataaaaatttaaaaaatgaattgttggaatagaaatcagcgtgactaagccagctcttcatccaactagaggcattcttaaatcaagtttaggtggccttttcattaaaaaatttgtgtagtgattttttctattatagcaaacatatattgaattattcccaggtaccaggattggaaactcagtggtaactttactagtacaatatgaataggtacctttctgagttgccctaaaaagaaacttagattgtcaggaaccgaacagctgtcagatgctgtgcttcagtgggcccagcatgatgaagagtcaatgaggagggacaagaataagaataaactttcatggaggctgaaactatccatagggaagataaaatgtcaacatgaaccaaagcccaaactttaaattcgttattcaaagtagctgccacatatgccaccgatacctaattgaatttcagtttctctactgagcattgactgcttctggcatgtatggaaaattggcacttttcaaagggttgctagtagacctcaaacccattattttcatatgaggaatgcgaggcactggcaggtgaagtaaccacccgagattgtgtgccagggaatagtaaagccagcactaaaggtggatatccctgtttctggtgcagtgattttcccaccacatttagtcctggctacctaataataggttgctctcatgacatactaacatgaatgtgatctttccaaaacagtaagtcagattttattttgaagatatatttagctcaagggctgtcatatttagtgatgtaaagataaattctagcaaggaggtaaataaattgtgaatacatttccaaatctgctggaagatgaaaactcagctatttttgttatccttggttcagatttttctgtttctacaaaaaaaaattggtgagttgagctgtattggctttggcattttttcaaagggtttctttcattttgcagaagatctcatttattcctagctctccctgctcccagggggtgggaaactcagccagggcatttgatttatataattagcctttcgtgagtatggatggcctctcactccagcatgaagtgaggtgaatttgaggaaaaacactcctcctttatccttctttctaccctccctcccaactctcattctcatttgtaacccgatttaccagggaaagcaatgattctgcaatccgatgtgatgtcaccctgtcaaagctttcaaccggagagacttagagcccatcaatttcataataatgggtgaataatgacagtccccttggtattgctctcacccaaatccccatttaaagagggcaactggaaggacaaaggctagtgtttcaggaagggcagatttaggatagatcagccatggaaatcagcattggctcacatgtccaggacctaatgagaatctggcagtggcccaaaatgagttgaatccactttgcctctgcattctagtccctttttgggttcttttcatgagaatctgtagaattataaggggaggaggtaaggaagcagcgcagggagcgggcactcacaagagtatttgctacagattcatctccagtttccttcttattatagtgacaatggatagaatctctgattattctatgaggaattcttccacacttatttctatgtcctattttgtaatttttgaagatgctcaagttccctgctccaggtcgtggtaactctgtatacttgaagtccataaggttgccacttgatttgagctcatttcaatttgctaatttgactgtcagcctctttatctttttccaatggtaatacatcattttcttcatgcattttcttatattcttgaaatctgacagtcctagaaaatatagtcagagagtgtcagtagagatgaaataagaggaagaatgcaaatagttatttaggactaatgccacatatcctgatgagataatttaaaaatctatttgaaagtagctggaatatgtcagtgaggaagtaggggaactttattttctgcaagaacaatctttatgcagccctaatggtgtagatgatgtccttttggtaaaaggataatagtctgaaaggtgatagaaacagcttcttgccctgccatatttgatctgaagcatatggtggttgctctgattcatacagaatgaaaatgctttggtgtactaatctcagagccagcattcatatgataaagacaaaacaggttttcagatatgattaataggttaaagaatgtttacatcttgtggaggaggaacatggtgaatgctatagaattattgagctctacttagttttgaggttgatctgaatttagtgccgatttttatattttaatcgctaacattctcaaactgagaggatgtactctgtgtgtgtcagcttctgtgttgttaccaagtcggttgaacgtgaggacattggctagtctgatttgcgtcactttcttatgttgtggtttggttctgagcacctcgaattgctcagccatgcttggtaaaatacagactagctgcatgagtagtctaaataatacggccgctataactttctctctgctatgtaaaataatttcctttagatgagtgttggactttatgggagtccttagttcccaactcttagcaaatgccttttttctgtcagctcccaaacagcgccaccaggatgcttaaagaagacaagctcagaggttctgtggcttttccttttgcttctcctctaggtgcatgcctttgttttaagaagatgtaaaacaggtagtaggcattcatttttgaaactattaaccccttatatataattcagtttggagagatgtgctatgctgcttttcatcttctgagtttttatttttgagaacttgcagcttgcattccacgtgaacttccttacttctctccatttctttccttggcattccttcttttttgccctccctgttttttagttctcttttcaggcaataaagctttcttcttcatctcctgcttattgatgaatgagtttcattcatctttttctctctctttttttgatggggagggggagcggggtggtctatgaatagctatagactttgcctgctcccatttttccacttagctattcagttccatggagacagaaagtggaagagagcagcagggtgggaggcaccagggtcagaggtcaagagtggccaccttttgaattaaagcttctgatttccactgtggataacatattgtaacccaaagtaactgtgcaagtacttggctgtcaggaggctcaaagcaaagagaaggaggagaaaaaagaagggaaagatcagaggaaaggagaataatgcaaatcttggggtcagttaacaatatttgcagtgttttttaagatagtgtttggtaactccgtatgggagtcattattctttgaaccacgctgcatatcttcccaagggttggacttgaagtacattgtgcagtctaggtacagaagactgcagctttcccaccttatacacaactttacttaaaacaatttaattatgtggcaaactattgtgccacatcaaatttttttgtgtgttgtggggaatgcaacatatgcaatttattgtcacttcttacagactttgcaagaccagcactgaagaggctattagtatccttttgggcattatatatgaacttaagcttagctggtttagtttcttagcggttgtctcatagttaaactgaaagaaattctatagaaatagtcaacgaattaaatttgtttgctttttcaaactcatttgtgctgtttaacaccctaaatataattttgatgagaattggattaacataagaatcaaattatgattttcctactgactttataaggggttacttttccattttatttgtctttatgccaataacacagacatctacagtgtttaataactgtgtgtagaaatggtaaatgatgaacagaaaaaaatttatgaatttttttatatcttaagcatttttatatgctaggatagtacttggtttatatcaaataatcttaatgcaaattgagagtcatactaagataagtctcatgtgattagccttctagttttgtctgtgggaaaggactccattataataataattataatctgactgaatcccaaaatacaatggttcaacctgagtctacaataaaataaaaggatattacatagaagagttctttccaaattgtatagctcatcagaattacctgggaaataaaattttttcttgctgggtctcataactggtgattcagatgtggagcttatttgtaagctacagtcacagggaataaatcttgcaagtaaactcttcaagtctgaaacacatagtggaattcagagccatataaaataaaattccattacgacagcaacaatgaaaaatacagtgagaatgttgtaaaacaaaacattttcatgtctcatgcagctggccaatagaaacagtgccttattgatatgattacaataaatactatacaatgaataaacacgaacatcaagtactttctttttgagaccatacaagcaatagttattgtttgatgaaggaactaaattgcatacagtttacattgagaatagggaaagcagagctgaactgatagacttttgagttattttgagctatttatgcaactgtgtcctaccattaaatggcacatcctatatgttccagttacctccctacagaagaaaatgagacaattcaaatgtaaatgccttaaaattataaaagcagcaggtaagtataagatggagtccactattacattgttcttaacaaaatttcactacaataacagcactaacaatattggacaacttctgacattccttgtcaaaaatattaacctggaaaacatacccagagagtggagagtagacgagggcactgatagttccataaaagtccttgtgatatttggtataagttggtaataaacccagttcttttgcatccatttctgaattcctttcttcattgctttgtctaatctatccttctgattttttctcattgaattttggctgattgctggaactgcttatttttattttaaaagcaaccacattcttccttttaccagtagttaaatattatgttactatactgacaaggttcatgcaacttggaaactagaacttagaggacatggtacgttgcctctgttttgtttcttactagctgtgtcaaattcttgatggcatttagcttctctgaggattaggtttcacgtctggaagatggggataacacaagctgtcctgtgtgcttcacaaaatggttgggatcaaatatgataatatgcacaacatctttttaagccataaattactatataaataaggtgacttattagggtttactttctttcttaactgatttcttttaaatttccagataatttttactttatacagaaataactgttaatgctattgatttcttgaaaagaatgcttttaagatttaatgttgaaaaaacaataacaaaaatagtcagttactagaagtcttaaggaacatatactaacgttttaattactatcctgaatttttgacacacaagagtaaagaggttcgcggttacctctacctagctagatcttagtcttcaaatgccaagatacttttaaaaatttttacattaatcaaaaagcaaacaaaacaggataaaacatgctttttctactgagttcaaagaaccagcaaactgttagcatgtttgattttttgtttgtttgttttaatctgagttcctagagtcctgctcattctgtgtctataaaggagctcattggtactttccatgggaatccaacatttaagcttctgttctgcatggttttctgcactgggtaggcttgctatacatttttttttttacttaatatacacaatttctcgcttgtcttggcatcctagggcaaagctatggacgctttgagttgttactacactatctgaattgaccaatatagctcattaatcctctctcttaaaacatctagtccaatctttacatgagctggttcacctgtcatagttgtccatgatgacaactctcacagctgtctccttcctgatggatttgtgaacatttacggtacaggtgctatgaggagcctacgctgtctaccatttcctgtggtctttacactgcccttgggttgcacctggtcacttagggccctctctttcctgcattttcctcatatcagtctttccctatagtcctgctttagtttcttatgcaactctattccccacattgcctattttatttttcattctgacacatattgcaaattgtttaggagactctagtcatgtaaggatgttgttagcagaagctacattttactaaatactgtactatactctttatacattttatctctagaacctaggcctgacttctttgtaattacccaaactatcctttaagaggctgtttggagagcattaagaatggggaatgaatgggaattcagcttaaggtagaggtggaaggatgaaaacataaaagagctgatccccaataaggtggcaagagtaggtcaaatgaactttgtaccatattcagaatgagattttgaaaatggaaacttcagctgggcaaggtaatactcagaaattggagttaatgattttttcgggctgaagcagggtggagtcaggggaaaatcaaagctctgtgaagagaatttgagacacacgaagatatgcctttgtgttgttactgggggagtgtgttctgcaaacccctatattgtttgggagatccgctgtgctgagtagtctgccagttccaagcacctctttgtctctgctatcaaattagctaatatctgctcatgtcttccaggtttggcaggctttactgtgtctgaaaaactccctaactcacccctgcctcccaaggaagagttaggttcttgctcctgtctctttccacaatgccccaatatcctctctgttactgtcagcttgtttgtcagtttcttccaccaggctgtgatctttgagggcaggtactgcactgtgttttgctctgtctctggtccctagcacctgggctgacacctacaaagcacttgataaatatccataagaatgaatgcatgaagaactaagagaaaattaagttcatttgaaatagctgatgaatttttatgcttctcaaattacgctgctagaatcaaccacctgtaccttaggccctaaggccactctgatggtcacaaaattctgagtcaaatggggtaaaagatataaaaatgtttaaattgtgaattttaatgtaatatcaatgttctatccatctacctgttcatgtatttatcatctatctacccaccgagaaagaaagattagtgttgtaaagagagaagtgacattgctcccatggcgggcagccacttcatcttgggcttttcttcctcatgtgcttagcccaaagacttgggatgaaaggccataggctttccgtgaaagaattttaaacctagacccaatgaaggggacttttgagtatttggcatgtatgaggatttgggtcttccctggccttttgaatgagtaatgcctcttacctgggggctaccatgattctagggtcaggacagggtctctggcaaaagagtcagatcttaattctttagggctgattctcaagcacagaaacaaaaaccgggagtgtacaatcagaagagacaaagatgtttgtctctttcacaagggcaggcataggggtgaggagtcaggaaacggtctctcttgaaagttaaagcttacacatttgatggaagtgtgtctttcataccagagcatggtttttagcactttctgcctcctctttggaaataactgcccctcatatttggtggtgtcatgaggaaagcttctttttattctgcactgtgccattaaatggtctcagaggggcgtaccatggggaccttatggggagtagtgcagcactgcctactttaagccctagctctgttccttatgaacctggcctaatgactggatctttctaaaactcagtttccccatttgtaaaatggggactaacggtcatcccctaatggacttatagtaaaattaactgagatacaagcatataaaacatttagtattatgcctagagcccaaaggaataaccaccaccattgacaacaacaaaatccagttaatgttagctgtgatagttgagagttttgttgtagttagacaacattcattttaggcactggatgactaaaggacgtgacctcgggaactaccaaaggctggaggtagggctaggcatattagtgttgaacagtattctggctgtgaatgcaatgtgcccatggaaacgtagcatgggtccatagaggaagtgtgtaggaatgctcagtgcaatttttcattaaaccccaggggtaacgaatattttctttgctatcggtacttaataaaacactctttagagtgttcaattgctcccaattactccaaagctcaccaagtcttacctggaactgattctcacaatgagtctagccccggcttggtgctattaaccaggcctaaagacatgtaatttctctgaatccctggctatattatagatcttgctccatttctttgctcgcaagttgaattttggataagaaaccaaaacagttactgtttttgaaattcctggcaggaaaccctaacccctgttgagaggtgatgccaagagcaaagggagttgacagagttggatgcttccttctattttgggcaggaaggcaggaaatagtcctgctttacaataattataggcaacagagctaggaataaagtagagcctctatggaaacagtctgttctcaatacggtgtgctgagccaccaagagtgtgcacagaattttgaccagatctcactgtgtctcagtgactagccacccagtgcccatgcattttttgacatgaattataagaggtttataatgctttagttatttttatgttaaaacctgtggaaggatcataaaatttgaaaaaaaataaatttccacattagagaaactactacactaaatagcttggagtcatttttctgtttaatatttaatcagaaactcagtaaacttttggacagtttcaggtcaatatttggctaagttaaaagaaaaagaaaatctaaagcatatttaccgaactaatgaatacagatttgaggattagttcaatcaaaatttaatcaaaatttggattaacacaaacctcaggactgtcaaaaattcaagattagaaacaataatgtttttatacttaagaatccttacaggctcttaaagttgcgtgtggatctatattttatcaattcttgctccttaatccttgacccaggtactttatgttggaactcagtaggacagcttctggtctctgttcttgcagagtgagctatttctgacacgtgaacaataagagttagatgtggaacaagcttgtgacagggttagtgagtgcagacggtaaacgacacctggaaacattccccattcctgcccactttggaaagcttctagccccttggatatcttcttgatctaacttatcagctcttctggatatcttctatttgcacctccagctctactctcctacctcctttattctgctctatcaggaggctgaccttcatggaaaaatcaatagattcgtttgccgtctgccttctgctttgctttggccaatggaggaactgtcgggaattcaaagtgttggataagaatgcgcctgggctatttatttctctccctcattgcctgttttgttgttgttgttgtgtgtatttagaggttgttcctcaggctgctctctccttctctctgtagattctgacaatgaccccttctagtttccacctcagatccaaaggtggtaaatctttttttgttgctcatctcagtatgttccaacatctctccttggtattccttaactcagctcatgcaattttaaataatgcattcatgaaattatcctcaatgcatccacttgagtatgccatctacctcttgctgggactcatcttccagtgctgctgtgtaaaacttccattctgtttagacaggtttactcacagtgtcttagatatccacagtggcttcgccacctccacgtatgcaatggcctatgcccctttatcccacagactatatccaaaccaaatttaactatgcttatgtgagtgaaatgatggtacagattttttggaaaaaaaatgatcatgtactattttataacatgtcttatttttaaaagtattttagtcaacattattttatctgtccatatcttatgcaagcttctttgggcaaagtctgtttctttccattttatgaatttccctgtggcatcagcctctttgccatgcacattggaaaatgtatttgctgatttaaattagctctgatttggaatactttttgaatcttttgtgcattcaagtaagcataaaatagctccactttccacactctaacaaacttcccagacaactacaagcataacctacatctacataggacttcttaggccatccaatctgcttcgatttggggggtttggtggagagccaggaatgttaggatcagctccgatcctcagaaaaataatggaacctctgtgtttcactagtgtgcaattatgggctaagtggtgtggtgcctggtattgctaagccagaaattgtacagagtcccctctgtttcaacaagcttcaacttatgcagtgtgaaatcagagttctactctccaccccctgccaccacagaaatccccaaacaattggccacaatataaatagggtgagggtttcatttttaatcagtagttttttaatagagcctaggagggaatactcattggaaaggcagataatattaaagtgatctcctggcatctggcaattggtagagatgtgagctccaaaaccaaattgtctctactctttctcctgccttctctctagttccccattcccttagctctcttcttcctttgtcaacctttctatttatacattagtgttttaatatgtctacttgaatttttcttggttttggaatttctccaggaatatggtattttaatcttttacctctcacaatttttcttgattgcttacagaaatatttattatcatgattattataaatgatgataatggcaatatggtttacaacttatcagataatttcacatatgtttatctcacttgctataattctatctgaaatagggaggacagattcttttagtacttatacttaaagagatggagattcagcaagatctgatgatttgctttggatttttcattaagtaagtgagaaagaactctgagaccaaaggaatgagattttccaattaaactctactgtctctccgtggcatcatgctacccaggcttttgaatcttgttcactaatcactcaaggtactagtgacccttcaagtgacccttcttttctgcttcttttcaagcagaaaaagaggtgggagcaggggctgaggcagctgacagttccctagctaggttcaagtttctttatctgtttgctccagagctttctggagggcaaagttccatttaacatacttattggcactggtgaagtagaaaaaattagtatatgaagtaccggccaatacaaatataatgtgagccacatacgtaatcttaacttttttaaaaccacgtgaaaaaaaggaaaaataaacagatgaaattaattctaataatatattttatttaatccaatatatacaaaatatttttaccatctaaatcaatataaacttgtgaatgatatactttatattcatttttttcatactgcttttgaaattcagtgtgtattttacacttacaccatgtctccattcggactagccacattttaagtattcaccagtcacatgggactagtgcctatttgatttaaaaatgaggctctagaacagatgagaaatttcatcctggccaggcagcaattggtaacgtactcctagctcacatcccagtcctcgatatttcggcagagctacaatggtatctgctttgagaatatcagatatataatcaaaatattcatatgaaagtccaagcaataaaaaagaacattttgaataatatctactatacttcaagctccacagaggccaggactgagcctgtgctattcattgttctatgtgtaatgactgattgaatgaataagtatatttgagatatttttacattctttttctgttcatagagtctctaaaatctgatgtgtatttcacacttatagtacatttccggtctgactacttacatttcatgggcttaatagccacaagtggctagtgactactgtgttagacaggagagatctagattgttgggatacaagattgactctgtcatcaacataagtcaccagatgggtgacccagggcaagttattttatttcttttttattgtttgccaaactctctgaaagcatgagttctaacttaaaattctgtgagccactttatataaaaaaagaaaagcaaaacagcagtgatatctgacacccatatctaatcccacacccacttaagacagccatctttattactatttcaaataatttggctaatggaaatggcgtacatctttatttgccttccacgtatttctccaaatgtacaaatacacatgccacaaggatacgtagctagaagcactgaggggagttcaagacacaatatatactgggcttttcagtaactgcaacttggcctgttttctggtggctgaggtggatggcagagaaacttgctaacaggccagactctcttggtggggcatgggatggcctggtagggagtaggtgattctaatttggcttcagactagatacttgactgccaagcaaagcagacagagtctaaattttaaaaggaaacttacatgtcaggaccaaggctattgtccatcatgatgcaaattgtgctctgcacaaggctgcccaagccagagagagagtcgggagaacttctctgtatgatgcccagtgtactcctgtgtgggcttgtgttcacctggaggaagaggtgccttctgaaattttgttcaagggcacttcatgggccatcaccagccctactaaggacctaagcagactgtattcaacacccgagctatggctagaatgaagaactccccatccagctaagctgcaaaaaaataacaacaacaataataaaaagaaatcagctcgcaactaaggtctaaaatatggaaggctttatgtatctaaatttttgcctaaatgagtattattcctttctaggaagtaaaataaaaggggacaaagagaaactctgtaaatacatgtgtaagaacagactcaagatatacttgtaatactccatcaacattttttgcttgcatgatatatcaaaacattttttccttcaattttaaataattccatttaaaaagggaggtcatagcacagacagtctttagggcagtggaacatctctgtatgaggctataatggtggatacattctacatttgtccaaatccatagaatgtacgacaccaagaatgaaccctaatgtaaatatggactttgagtgatgacatgtcaacgaaagttcattaattataacatatgtaccactctggtgggagatgctgatcacgggggaggttatgcatgtgcggcggcagggagtatacaggaaatctctatttcccactctgttttgcagtgaacctaaaactgtgctagaaatacagtctatttttaaaaaaagtaaagtcaggacatgagtttgccatctttatgatgctgagtatggtagaatcatccacagcttcacattccaagataaaatatttctgtcttcctcagcaccctgcacaagtaactccactctaattactagcatttcaagtatgctagcccagaaactttatcaatcacatgaggaataacttctaaaggtatttaggggtgtttgctttttaaattcttcctcagtatagttatactgcttgggaggtggaaggatggctaccccttatgcgcgcacactagcttcaatcacctgtgtctcatcccgtcagtcaggaagtaggaggtagtttcactccatctatttatggattctaccttttctctttcatctctcaacttcactgttgagcagttttaggcctaagccaattcaggtgttcagctccatcacaagacccaacttatgttaaccaatttagaagaccaggagtggtttgaggaaaggaaagccttgtggcttattacattttgataagaatgcaaaatggtaagtgtcatgagatggcaactatgtaaaaatgaatgaatatgcatgtgggtaaaggatagaaggtaattagaaattaaaaattctgatagagtgttaggactaaagattcagttattttctttttcaagtttctaaaatactgtgttatttcacattttgattacttttttttccttttggaaaacgacctcaccaacatgccaaaactcacccacccacttgaccctaaatggaatacagtcagccctccttttctgtgcgtcccacatgtgtggattcagccaaacctgaattgaaaatattcaggagagaaaaacagatggttgcatctgtactgaacatgtacagacttttgttcttgtcattattccctaaacaatacagtatagcagccatttacatggcattcacattgtatgaggcatttgtattagtctgttctcatgctgctaataaagacttacctgagactgggtaatttataaaggaaagaggtttaatggactcacagttccacatggctggagaggcctcacaattatggcagaagacgaaggaagagcaaagggacgtcttacatggtggcaggcaagagggtgtattcaggggaactctcctttataaaactatcagatctcatgagacttattcactaccatgagaacagtacaggaaaaacccttccccatgattcacttacctcccaccaggtccctcccgtgacatgggaattactacaattcaaggtgagatttgtgtggggacacagagccaaatcctatcagtattataaataatctagaaatgattaaagtatgcagatgatgtgtgtgggttatatgcaaatactacactggtttatatcagggacttgaacattcatggattttggtttccacagggctcctggaaccaatcccccaccaatgacaaggtatgaccatattttacatcagtggcaatgaacataaagtggcaaaattcatgtgcatttttattggttcagggcaggcaaagactgacggtttctcatactttatcagaatcctagttttattctgcagacacaagggaacacagagactgaatgccattgggttattagaggaggatgccaaaggatctaattccaataaaggtgagtggttgaaaccctagccaagttacatctacttctcaagtatgtcaaaagaacccgcagtcattcaaatttcactgcctctggctagaaatttatgtttcagcaattcagatgggacactcaattcagagtatggcattttcatagtatatgaaggagaaagtaaagtaagacaatttcccttaacttacttcagtaggagctttgaaaaaatggagtcagcgcttacgtcagaggacataagtgttgcctcaggctcacttgggtactctgagtgtctgaccacatctgggatgccgttggggatgtcaactggcacttgatactcaagtcaaaactggtggtcaaggacaatgagagacccgtaggcagcggtcagtaaagctgtagatgcccaacctgtgaggtacaggtgcccagctgccttcatgtgaacaaagagtgatttgatgaagatgtgagccttgctctacatttaattctcaactttcataaagactcttggatgtttaataataataatgttgctttgatacaactagactgaggcacagtttcaatcaaattattttgtgaaatgaaaatggctttagtgccatttttctgataataaacatgtagtataaaatatagcatttataaaatgtagaaaattttgaaaagtaatttttaaatgccccacattccacaggtaacttctttcaaaaaatgggcatattgcatatgtgtgcatgtgtgtgaatgtgtatgtacacttatgtactttttttaaacaaatggctttgtagtatacagacagaataaacaacttctcatgggaataaatatatatcacaatttttgtgcatagctataactcagattttatagatttatttaatgatcccatattggttattgacaatttttcatcattcagcttcaatcattttgaaaccatagttcaaacttttacaaacccagtttgaatattgcttaaaaaatacctttcaaatgttccacgttgtgtgatgaagagaaatggttgatgtgggtgaaaaaacacttatttcaagtaaaaatatatgttgtttttatttttttttaattggaagagaataggaaaggggaacataaccccatgttttgctgaaacattttaagtcagccctgaaaataaaatgtggttttaagggaagtcaaaagcccttgaatgtcatctactggccaccccagctcacctccaaattcttgaagttggttttgagtcagtcacttgtcctatgtatttatttcttgcactataagaagagataataataataatttgtctactcaacttggttataataaggtccaggtgatataatgaatgtggtaatacattggacactctaaagcattacttacatattattaatataaccattatttatttataattccatatgatcagatgaccagaggaatttgatgaacctactactattgatattttcttgcaaatgtgtttgtaggaaattgattatattttttacagataaagcaagctcgttttcaagttaaccagaaatacccattaaagtcttaatcacaggttaacccttgtttcctaaaagtatttagaacaccatttgtttttattgcaatatgatacagtttggctgtgtccccaccaaaatctcatcttgaattcccacatgttgcgggagggacctggtgggaggtaattcaatcatgggggcaggtctttcccatgctgttctcatgatagtgaataagcctgagatctgacagttttaaaagggggagtttccctgtaggagctctctctttttggctgctgccatccatgtaagacgtgacttgctcctccttgccttccaccatgatgatgaggcttccccagccatgtggaactgtaagtccaattaaacctctttgttttgtaaattgcctggtctccagtatgtctttatcagcagcatgaaaatggactaatacaccatataacaaattactataaatgtaatgacttaaaacgattcttatgattaacgcacagttatgtaaatcagaagttcaggtatgatgtgattgagttctctgctcagggtcttgaaactgaaatcaagatggtggttgaactgtgcttctttctggaaattttggggaacagcaaacttacaagctgattcagatcatcagccatatttagtttgttgcagttgcaggaatgaggtacctctttccttgctgtcagctgtgggccacttagctcatagagaccatccttgccacgtgatccctccatctcaaagccagtagaatttccttgggccagctccctctcacacttgaaatttctgactttctccgtctctgaccacaagactcagatttaatggcctcatgtaattaggtcagggccacctagataatatccctattttaaggttgactgatttggaaccttaatgtcatctgtgaaatccctttacagcaacacttggattcgtggttgctcgatcgataagagaagtcgtgtgttcttgggagtatcttttaattctgcctaacacacacctgaaagccaaagttctcttccaatgattcacaggactgctctttccctttgataaaaaagaaaccctccagtgtaaagtcatttgaaagataaagtgctagggtgctgagagatcacatttcaataccaaggctctaatttcatgacaatagctatgttcccttcttttatcaatcttgagaatatgtttagagtcaaatataccaagtttgattcttgcttttaccacttctcctgagttgagtgacatgctgaacctctttgattctcttttcgatctgtaaatggtaataatactacctacttcgcaaggtgattgcgatgattaaataagactatgtgtgcatataaacacatcttaccatagcacctgcatataagtgcaaaataaatagtaatcttaacattatttcagtagggaggtttatattattattcagtgtggaggcttttgttattatctgatttgaagtattctcttggcgttttaaaattaaatccaccatccagcagaaggtatgattttgcccctgttgtacttttactgaaagtcttttcccctaataatatcattattaatgaatacgttatgtataactttagttttcttgaggaataataggtctaaagttttcaaacttcagataaaaggtttcttccccccaaataaatgtttatttccatctctacacttgatcttagccaaaaggctgagaagcaatttttttctttccatctctatgcaaatatttattctttgattttaaggtcccaatgctaaatttaaaaaatacatttagctttagataaaattcagtaaatacatctgatgataaaaatctgtgctgttttcattggaggcccctggaatgtagtcagatatcctttaaagcataaataataattacaaatcacatttaacatattagaaaactgggtgggcaaggtgtgtttcacgtctcctgagaactgagggacaaaattgagatgaaaacgaggcagagctcctgagttcctctcattattttagcaaatgtttggccaggaaaatgaggcagtataaccaattcataactttgttgtatcataaaatttctgaacgccaatatgtccaaataattaactcatctgagcaaattatttggggcaacagcttgtttattaaacaattcatttattaagactcactttgagaccttcatctcactaaactattataatatgaactttgctgaatcctaatcaattctctgctttgaaagattcaacttataccacttgagacctgaccccaaaaccctggaaatatcctcttttacgtattccttctgagacactaagatgtagtcaaggttatcctctttgctgctgcggtaggtttaataaaattagctttgcttagtcaatagatttttctggttggttttctaggggaactcaagtgttgaaagtgattatcatatatatcttttataatctggaaaaaacattactaaagaaaataagtcatctaatagcgccccccctggcttcagaatgaactgtactatagacattttggagcacatacaatgtaagccctttttttctttattctttcttgacacaatatcagatcttttattgtcatcaagtgatcagtgagagagttcaaactgaggtgagatcatcatgtatttgtaagacttttaattatatggaacattttgtcatattgaatataggcactgtcacacgttcatgaaaaccttcaagttttagtttaggctctttatggatgagggtcatatagtatattttatatgtccacagaatcttgtatataacagaattaaacaaattctggttgttggattaggagtttaaggaccaatttaaggtcactccctttttacaattctctgaaaaaaaaaatgcatattttgtcttacttatttcacatcctgggtgaccctaagcagaaaggaactccatgtcataccaacaatagccgacaagctttaaatacacatagtgatcaggtttgggccacttaaattactttttacaagtcctctggaaatagaagttatttgaaagaagcactataagtagaggtgacagcaaattgttcataaattgtgcatgtgaaatgccaaaggaggcagcagaaacatttttactaaccaaacagcacatatcacatcatctgggggaacaagcctcgtttattcaatgtgctgctttgtaaacatagcacagagatttcagtctatgaaatgggatagctgatgattacgttcatgaaacacgaatgagggtttttacataataaatagaataattaggactcaaatcaagttaagttcttatctggctttggtattaactatctgtgtggttgggagtaagttatgcaatctattaaatcttcaattttatagtctattaactgcaaattaacaatgcctgccatgtttatctcacagtgattttgtagaattgagcacgatagaatcatagcagttgggggctgaaaattagttaaggcttatttagtccaactaagtatggaaacatgctttgaagaagaaagtttagtaccatatatatggtaacttctgctttttaactcattctgaaactattcttccaaatatttatgtattctcccaattgaggtgcttatctctatatgtgcttcactcagcctggtacctgggatttattatgcattcacactataaatttgttcagtctaaatgaataattaagtaaaaaagaaattatttatcttcgatggacagactggctcacttttctcctgttttacttttatatgtgttaatttggtttacatattcgtaagttggatatgatgttcttattctacccctctggatattatgataattgaggtgaaaataggaattgatcataagaaagatcccttgctggaagctggtaacatgagttgctattgagattttcagtgtaatgaaacagtaggccagagggagcaagtaaccataagtagtggggtttgtttagagagctaagggttcatgcctttaggtactaatttttccaactatcaaaccttgtaggtatagtcttataaaaggtactgcaatactttcccatattgctgattacataatgccttataaatatacctcaatgactttatctatcttaattaatatcagtattgtgaagtctgtgggtgcttctattagggtaaactgagttattgggggttatttgactccaccctaaatgactctaaactaggtgcatatgagttttaaaaaataatttccccatgttttcttttattttgattggataccaatatacttggctgtagcatttattttccttccttctatttcctacgtatgtgaaaaccagataaccaagactgtagaatatacataaaattcaaaagatagtgattgatattctaagagtatcagccacatgctattgtttcattgggtttggctggtcagtcttttaaaatttactcacttattcaccatttgccatgtgcctaggcactttactggagacgggtagaaagatgatataggacacatatttctagatacatgaagttgctggatttacactccaattaaacaaagatgttattatatggtctaaaggaaatactgtgatgtaggttagcaactactttattttttttatttttgaggtggagtctcactctgttgcctaggctggagtgcaatggtgctgtctcggttcactgcaacctccacctcccaggttcaagtgattctcctgcctcagcctcttgagtagctgggactgactacaggcacacgccaccatgtctggctaatttttgtatttttagtagagacggggttttaccgtgttggccaggctggtctcgaactcctgatctcaggtgatccgcccaccttggcctctcaaagtgctgggattacaggcgtggtctaccgcccctggcctaggttagcaactactttaaattcagttaaaatttgcaactgcaaggtaatagtctctaatctatttgagtgttagttccggcttcatagtcacatcaggtacattatattataatcagggttaattctgtatcctattatctatgcatgagttgctaggaattcaacctcatttctcactgagaaaaattaaatgaaatttagtgtatagaatccagctcaatataaggaagaactttctaccaatttgagcttctccaaaatggaatgtactgatttgctcattagctttgcttttttatgtatacttaccatttatatatatatattaaacttgtagtcaggtaataccttcagtgtatcctatgaaccaatgtgaaacaaattaccttctaatatttatttaagttgttgacttaaatgtattcaaatgcaggatttgaaagttattctcagatgttaatttatttcaagtcagtatttacttcattgagaatatagttaatattgattcgctcaccaatgtaattccacatttattccaattttgtgttcctgcttgaactagaatccttttgatgtttttattctaattattaagtctttacggaacaggtgaaggagggaatcttctgtcaacttcttgtagccacctctccaagttgacttctccagaatgtagtcatctaacagtgtatgtacctcataatattattgtctaaggaaaacaccattatcttagtggtatattttcagggtatttgtcaaataatttcctgaaaccaagatactctatggcaataaaatcactattattaaccactttctcagagaactaaatgaggtttatttggcatgaccaagccattttgatcttttagttactctttgataaatttccatggtagttttagcctttaggctaattatttctgagagagagagaggtcagtgagtgggagcatttgatgcttccaaggaaagaaagttagaaaaaaagaaagaaaaataaaagacctcttcctttttgacatggtaactgtgcagaacttcagaagaccgggaagggtcttcctgaagggtcaggaagcaatcaattcgtacataccattataaaatatgatgctcggcccggcgcggtggctcacgcttgtaatcccagcactttgggaggccgaggcgggcggatcacgaggtcgggagatcgagaccacggtgaaaccctgtctctactaaaaaatacaaaaaattagccgggagtggtggcgggcttctgtagtcccagctactcggagaggctgaggcaggagaatggcgtcaacccgggaggcggagcttgcagtgagccgagatctcgccactgcactccagcctgggcgacagagactctatctcaaaaaaaaaaaaaaaaaaaaaaaaaaaaaaaaaaaatctgatgctcattttcacattcattttatcaacactgcatgcattaaatcattaggtagaaggagattgagtaggactatgtgtatgagggaggaggatggtgaaaatgaggtccaaatgaccttgttagaaggaaagaaaagtgggcttttagaggatacagtgagtgatcagaatcaccgtccctgattttagcatttctaatttctaataagtcacatttctttccttcttttggcatattttttagtagcaaatatttcaccattgcgaaaagtatggtgaagaatgcaaataatgtagcagagtggatgggggtgggtatccttatcaaactataaggccacttgaagttttaaactaacctcatgtaatgttctagttttggaagatgtcactaggtctctaatgaagtaagtttgccaggcttctaacaagatttttctctttcccaaagcaacactctgaataatcaatgaagcctttccttgatttcttttctcgttttttcctttttttcagttcttctttatttttttagtcaatgagctcagccctaaatgaaagctggagttgtatgaactgaatcggctggaaatagtagctgaaaggcgtgcaaatcaaagctggcaagttcagctcttccgttcttgaaggagtagctaacttcaatccaaatggcttcctgggcaattgttcgattattctagggttttgttcctcgtatggaaccaggcattaataacctatttttttgccagctaaaccaagaaaatacacatctcatctttaccttgctgtgccttagtacccatgtggacacttcctagcagtgtgggaaccttgtgggatgggattttacatcatttgtggagtggaggtgggagtggagggggtagccttcaggctctttgatatttcctgctccactctagcctagcacacgacctaaattacagacagcggagaaactaggagctctggaaatcaagtagcctcatcctcattcactttggtacctatgctaagggccaggacttctaatattttttgtgggagatacatatgtctccatacacacacatacaaacctagattttctggggtagaaattatttgcgattttgcttttggaaattatttgcctccaactaatttatttttagatcatcactaagtatattgaaaaatccttgcaaagagagaaaatctaatctaaagatgacttttaaatacagcaaactttctgattgttaaatgtcatactttattaatgtaatgctttgttgtgtacccatttttaatcacattattaattcaactgttggtattttcttgttttagttacatcattttttttctttatatctcaaatatttttaatggcctccaaaaagcctaaggtgctggctgctctgactatcatggctgttggacatgatgagggagcaagttcctgactctctgttctgcttctctgctactgcttgtacacctacctcctcattttctagttcagaataataaagtatcagtcatctatttaaaaataataaagtcatctatttgtataagattatgctacaatattaaaaactctctggatatattgtatacacacattagctaagaaacaggaccttactgtcatggtatgcagttcattctgttgaggtcttacatagctcatacttttgtaagaatacatagcttctctaaaaacaaaagtgatagctctcttctaccacacagttaatgttatgacaggcagaaaattaaatacagactttctgaatgttgtaatcactgatattttctattcacatgagcttctagaacatttaaagccaaatgcagagtaagtcattataaatagatttgagtacacacaggttttatattttgaccttactgtttaattttgtgattgagagcacaggtgtagtttggtgttaagcaggcctgagttcaaaccctgtttctaacactttgtaatcttaggcaggttacttaaattctctaactcacattttcctcacctgtaaaactgaaataatattgattactttctaaagttattgtgaaaataaaagatataaagctcttagcacaggcaaagtctttcatacatattggttattaaatgttcctattcttatttcccttggtctttatttttttacttttaaattgttctggagtgcatatatatctttaaaagtgtcttaagcacttatttgaagaagttgggctataaatacattagcaaataattaccaaatgttgaaattttttattgttaaagaaattgtggtttagaagagtttctcaaactttcatgtgcagaaataagagttcagctggggatcttaatctcgtcaaaatggaaattctcattcaaaagtgctggagtaaggcttgagagtctgcatttctaacaagcacctgggtgaggtccacgctactggccctgagagtagccttgcacagcaaggggttctgaggagaggtgtaggtatcattcttagagctttataaaagcacacagtagctggttttgttccttgaactccttgaatcatgaatggaagcagtgagatggtctcttatttcttactcttttatgagtgaaagctttatcactttaaccaaaatctgaaagaatcacataggattctatttctacgttttttttttttgagtgataccagcccccttatagttggcacttggtcccttgacattggacagtcttttcctttatattctatgagctcttgaagactttcattaggtcacgtggcatatttattaggctgttctaacataacttggctgaatcacacaggctatccagtagtcaagaaatagtctccaaaccaatgttatcttaaatgaatgattatttctgagacagctatgtgatattttaacttcacaatttcattaagactcctctcattaaggttattagtggctttttattgctaattgctaatccctatggagcacctctctgaagaatttggccttggtcttcattcttatttttttgaaaatttcctttttttttttttttttgagacaaagtcttgctctgttgcccaggctggagtgcagtggcacaatctcggctcactgcagcctctgcctcccaggtttaaccaattcttgggcctcagcctcccaagtagctgggattacaggcacgtgccaccacactcagcttttttttttttttttttttttttttgtatttttagtagagacggggttttgccatgttggccagactggtcttgagctcctggcctcaagtgatccacctgcctcggcctcccaaattgctgggattacaggcatgagccaccacgcacagccccagtttgcatggtttctgtttgctctctttgcttgtgtcttattactcctctggctgctacccttaagtcccctaattcacttatataactagaattctcgcctcttgcttacttcttcagtccttactctatgtcttcttattctatagtctccttgggcaatactaaatcctcctacttactcaaatatattttgacaatgctttaatttctatctccagactagagctctcttccagagccatacctaccaactatttcaacccagatgtcctactggcatcttaaattaaatgtatccaaacagaactttactacctttccttaactttacttacttacataagccataattattaatattaaaagtagagagagtaaaagaatgtaagtaattagattttctaagaattaaatcacatttaacatatgtcagatgcttagactattttccttagtatagctcatagcatgcattacttagggagccgtttatgaacccatattctgtatgttgacaatttatctctggattgaggatcagaaatctgggagatatcctagatttctcctttcatcaaatattcaattaatttgataagtccaataagtttatctcctaaaaaatttaacttattttcttctcagcaacttttttcaaagtcacagtttaagtctgtaatgtttgacctgtactatgtcaagtggccctctgtcagcctttctggcttcagcctcatcaacctccactcactctgcttattgcctgctgagtgttctttcagaaattcacatctaataatggcctttctttgttcaaaattcttcatggatccatatttcttaaaatatagcgtcactaaattttttacgtaacccttgtatatgacaagcaagaaacataagcttagtcttttctatctctatagtttatttatttccaatttttctcatggatgctccagcaatatttaactaattgttgacttctgaaatagatcacacttactcaaatctacatcttttcctgaaggtccttcctcttctaacttaatctgctatattagactaaactcaaaattatgctcctctggaagcttttctgaaattctatgaacatacctgggtaattattaaattccaatttaaaagaaaattttaatacagcagttttctaattttggtgcatcttaatttcatcaggaaataatattgagtgtgatcaaatattttcctctaactgattagatgaccatgcgatttttctcctttatttcagtattgtattaaagtggcaaaatacatggacattcaattgttaaatcaaccttgcatcctagagtaaacatcactagctatgatttattagctttagttttctatttgttggacttggtttaataatattttaaaaagattttaatgtttttgtttattaggatattggtatataatttcttgtaatatgttttcaggttttggtatcaggtcaggttcattcatactgacttttttctactcatgtgaatttctcagtttgtttttaaatttcagattatgattctggattggtccgtttctttattttattattattattattattattattattattattattgttctgagatggagtctcactttgtcacccaggctggagtgcaatggtgtgatcttggctcactgcaacctctgcctcccgggttcacgcaattctcctgcttctgcctcctgagtagctgggattacaggtgtgcgccaccatgcccggctaagtttttgtaattttagtagagatggggtgtcaccatgttggctaggttggtttcaagctccgacctcaagtgatccacctgctttggcctcccaaagtgctgggattacaggtgtgagccaccctgcccggccaagttaatccttgtattttgaaagtttgttgtttgcaaatccatttggtattgttatgtttttcagatcaatataagcctctctaattataaaataaccctctttattttgtaaattctattttgaagtctaaattgactaatactgttagagccacacgatctttctcatgactatttctgtgaaataacttctcccatcctttcagtttcaaccttttagaaaatatatatatttaaaatagatctcttctagatagcatacaattgggtcttgcttgtttatctaatttgacaatctggctttttgattagtagtcattttttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccacccgcctcggcctcccaaagtgctgggattacaggcgtgagccaccgcgcccggcccagtagtcattttttaaaaaatgaatttatgcttaacattttagtttagatcatgcaacatgctgttgcatctatctatctatctatctatctatctatctatctatctatctatctatcatctcatctatctatctatctacatatatattttttggctgggcatggtggctcatgcttataatccaagcactttgggaggcttagccagaaggatcacttgaacccaggagtttgagaccagcttcagcagcatagtggtaccttatctatatgaaaaatagaaaaattagccaagtgtggtgacatgtgcctgtagtcccagctacttgagaggctgaggtaggaggattgtttgaacatgggaggttaaggctgcagtgagccatgatcacgccactgcactccatcctgggtggcagagtgagaccttgtctcaaaaaatttttttttcttgcttgggataacattgtttgactatactacaatttattcatcaatgtacctgttgatagacatttgggttattaccatttttggctattacaaataaagcaagctgctataaacatttgtgtatgccttagtgcagacctaagttttcatttttcttgggaaaagtggctgggttgtatgataagtgtattttaatattcttaaggaaagtctaaaatgtgttcaatagtggttgcaatgattttatagtcctaccagtaaagtgtgagagttaaagttccacatttttgccaacacttggtttggtcagtctgtgaattttggttagttgagtgggctacatagtgatatcatattgaagagttttcctaatagcactgggcgtcttttcacatgctcatttgccatctgtgtgtcttctttgataaagtgtccagtttttttgcccatgatttttattaagtgttcttattaccattgacttgtaaatattctttatgtgttgtagataaaattcatttgacagatacatattttgtaaacatatagttgtataatttatatatgtgtactcaccttgaatcctgtaacccattactaaactcacttatcaattctggtagtttttttgagtgattccattggattgtaaatagaatactatttcattaaggctctgatatttctaagtatcaaactgagaaaactgctacagcttttcagacacaatcaaactttactgagtaaatattttttgtgatttttttttttctgttaaaagcaataattgtgaagcaagttctctgtgcactggtatacatcctaggagaggactctaaagacttcaccaataccatgcaccagtattagttaacttgcatgagtctggtgaaacaaaacactcacacaagtgaagcaaagcaactatattactcacagacaggcagcaagggacaatagaagcctggaatcaatggcaagccaggtccccaacttcatgaaaactgcccaaggcaggtgaagtcttgcgtacatgtgccccatatcacactgcagctgaggggccctcaaaacccatttcaccctggttttatatccaggggtaaccggaatttccaagctaaagcattgcaggacgtcctcttctaagagggatgagaacagagcctggactgttctaatagtttctctttatctcaggatgctgcattcccagcacgttctgcagttgcccttgaactacattagagaaaggaggaagagctgggtctctagggtcattcagggacttgccttgcaataatcaattccttttctggcacaaatttaatagtctgtaacagatcaattaacaaatttagatccgtcttcaaaattctcacttcccagatggactttcattaggtgtttgacctttgtatgacaggtttttctttgagttggggcttgatgctgacctgcgacatttctgcctcacaaacataaccaagatcagccaaacaatagttatttgttacttcctcccaaatacataataatgtgggatgccatttgcttagttgtatggcagtgaatttgaaaacctgcatgctgttttgttaattatgtttttaattgagtcacttcatctgaacaaataaagccaccagttattagaaatgccatctgaagtcagtagctaataaagctatactgagttgtttcagaagtgtatcaaaatgtggtagaatcatgacagaaataccttttcatttgaagctgagatctatacatttttaaatgtggtttcttactgagttaggttgaatgattatggatttgtgtttttagtcaacatggggcatttatttgcaacttgccaatactagagagtcttgccttcagaacctaattcagtttgccaatacaatttttttttttaaaaaaagatttactgccaaaagttgagaagtgtccttttaatttcccacaagagattttggcaagaatattatcataaacactttgcttttagttacagcatttttatgtctcgcacaaagatgtggtatataatcttattggctgaatcctcttaatgagcctgtaatcttgtagggtttctaatatcacatgtaattcccatctgtatctccctcataacttgggatattatctttcatatagtaggtggtctacgaaatagttgctgatactaatgataattctggggcttcagctcatctataccatactttcttcttttattactaaactgacctatatacttcacactggtctcttgatttctcacctgaaactttagattattctatttcttccattggaaatgctttccattctaggtttacttatcaaagtctaaaccgtcttaaaaggctgcattatcaccctctgtgcaaagctgcctctgatgttttttgggggagatatacacttcttcacctcccctctcttcctcaaagaaccacaagggctaccattgatggagaactgaatacatgtctcacaggatgccaggcattttatatgttatctcactgtactcttcaaacaaattataagtgtgcatatgaaaactctgtgtttccattgatgaggatactgacagtaaaagaaatcgactactttgcctacatataagaagtgatgaagccagtgtgaaaaaatctgacttcaaaaccttttctctttccaccatattaaaataggcctcttatgccttacgattttctgtcataaattcttcatgattataatcatacttgttaggctatgtgtttgatctttgatgacaagatgaaatcatttcagactttataaagtacagaatagttaactataaaatttctatttttaaatataatttcacaaatattttttgagtacctaatgtgagcaaggcatctttcatactaataatagatttcatatttacatcaccatctgtgaggcatttttcctattctatcttttaaaaaaatactgttctgatgagaacacatggacacagggaggggaacatcacacaccagggcctgtcggggggtgggggcctaggggagggacaacattaggagaaatacctaatgtaggtgacgggttgatgggtgcagcaaagcagcatggcacatgtgtacctatgtaacaaaaccgcatgttctgcacatgtaccccagaacttaaagtatatataaaaaaaaatactgttctgtgtcactattgtatctcctaactagatagaccttggtattgggtagaccagtggcctttaaatgtattttctttttttgacaaatggacttttacaaggaagtcagtgagtagtgaaggaggagctgctctaggcacagctggggtaaggagggggcactattgggtgtggcagggaggtcagggcaccttctcaggcctctcttaatgccttgctgcaacccttggtgcttccttgtggaaacaccagtgctctgttgataaaaataataaaatgaaaataagaaaataagaggctatttgtgtgtgtgtgtgtgtgtgtgcgcttctgaaattttgaggtgttagtgcttattctggactcctaattatagtacttttgtaataaacaaataagcaaaagtgagctgaagtacctaaaacacccacaaaactgataaaaataaagacaaaccaggacaataaccacagaactatgcaaaggatatcttgatgaactcttgaatatggcagctgaccccttggtggtaacttagggttttagtcatgttcatgcaactcacagccttttcccctctccgtggtctttccttgtctcttctccagactacttaatgactctgtctctattcctttccccctcacagctcccaggattaactcatttccactgtcttcttttgaggtccatccactgtttcttgttactgtgtgctctagactctacacatttgtcactgaatattttataaatgccacctccattcatttgcttacatggtccttctacttgagttttcataagtatccagtggtttcataagtatttggtagttcctcctgtgttcattctccttcctgctgccttgtcccttcgacttcagccatgttggtaaatttcctgcagcttccccagccatgctgaactgtgagtgagttaaacctttttcctttataaattacccagtctcaggcaggtctttatagcagtgtgaaaacatgctaatacaacatccaacatgaattcatgctaaggaaaaagtaaagcccagtaagggaacagagatgtgtaagtgggtgttattttagataccatagtcagtcagttactatattggctaccaaggccatttttattctttattttattcatttatttaacaaacatataaatgaaatctgtgggtcaacactgttctaaaccttacaaatgaataacagagagataatgttctctcccttaaaggatgtattgattactgaaggaagatgaatacaagtgtttgtgtctacacacacacagtattatatatacacaaacacaatcacaatcacacatgcatgcacagaaaattacattattatccaaaggctttcgatagaacttcatcagtagacagtattctaaatgtcagttattctaataggacctcaagcgtccatgacttgagttactggtagtttttctcagatgagaatttacttattggctagtgtatgtgaatcaatcaaacagctagtaaggaactatagtggactttcagtatctacctttcaggacagctttgttattctctacttcctttatgtattacaattataatgtgggacattattttatttctagtttcgtttttttagagagaaatagctccttaaaagaaagtcaattgctagcattggtaatcaaagaagagaaattgaagagatttaaagacatgatagttactaaatataatggtctagatggctcatgtcatttccttttcagttttatatgccacattttatggaatcaataatatgccacgtgcacattcagggttgtgaatgaggagggtccgtggaatggatgtggcacaatgtgctccagagatagcgatactgtcatcttggcaaaggctttgttgagggcgaaagccttgagctaaaccttggacagtgataaggatttgccaggaaaggggattgggaaagaatttctaatcacacaggatagcatgagcaaaagatcagttgattaaaatgtttctgggtttaaataattataagtacttctttctggctaaagatagatagatcgggtgcaggagtggaaaagacagactgaaaggtgcctccaagaaggaaagcttttagacagtctagacatcttggtctcagcagattgtggtttagaaggaaataagaaagacaacaggaagatgaattaggaagatagtacaataatctggtaaaaagaagaattggattgctatttttacccaaggaacagtcagtgtttggcatgctggtatagggaaattatatccactgtgtccatttattgactttgtataattaaagatgaaggggcaagagggctgcaattgaagttagaaaagcttattgagaaaagatattatgggtctgctgtgtgccaggaactgtgttgcttaattttcatacgtaatctctaatcccaaaactttgtggggaagatattatacccacgtcgattgctaagaaaaataagtttcagagaaagtaaatgtattgcttcacattccctagccagagttgtgattctcactcagctctgacttggtctaaaactcttatttgctcccctataccacgttgcagcagatagacttgaaaaggattaggaggaaactaaacaattctgtgattctcaaagtcagtctccagctcttttcaattataataaattaaagcgataaaggaataatacaaacagccgagtcttctttgaactcatttggctccccagaataattgaacaaacatacctttactatcacagttatattataaagagaaaacccagtgtatttccttcgaatacttgttttggttgatttatttgtttctttcttacgcctgtgtgcttctgtgtaattagagatgaatttgaagtagaagacagttttcatgaaacctactcatccttgtaaagattaatagggaacagaggtgataagactccatgcttttagtcacaacggattttctactatattaccaagtcagaacacatgggaaaagaacactttgtgatatcatgtttaaatttaaaaagggacattatttttcttgggaaatgtaaacatttcttgatttgtttgtttttaattctgaaattatatgacattggatattaatacagattatgaattggtacgatttcaggtttgatcagattgcctgctagtgagccaataagagtgagaaattgtttgatgttggtcaaagctaggaagattatgtggatgcagagcctgcagtagaatggggagaacaatatcaatcaggagaaatggatggctaactactgaattccagaagaatgttaaaagcttggaggccttcttgtcttagaagagaataacgaggaaggaaaagtgagaatttggagtccatgatgcaaactattttcagtagagataccatacctcacttgctctttcttagccataggatgaagccacccataaccccctacctaaatagtcctccttgggtcactctttatgatatcatttttaattttcttgtcacaaattttccacaatcagaaattaccttgtgtatgaatctctttagtcgtctatttttttccatgttattttccagcttgcccactaaatataagcattgtgtggtcaggaatcttgtctgtgttgttcaactccttatttttattgcctagaataatgtatgccacaaaggctgcaactcttacaaagtttttgaataatttagtaaatggatacactatttgtaatgaaccaaatatcatttaatattaccatgagtcaatatttgtaaagtgcttaaaacagatcattgaatatggtcagtactataaataaatttgttaactaaatgaatactgtactttcttaaactaaaataaaattatttctggtgaataagaaaagacaagcatttgactgtatgacaaaaataatcaggacatttattaatagctaataccttataaaagaacttctagctataagtggttttgttcactttatagggaacttcagggaagttaaatctttggccttaactgaatccctgtcttaaaattaattgacaatcgaaaaagggaaatgcaaaataattgcccttcccttgtacttcatgacattctgtacttcctatgagaggacagtgaattataattggctatttatctgtcactgatgctttatcggagtgcaagcttcatgagaacaagccaaaacatctgtcttatcacttgtcactgtcgtgtcttgagaataccacccagtggctggcatagggtaggtgactccaaaacatttaatgaaataatgtgttaatttggggtggaaagaggtgtcaagatagttttggaaacttcctgaatcttcacataaaaatagatggagcaggctgggcgcggtggctcacgcctgtaatcccagcactttgggagggagaggtgggaggctcacgaggtcaggagattgagaccaccctggccaacatggtgaaatcccatctctactaagagtacaaaaattagccgggcagggtagcgcacatttgtaatcccaactacttgggaggccaagacaggagaatcgcttgaacccaggaggtggaggttgcagtgagcagaggtcatgccactggactccagcctggtgacagagcaagattccgtctcaaaaaaaaaaaaaaaaaaaaaaaaaaatagatgaagcagcttgacagatagcaagaccaaaacccatggtcaagatttaaagcaaaaatcaggataaatttttctctcacaaacctgaaagcaaaagtgaacgggagcaaaccactagtaaccacaagacttgcatgctattggtatttgaacaaaacaagatagagagaagcaacatgagacagatctgacagggggagaacccaaaacagcccacacaagtgcactgtagatcatggtgagccaatgtgagaataaaagctgaccctccaggactcccttctggggcaggaactcactgtaaggataaactgcgtgaacaaaatcaaaattgatcaagagagcaacaatagaaacaaaagagaaagagaaagactagataaaagtaagaagagaacagaacgtgaaaatctcagaaagttagataccatgtttccaccattatatgaaagaacagaagaacagattttgtgaaattagaaaagctatgtgaacataaatatgaacaagagaaatgtattgaggtcaaatctcatacaaagtaacttaaaaggagagaatgaacagaaaaaggggaagaccattatttatatggccaattcaagaatttctgaatatgctcaagaaacagaacaacaaaaatctttgtaacctacagtttcaaaacgagttacaaaacactaagaaaacaatataaaatgtaaaagagcatcacaaattataattagaaaactcagcaatgaggtgacagaactaggaaagaattaaggggaaataagggacaagagagaccctctcatattgttttatattatttcatactcagaaaaggaaagagaagccaaacaaaaggcaggtaacccagcgcctaggaaccagacccgaaaccaaggaaccagatctgaaaccaggcctgggcctgcctgacctaagcctggtagtaaaaattccacccctgacctgacctggcaactgttgttatctacagattccagacattgtatggaaggacactgtgaaacctcccgttctgttctgtttcactctgaccatcggtgctcacagcccctatcacgtaccccctggcttgctcagtcgatcacgaccctctcacgtggacccccttagagttgttagcccttaaaagggacagaagttgagcacctgaggagctcagattttaagacgctaggctgctgatgctcccagctgattaaagccactcccttcactatctcggtgtctcctgtccgcggctcgtcctgctacatttcttggttccctgaccggcaagcgaggtgagtaatggacggtccaggcagcttcttaagcggctttagcctgccctgtggaacatccctgcgggggactccaaccagccggagcgacgcggatcctgagagcgctcccgggtaggcatttgccccggtgggatgcctcgccagagccgtgtgtggcaggcccccgtggaggatcaacgcagtggctgaacaccgggaaggaactggcacttggcacttggagtccggacgtctcaaactcggtaagactagtctttggaacttgcccactcatttgagtggaagcgtggcctgatcacccactttgtgcctttatgggctctttggtttttgtttttgttttgacttggtttgaattgcttgacaggattgatcttgggaacttgcctactccattcaagtggaagcatggcctgatcacccatggtatgcctgtatcggcactttgttttttgtttttgacttgacttagattgcttgatactttggttttggttttgacctggcttggatttcctgatactccgattttggttttgattctggtttggtgtaaactgtaaaagtgtgtgtgtgccctttttacccgttctttgttttgtagtgtgcgtgtggtgtgagcgtggtgttttgtctcgaggagacacgggtcaggtacaaactaagcccaccccactaggaactatgttgaaaaatttcaagaaagaatttaagggagattacggtgttactatgataccaggaaaacttagaactttgtgtgaaatagactggccagcatttgaggtgggttggccatcagaaggaagcctagacaggtcccttgtttcagaggtatggcacaaggtaacctgtaagccaaggcacgcagaccagtttccgtacatagacagttacagctggttttagacccccttccccccaacagtagttaagagaacagcagcataagcggctggcagaggcaaggaaagaccagcagagagaaagagaggaaagagagaaaaagaggcaaagagagaggaaaagacacagaggaagagacagagagacaaagaaggagtcaagaaaagagagagagacagagaaagatagaggcagaaagagaggaagagacaaaggcaaaaggaaagtcagagagagagacagaaagtcaaagagagaaagaacaagagagagaaatatacaagtagttaagaaaaatacaatatacctgattcctttaaaagccaaggcatatttaaaacctataattgataattaaaggtattctcagtaaccctgtaacactgtaataccactttgttgtcagtgtaaacaagggcgtatccggaaagcactgaggccttcctatcagaaacccttaacccagtaacctgcggatggcccagatgtgttcaatctgtagcggcagctgctttgctaacaggaaaaaaaaaaaaaaaaaaaaaaggccatctatacaaattctaagttaatttagactaaacaggctcttattaatagcaaagaataattgaaatcccaaacttacaaggttttcaacaaaagtaaaatttgctaaaagttaacagtgtaacatgtattatagtaacttctaatcttgtggccttcatctagtccacagacataaagaaagttcgctttaaaaaaaaaaaaacagaatggttatcttcaaaaaaaaaggaaaaaaaaggggaggcagaatttatgtaaaaagagtgttatatggtaaattcttgtcctgaaataaattaactggttgtttttttaaaaaaaaatgtttgtaataagtcagaaagttgagcatgtggaagaattgtctgcgaaagtcgtggaagaaaaaagttataaaaaaatttatgcaaaaaatgttgtataatttaaaagtaataaggcctcctgagtactattgaagaaacagtttatgtgcaaggtgtataaggaaagttaaatatacctttggtaaaaggactataaggaggcataagaatgtggatttttacctacattaaaaagttaaaaaaaatcattgttttgaaagtttaagcaagttttaaaacgttaattgtaaagaaaattctgtgtgtaaacatattagctaaacttaaaaaagtatcatccagtttttctgtgaaatggacattaaagtaaaaatgcaacaggtttttcttaaagcaccaatctcctctttaacaaaaattataaaaggttaaaaagagtctataaaatcttacttatgatcaaacattaaaaattagataaatatgtctacaaggttttattaaaattaagtttaacattaataacacactaatataaaagtaaaatttagcttatctagtgtaaaaatcatacaaaaagcattgttaaatgtaaaatggtatttggctttctttggtctaaaaactaataaaaataggtgctaaaggaaacattcattttacaagaagatcataaaagttaaaaacttaaaacaaactttggcaattaagatagcataccaagatgcaaatgcctggttggaatggatcaaatattccatctgcacgttaaacaaaagcaattgttatgcttgtgcacatggcaggccagaggccctgattgtctcccttccactaagatggtcctccagtcggccaggcgtgggctgcatggtagctgttttccaggattctacagcctggattaataagtcatgccaggctctctctgctatatcccaaagtctggtaccctgcgggtcagcccctgagggccatccagcctccgtctcccaacactaagttcacttcgttgtctctcacgacagggaggaaacttagcattccttggagacctgaagggatgcgatgagcttaagaattttcaagagcttatcaatcagtcagccattgttcatccgcaagcagatgtgtggtggtattgtggtggacctttactgggcactctgccgaataactggagtggcacttatactttagtccaattggctatccctttcaccctggcatttcatcaaccagaaggaaaaaaaataagacattgtaaagtgagagaagccccttataggtctttcgactctcctgtccatttagacgcagttggagtcccacgaggaatacagatcaatttaaagcttgaaatcaaatagctacaggatttaattcaatattttagtaggtgacagttaataaaaatataaattagataaactacatctattacaaccaacagcagcaagcttttcatgagttaaaagaaaaactcaggtcggccccagccctggggccacctgacctgacaaaactttttacactctatgtgtcaaaaaaaaaaaaaaaaaaatggcagttggagttttaacccagactgtaaggtcctggccaaggccagtggcctatctctcaaaacactagaaggggtttccaaaggctggcccccatgtctaaggtccctggcagcaatgaccctgttagcacaagaagcagataagctaactcttaggcaaaacctaaagtccccccatgctgtggtaactttaataaataccaaaggacatcattagctaatgaatgctagactgactagataccaaagcttgctctgtgaaaatccctgcataaccgtcgaagtttgcaacaccctaaacccagccaccttactcctggtatcagagagcccagttgaacataactgtgtagagttattggactcagtttattctagtgggtccaacctccaagaccatccttaaacatcagtagactgggagctgtacgtggatgggagcagcttcgccaacccctgcaaagtgattctgaagaagacgacaagcgctgctccagtcacacccggaagctgactggtccactcatggccgaagcatgaggaaactcatcgcgggactcattttccttaaaatttggacttgcacagtaaggacttcaactgaccttcctcagactgaggactgttcccagtatatacatcaagtcactgaggtaggataaaagattgctacagtcctattactttatggttattataagtgtaccgggactctaaaagaaacttgtttgcataatgctattctatccaaggtatgtagcgcagtctctaaatgttatgtttgtggaggaactgtaacaggagatcaatggccataagaagcctgagaattagagcctacagacccagttcctgatgaattcccagccctaaagaatcaccctgatcatttctaggttctaaaagtttcaaatattggacaatattgcaaagctagaaaaaggaaagaattcactcattctgtaggatgacttagttgcttaggacaaaaactgtgtaatagtaccacaaaaacagttacgtggtggagttcaaaacacacagataaaaatccattcagtagatttccaaagttgcagaccatttaagcccacccagaatcccaccgggactggacggcccccactaggctatactgggtatgtggacatagaacctacgctaagctgcctgaccagtggtcaggtagttgtattattggcactattaaaccatctttcttcctactacccataaaaagaggcaaactcctgggcttccctgtctatgcttcctgcaaaaagaaaagcatagctataaaaaaattcaaaaataatgaatagccccctaagcaaatcatacaatattataggcctggtacttaggcacaagacagctcatggggataccagacccccatttacatgctcaactgaatcatatggttgcaggctgttctagaaatcatcactaataaaacctgtcaagccttgactattctggcccggcaagaaactcagataagaaatgctatctatcaaaatagattggctctcgactacttgctagcagctgaaagagaggtctataagaaatttaaccttactagttactgtctacacatagataatcaaaggcaagtagttaaagacatagttaaaaatatgacaaaactggcacatgtgcctgtacaagtgtaacatggattcgaccctgaagccatgtttagaaggtggttcccagcactaagaaaatttaaaactcttataataagagttataatagtaataggaacctgcttactgctcccttgtttgctacctgtacttcttcaaatgataaaaagcttcatcactaccttgattcaccaaaatgcttcagcacaagtgtactatatgaatcactatcaatctattgcacaagaagatgtaagtagcaaaaataagagtgagaactccaactaataaaaagtgagagtctcgaaggggggaaatgagggacgagagagaccctctcatgttgttttatactcagaaaaggaaagagaagagaaacaaaaggcaggtagcccagcacctaggaaccagacctgaaaccaaggaaccagatctgaaaccaggcctgggcctgcctgacctaagcctggtagtaaaaattccacccctgacctagcaactgttgttatctatagattccagacattgtatggaaggaccttgtgaaacctcccgttctattctgtttcactctgtccatcggtgctcacagccccgtcacataccccctggcttgctcaatcaatcacgaccctctcatgtggacccccttagggttgttagcccttaaaagggacagaagttgagcacctgaggagctcggattttaagacgctaggctgctgatgctcccagctgattaaagccactcccttcactatctcggtgtctgaggggttttgtctgtggctcatcctgctacacagtaacctactgtttcaaaatgagttagaaaacactaagaaaacaatataaaatgtaaaagagcatcacaaattataattagaaaactcagcaatgaggtgacaaaactgggaaagaattagaatgataagaaatctattttagaaatgaagactaaactagaagggacacaagattgaataaacacaagtaataccttaagataaattgaagataaaaaagcaattgcttttaaataaaaaatataaaaaggatttgagataaaatgacaaatattgaaaataagcaaagcaaagatctcattactgtctgaaaatatttaaccaaaatgaaaaacacctagttattttttaggaaaattgttgtactttaaagaaaaaaatcccttgggcatctcaggtaaaataatactatatttataagggaaagtaaaatagattctgaatagtcatagaaactcttccacaaggcatgtcatagaaaccagaactctttttccccaaaactagccatagaacctaaagatattattctaacttccctacacctttctgtgtaaaaactggccataaagaaattatctgatgtactttgtttgagtataaatcataagatctccattccagagagggccctgccccacatgcagagaaagcaaaggtacacagagagagaccaagaagactctaaacaggccggccttgcttggtttcctcattcagcctgttgttagcactagattataccttttgcctaatcatacttctacacagctgtccatattttgttgagcctaggcataaaaatagatagtttttctcctgaatctttgggtcttcgttctgaatgctcccatgtcacgtaaaaatgtgatcaaataaatttatatgccatttctcctatttatttaccttttctcagcgatttttaggtaaccttcacagggcaaaggggaaattttcccttggcccctgtaagtatgtaatgactaaaatgtctgattacatagatgtcaagcaactataaaaatgagagccaaaaggagatcatctatgtaaaatcattttaactgcttttaaaattcataattggtgggtttaatatttatattattaccatgagactaatgtttatgtaatgtaagataatcaaatcattaattttatatttagttctatcatttcctttgtcctttcctcactctgctcacagaaaatgggctggaaataaagacaaactcattgaagctgagcatccctagtgcccagattttggtcttaaaatatcatttgttattatcaaaacgaacaaacaaagattcttcaaagatgggacaattagagcttcaataaagataaaaagaatgtgatggcttaaaacctatcaaatatgaataaatgcatgaatttataataacattaaaaaaagaaaaagtgattggctgtattttaatgatagtagagagcaaattcataatcttgaaaactagataaataaaaggaaagaatcaagcatttatcctatatatctttatgaactttaaacagctgaacaaaatattagatgaaggaaaacatttctttatggaattatgttaagtattgtatgaaaatgaaagactagaatgagaatatcaccattttgcaacccccatccatactcattaagtaccaatggctgctaacatcacaaaagagcaaaacccaaatattttgtagctcctggtgaaagaatgcaatgttatttacattcttaccaaagggatagcacctgagtctgattaagcctctgcatccaactgccaatttgcagctgaagagaatattgaattgcaccatgaatttgcaatcatcaaaatctggaatatgggatactaatgattaaatggcctgggctttgtaaaagtaaaaagcaagaaaaagaaagtgatggagggtaatcctgtatagtaaaagcaaattgaaagatgtatcagtttaaaaataaaataaaataaattaaaattagacaagtcaagggaagcacccttgaataaaaccttcaaataatacaaataaataattactatatgagttacttttggagggatgagactgtcattgggatgggaaacatgtaaagccttctcacatgactggaaaaatcttacaataatttgctaagctctttagtgggtttgtgtggtttttctataacttgtgttttgttttacaataaagaggtcagaaaattactatttcacgagagtttatgcaactgaatcacacaatatctagaacaatctggcaatgtgaaacaaataatgcagaagcatcacaaatcatttactctcatatgaggctactctcaaaactgattgtttccagcacttctttggtaaattacacatccccaggtattgacaaagggcagagacaatcttttattatgactattcattcctctgtttaatgccatgttttgctgatgttttccactagcaaaaagtgtaatgagtagtagctattttaaaatcttaggtactttaaataaaaagtgggagacataatagttttatcacatgaagggtataatatgtagttgcaaagtgagatgttttttcttatttcatacaagttaaattacatttacatatttcctaattatcaacattgcaacattggacctcttgacttcagcgaactcaaaagaaatactggggatgaaggtccttgagttcttattaagcttcgaagaagtaaaggcagatttaatttgtgtcctgataaggctgaacacaactttagttggtctcaattaaatcatgtctctctctctctgtccctttttgtttgttttgttttgcttttggataatactagataaaacaaagtataatgcttatttttttaataaaaaaagcacttctttgtagtaagtaataagagtaaaggggtacactaattttattcagcaactaatactgtattaatattctggttatttctatatctgtatcttgtaatcttcatgacaagtctctcaagtaattgttacaatcacccccattttgcagatgtcaaaacagttcaatctgttgtgatttggtaatttgttcaaggacactcaaaaagtaggtggtatagctgaagtttgagccaaaggttttgcctccagatcctgtattaatcccccaaataggtcgctaaagtacagtttccagcatcctttccctgtatttactttagatattaccatcttgaaaattctagatctccttaaaatactaaggaaaaggggagctctcttttcctaattagctatttatccagaaaagagattgagatttaatagataaacacattctcctaaagttggtttctttaatgtcttttaatcattgagtttcagatttcattgagataacttaacaattatttccagacaccagcacccaaatatggtagtcttcaacttaattgttaatatgcaattaagtctattagggcaagtacaagaatgattgcagtaggaaaagggggtgagaaacaagtaaattattcaaaagaatggagtcaatttagtaaggctttattctcgcactattttattttccccagattaaaaaaaatatgccacgatcctgatcacttccttagaatccatatttttgcctctgctctcatttggcactcagtctgttggagaacaggtagggttaaacttcatacaggaagagcttttgccctcacttggtgctaaggacaaataaacaatcaactatgcaaatatcacaagcaagggcaactgttatctacccctatgtatactagttactcaagtatttactacaacagcaaggcaccagcaggctagttgggtattgttttgggcatacttgaatttttggataaatttaatcattgcatttttaaaactctttactctcttcttttaaataacctttattcattttctctacccagaaacatctaagctctcaaaatataggcttaagtagaatgatgaacaaaatagaaggaaggggagaagaggctgagaagaacagtgttcttcaattcaaagctgttgttgaacacgtattgtacacaggtgacccactgtacacatggacttgtgtgcatttatttcatagaagatttaagtgctgaaatccaccatttactcaattcttaatgttcttaattattctaaattaacattagaggcagatagagtgtatttccattctactttctctccaactcccatctagtacttacctttccttctttccagtcagctcatatttcagttataatgacttgtttagtagactattctatactaaaaattttatttgatttggaaattatggcctgtgtgtttttttccttgaaatcagtgaatagaactggattaaggaaatctttttgaaaataacgatgaaaacaagagtttaacaatataaaactagaaatgctgaggttaaaacttgccagtgatagcaccttgccatgaataactctgtgtgtgcatgtgtgtgtatatgtgtgttattgtattatttacagaaggtagagtctttctatttctgccaagttatcatatttctccagtgggctctgaggtgcttctggcctctcttcttgctgtaggtatcataggactatggatgagcatcccatggcttgggcagaaagttctctcaagagttctgcgttctccatgagaatttccaaattctcacagtaatctaattctcaacaacctaaatacttctgatatttgtaagtaactgttgaaaatgcaggtaaattttaacttggaaagaaatatattgtaatttaaaagttctgaatcaaaaaaataatttgcccttttaaacaattgaaatgaaaagtttctgccaaagtgacagaaagaaggctttcagccagcctctggggaaagctcaaagacttccactttggtttactttacacctaataattttaaatgacatttgagtacattatgaaagatatagtagcactgatgtaccagtgcccaactcaaagaactctgaaaagacttgcaaacctatgagtctagactggcttcttttaccattcacacccaattaaaagcgcaggaaaagcctcagaatcagtagaaacttttctgcgtgaccattcatgaggtattaggttggtgcaaaagtaactgcgatttttactttaagggcaaaagccatgatcacttttgcaccaatctgatataataagaatttagcctcaggaggaagaacaaagcaccttatcttatattgtagaaagtgctggagatggtgagtagctaatctaggcttgtgattcagggaaaaaattaaggttcaaaatattaattttaattgataagtgaaatatgcttcatccatatgttggaatccaaagtcatcaatttttaaaaacaacacttatttacattcccaccaacagtgtaaaagcattcttatttctccacagtcttgccagcatctattgtttcttgactttttaataattgccattctgactggcttgagatggtatctcactgtggttttgatttgcatttctctaatgatcagtgatgttgagctttttttcatatttgttggctgcagaaatgtcttttgaaaagtgtctgtcatatcctttgcccagtttttgatggggtttttgttttgttttgttttgttttgttttttataaatttgtttaagttccttgtaaattctggaaattagttcaaccattgtggaaaacggtgtggtgattccttgaggatctagaaccagaaataccatttgatccagccatcccattactgagtatatacccaaaggaatatgaattattttaatataaagacacaggcacacataggtttattgcagcactattacatagcaaagccattgaaccaacccaaaagcttatcaatgatagactggataaagaaaatttggtacatatatacaatggaatactaggcaaccataacaaggaatgagatcatgtcctttgcagggacatgagtgaagctggaggccatcatccacagcaaactaacacaggaacaggaaaccaaacaccgcatgttctcactcataactgggagttgaacattgagaagacatggacacagggaggggaacatcacacaccaggacctgttgaggggtgtggggtaaggggagggaacttagaggaccagtcaataagtgcagcaaaccatcatggcacatgtatacctgtgtaacaaacctgcacattctgcacatgtatcttggaacttaaagtaaaattaaaaataaataaatttaaaaaaacactaataagagacagcatatacaatgccacagaaaaggagaaaaattcacgggcaaggatatcatctcagatatttttcaatgaggaaaataaattagagaaaagaataatctcaaccccttatatacatgaaacgttttattgttcacactaaagagaatgttgaaacacctaaactaatctagtactacctctggaaaaaaaattatcagcctatgatcataggacattacaaccatttttatgtgaagtataacacaccactaacacagcagatggagctcaataactgccaggcaagttgctgcagccatgatatggtgtagccattgggaagtgggtcgtcctggagcttggactgaaactttctcaagggtgttttggccaagtgaccatattgacactaggctgtcacaggtggcttcaagttctaggagagtctttctaatgatatcttgggatttttgattcacatcaaatgtgagcatttcctattatgagtgagtgtaaagacttcaccatatcctaagattagaggatttttagcacatgcgaatttatcattgtgtttgatatgtatcacaggtgtgctagctctacttctgggattcactctttgttagatcaataaataatggaataataagatgatagtgatgattatgacaatgattttaaaaagatcagagatgttggttgttgtgtatgcgtctaaatagaaacagtaaacatatacttgtataggtaattcattcatcatgtctactcaaattggtcttgtgtacagcagtatcattgctgtggttgtttctaatattgtcaggaattttgaagatggctgtagttgtcgatattaccaagtgatgctatcagcaagacagtaggactgtgttcaaatgcatgccttcaaagttcttttgcttccataatttctgagtcatacttagcaaatggttgtgaagtcttaagtgaagaactgttgcgttttgtcagtgaatacgtgattgattgcagaagagcacttatttcaatggctgttggtaagaatagataaaattctacccaagataattgatatgaatcttcctgaaatctaacattccagaaatggaaagtggagccttttcatcaagggttcaatgaatcttcctttctgacttaggttaatgccaccttcttctctttctctgtttattcctagaatgcaggctcaacagtaccagcagcagcgtcgaaaatttgcagctgccttcttggcattcattttcatactggcagctgtggatactgctgaagcagggaagaaagagaaaccaggtaagcagtagggttctgaaggccagatgcttcattgattaatgtccatctagtctaattacctgcttttccttcctctcttctactctgcctctctcccttcctattcctctattccttcaatcttcccttttcaaaaataattacttagaggaacctaagaaatatcctgtcttatttttctcccattgtaagtcttggattgcatgacgatgatgatcattaatataatgatcaaattagcagctactatgtatagaacattgaccggtaatcaggtgctttattatttacctctctacctcaaaaaaaaaaaaatgcactgcaacttgtttttctccttaatttcagatttacagaggaggaaacaagcacagagaagataaagcaccttctctatgccactcccaaagtcataagtaggctgtggaactgacagtctgtttaaatctgtgatgcaccatatttgtatgatgtcattccttctacaaggcagagaaaggaacaacaacttacactgaaatggctcatttgacaactgttatttctttttttttttttttgagttggagtctcgctctgtcaccaggttggagtgcagtggtgcgatctcaactcactgtatcctctgtctcccggttcaagtgattctcctgcctcagcttcccgagtagctggggctgcaggcatgcaccaccacgcccagctaatttttgtatttttagtagagttggggtttcaccatgttagccaggatggtctcgatcttttgaccttgtgatctgcctgcttcgacctcccaaagtgctgggattacaggcatgagccactttgcccagctgacaactgttatttctaatagaatattttcttcatttttaggagaactatatttttgaccatctcttcttttatagaaatgtttgcttctaaaaggagatgccactaaatcacttagcacagtctctggcacatagtaagagggagttcaattaatattagttttagctcttttctcagttttctttctctcttctcttgatcattcattggttcaataatttggttaatattcatcatgtttctactattcattagacaataaggatacagattaaaaaacacagatcctgcaattaaggtgctcaggaatgaacttggttatatctggaagttaaggagttttctgtatgttgattaggttttcctcctttcattcagaaaaaaaagtgaagaagtctgactgtggagaatggcagtggagtgtgtgtgtgcccaccagtggagactgtgggctgggcacacgggagggcactcggactggagctgagtgcaagcaaaccatgaagacccagagatgtaagatcccctgcaactggaagaagcaatttggcggtaagcctcatgctactgagttaatctcctactctgagataattctcaaatttttccaccaaatgtctttttaaggataagtactttttattttaaataactttatcttaccagacacaaagtgaccagactggtcccatttcaggccaggcaattatttgttgtggaggctgtcttgtgcattttagggtatttaggagcatcgctggcttctactcgctagtttccggtagcattcctcacccgctccagatgtgaaaactaaaaatgtctccaaatatctatggccaaatgtaccctgttggtcaaaatcatccctggttgggaaccactgcctttccaaagggacataaaatatatccttgattcctctgaataatgttaattgatctgtcttctctctcctttcttctatttctaagttcctttgatttttcctttccccttttcttatttattctcctgcttctccatgtttctccctgtcactttcagaccttctctcccatttgatccctccccaacctccacacagtttcacagattcacttactgagttcagcagggctgctcacagccacgtttcataaatctttctcccactgactggagtcagtcttatgctggcctgatctatctatctgagacaggatctctcaacactttcaactttatatccagtattgaaccctcaaataacctcttccacaatccagactttttgtctttcttagccatagtgggacatgatgcctgaaatgtcctatctgtgttctatggaaatgcattgtggcccatagacaagtgaggaaggataatggatgtatacatgtatgtctttttctccctctgtaatctttggggtattttttatttgaatggatatagacaagttctataaaagtgtgatggagaacaggtacatttggtcttaaattgtatatgggcaccttaaaaacccacttacaaaaagtttaaaaggtatatcttaaagacttacattgagaatattaaataactctcaaactcaacagtaaacaacaaaacaacaacaacaaaaaacaaaacaaacaaaacctaacagttcaataagaaagtggggaaaaaacattaacagacattttaccaaagaggatatataggcaacaaatgaactcctgaaaatatattcagcatcttttccttattagggaactagaaattgaaaccataatgagatatcactctacatctatcaaagtggctagaataaaaaatagtgacaagacgaaatgctagtgagggtgccaagaaaccagatccctcatatgttgccagtggaaattgtaaggtggtacagccacagtggaaaaagagtattgcagttttttacgaaatgaaacatgcatttaccatgtaacacagcagtttcttggtaatttatctcagagaaatgaaaactgatgtttccacaaaaacctatacatgaatttatatagcagttctatttgtagtaacccaaggctggtaacaactcggatgtccttcagctgatgaatggttaaacaaactggggtacattgggaccatggaatactactcagcaataggaagaaacagactattgatgcacatgacttggatggatcttcaggaaattatgctaaataaaaaagccaatctcagaagtttacatattgtagaattccatttatgcaacatttttaagctagaaaaatgatagagctagagaacagataaggagttgccggggattaaggaggtggggaaggaggaaggtggctaggccatgactataaagaatgacccactgttgtattgggactgtatattaatagtgtatattagtgtgtattaatggtgtatattgatggtgatcgtatgcatctacacatgtgatagaattgaacagaaatcaatacacacgcatacactctgtattatttcttatagctgcatatggatctataattatttcaataaaaaagttacaaacaaaagtgtgcctttattatcctggaagtacgataggatctttcaaggatttctgtttggttctaccctgcctttagcggagtgcaaataccagttccaggcctggggagaatgtgacctgaacacagccctgaagaccagaactggaagtctgaagcgagccctgcacaatgccgaatgccagaagactgtcaccatctccaagccctgtggcaaactgaccaagcccaaacctcaaggtaagtccttgccattataccacaattttaatggattgatggactcaggtaagatctggaaaacccacattttccagaaggaaatattaggtgaattaccttaagaaagtgactgaaaaactcccctacactgagagtcacaaaaatactttaaaaatactttgaagcaggcagcctgtgagtgcaaattgaagtcctctgcatagatgaggggattggtacagtctcctaacccaaataaataacatagcaaaagaaaccagcaaagacagttgtatgatgaccatatattccacactcttaattggaactgtatcctgacaagaaaaacaaactcagaatgtttatgacggagacaattttaaatcaaacttctcccagattatctgaaatatagttttcacaaaatcaggaaaattattttacattttccctttattcactgcataacttaatgggttctgcatttgttttcagagcctttatattttttgagttcaatttggttaccaactacattcatcacagaatttttaaatgacagagatctgtatctcccagaaagtcaggctctgctctcttgctggagaaggtaaaaacaatcattatggccatgaattcatacatacaaggatcccaactgagggaaataaactctttcatcatggatgttattgtctgaattgtgttttcccaaattcatatgctgaagttttaaccccctcacaatgtcactgtattggagacagggtctttaaagaggtaattgagataaaatgcagtcacaagggtaggccctaatccagtgcagctggtgtgtttataagaagggagattaggacacagaaatacatagagagaagactgtgtgaagacagagggagaagaatgccatctacaagccatagggagaaccttcagaagaaatcagccctacagatgccttgatcttaggcttgtagcttccagaactgcaagacaataaataaataaatttctgttgtttaagccaccaactctgtggtactttgttataggagctatagccaactaatacaatgggactcaatgaactctaaattcaaataccttcttggcctctactcatatattttaactctaaggtggtcctgaaaattcatactgccagagaaattgtaaggagagattcagaaaaatgaccatgtaagaaatgctcataataaataaaagtagaaaaaaaaaatctgcagaaggtgatggagattggctggtttcctgctggtggccagaaaggactttatttttcacaggcctggctttttggccactgctggagttgtccatagaaatagttatctccaacttcaggatggccaggtacaggctggacctgcaggtggtgagtctagggttcaggctgccctttccagatcatggaaatctctgcctgttgtcatatggtttttggaaggcatgaagcagggctggagtgactgcagtgagtacttatgcagacttcccaaatgtcatttgtccagagacaaccacataaatctaagcaaaatcagtgccctatctaccaagtgaaacatttccaaaaatggcaaaactcagagttactgtagtcaaaataatttatttttagtccagctgtagaaccaaaatattcagcataaatacagaattgaaaggaaaagaaattaaagaagcttccacattctagcacagtgatgctcaacctgggcttcacattagaatattctgtgggaacttgcaaaactcccagtgcccaagtatagcacagactaacccaatcagcatcagtagtttaaaaattgtgaatgcatctcagaaggtttcatgatgcagccaaaattgagaactactgctctagtatggaatccattgacaagagaccacacacacatgcatacacatgtaacacacacacacacacacacacacacacacacacgtgcactgtcctgttctttcctatgggaaagagaaaattcaactttataataagggagaaaaagtggggacatgattaggtggaagatggtggggctgggtgaacacataaaatgttgaaaagtttggaataaatgggacacagcagggaacatgattaagatagaaccctaaacgatatttaggaaataagtgaagtcttccttttacctgaactggtgtatatttcacctttatacagtatctcatctaataacatgtaatgaaggttaagtttgtttcaggctttcagcttgaaaaaatgacactaaaaatatttcaagtggatagacattctgtaatattcatacgtaaataaattatggtatataattaattgatataattaattgaaaatatgattactatgagtgattctatgtttcaaactaccagttatgcaatttacaggtcattaaaattcatccttccctttgtgtataatatacctttgttataactaaccaatcttttccatctcagcagtggagagtcttataaatgctgtttggcactgagacactctgcaaaaagaatgatttcttttttctttttgatacagagtctcactctgtcacccgtgctggagggcagtgaggcgatctcggcccactgcaaactccgcctcctgggttcaagtgattctcctgcctcagcctcctgagtagctgggattatgggcatgcgcccagctaatttttctgtctttttagtagagacagcatttcatcatgttggtcaggctggtcttgaactccagacctcaaatgatacacccgccttggcctcccaaagtgctgggattaaaggcatgagccactgtgcctggaaaaaagaatattcttattttaggagttgaaccagggagatgtgtcagatataaaatctttgtaggggacacagacacactcacacacacacacacattccatggcatatttttcctagtttaaaccaaaatgtaacgagtggcatatgtaagttgtatttatttttgtactatttttctcaaataaacttggatagatattatagcttttcctttgcacgtctctaattttaagatagcttacattctactaatcaatgggaaagcaaatagtaatgaatggaatctatactatcattatcattattcagtttctactctatacattgctctaggtgttttccatatggtaacttataaagtcccatatatccttgcgggtgggtattattataaaggaaactgaggaacactggttaatttacttgaccaggagtatatctctaataaatgacagtgccaagatttgtctaactctaaattcatgtcatcttttgtattctgctgatttctcacctaaatcacaaaggggtatgaactaacctccatgggttttaatttcctttgaaataggagaaggtgaatgttgtcttttttctttttaatttttgtggatatgtggtaggtgtatatatttatgtggtacatgagatgttttgatacaggcctgcaatatgaaataagcatattatggagaatgcagtgtccatcccctcaagcatttatccttggagtaacaaacaacctaatcacactctttgcgttattttaaaatatacacttattattgactatatagtcaccctgttgtgctatcaaatagtaggtcttattcattctttctatttttttgtacccattaaccatcccaaccacccatcactacccttcccaacctctgttaaccatccttctactctctatgtccttgagtttgtttcgattttagatcccacaaataagtgagtacacgcaatgtttctctttctgtgcctgtcttattttacttaacctaatgatctccatttctatccatgttgttgcaaatgactgaatctcattcattttaatggctgaattgtactccgttatgtatatgtaccacattttctttatctgttcatccgttgatggccacttacgttgcttccaaatcttagctatcatagacagtgctgcaacaaacataggggtacagatatcttttcaatatactgattccctttattttgggtggaagctgcagtagtcatttaactaaacttttctcaaaatgatgcatttataaattattttcttccttcaggaaagagtacatcatcaacattttttcttatgttaattcaatatgtgaaggagatagaagtagggaactcactaattttgaattggacactggggtaggagctcctagtcatttaatttaagccttaaagcaactttaagcatacattttatttatcctactttatatatgaaaaagcataggctcagaaatgttaggcaactcatttgaggtttcacagcttgcaagcagtgcaaccagattcaaatttaaagtcagactgatacaaaagacccactgccttttcaactgcacgatgctccttcttggtattataaacccatgcaacgctggtcacatttattagatgaatctttatgtctagaagctttaaagggttgagcttctggggaccttgcctaatgtctgatctaatatccacataacaaatgaggacagagaaaatcaatgacttatgcatgtccattccgttttctggtagtggagtcagttccaggttttgttctcttttgatgtcatttttctgccttatttcaaacatgagaattataggaaagggaatttttatagtgatcagtaaagggcattgcagtcatgaggaaaatcagtggttttcaaaatatgagtttaattacagtcatgtgtcacttaacaacagggatatgttctaagaaatgtatccttaggtgatttcattctcgtgtgaacatcatagggtgcacttatacaagtgtagatgtgtagcctactgtgcccctaggctgtaaggtatagccgattgctcctaggctgcaaatctatacagcatgttactgtactgaatactgtaggttattgtaacacaatgataggtatttgtgtatctgaacatgtctaattattgaaaagatatagtaaaaatatggtataaaagaaaaaaatggtacatctctgtagggcacttaccgtgaatggagcttgcaggactggaagttgctctgggtgagtcactgaatgaacagtgagtgaatgtgaaggcataggacattagtgtacaataccatagactctataaacacagtacacttaagctacactaaatttatgagaagatatttttctttctccaacagtaaatgaaccttagcttacggtaactattttagtttataaacttttaaatttattttaacttttgactcttttaaaataagacttaaagttcaaaaacattgcatagctataacaaacgtattctttccttatatctttattccataagcatttttaattttttaaaactttttgttaaaactaagacacacacagattagcctaggtctacacagggtcaggttcatcaacatcactgtcttccacctccacatcttgtcccactggaaggtcttcagggacagtaacacatcatctcctatgataacaatgcctcctcctggaatacctccagaaggacttgtctgaagctgttttacagttaactttttttttttactaagaagaaggaatacactctaaaataatgattaaaagtattgtatagtaaatacataaaccagtaacatagccatttattatcactctcaagtattatgactatacataattgtctgtgttacacttttataagactagcagtgcagtaagtttatttacatccgcatcaccacagacatgtgagtaatgtgctgccttccaatgttaatcagtgataggaattcctcagctctactgtaccctaatgggaacacagttctatatgtggtccatcattggttgaaacattgctatgtggtgcgtaactgtattacgtataatctagtcactcagctcttcgtcagaaagtgccttcttttcctgtctttatcattctaatcaaacatatgatcaggatctgttttgtttgtttgatatttgcttgttttcattttagagaacttctttgcttacttcctgaccacttttgttttgggaaatggccgtggattaatatgcaaaccacttggtttcagtgtgaaaatcatactctttacattttagaatgaaacataaagatgttggcaagtctgtgaatacccaacattaaattgaggaaaggctggagaatgtctttgctatttgattggtaataataaggctaaaagattaagtgacttggttaggaggcttaatatcgagagttgctatccaaacaccagggaattactaaatatcccgcagagtttggttaaaaattgccttaaaattcatcatagtccattctaacagcattacttcttgaggtatagaagcaatccttcctattgctatgtcaatgttgaacagattccacactctagcctcagtctgcaattttgatgatactagatgtgaagttggaaacccttgtttgaagattctcttgggttggaatcccacttaatctgaagagatcattctcagcaaactattgcaaggacaaaaaaaaccaaacatcgcatgttctcactcataagtgggaattgaacaatgagaacacttggacacaggaagggggacatcacacaccggggcttgttgtggggtgggaggaggggggagggatagcattaggagatatgcctaatgtaaatgacaagttaatgggtgcagcacaccaacatggcacacgtatacatacgtaacaaacctgcacgttgtgcacatgtaccctagaacttaaagtaaaaaaaaaaaaaaaaaaaaaaaattctgaggagaccttttagctatccactttgatattttatactaagaagaagagggaatattcatgctcttatgcagaaataagaattgaaatgtgcacatctggaatttagctttcctggagatggaggcagtattactctgggaaaggttcattgcttgactgaaagattgtagctggaatttgcttaatgattaccagagtctggcagggataaattggtgaacaattgtgttggacacttgagattttaatttcttaagaaaagagattgagtttaattaatatagattaattaaattagttaaaacattgtatctgtcaaaagcttttagatacagcgagatctactctagctcgttaagcaaaagaggtctattcaagggtattatatagttcaaagaatctccgggagggccaaagatctcgcttggatgccgcaagaccaggaataatgcagccaaagtcaacagatccgggagaaatatctactcacaccacatgtcactgatctagcagaaacctttctgctgcaattactgtctgttcagcacatataatgcttagaactgaacactggaaggtccgccacaggtgaccctccgaaaccagtcacttctgccccctttcttgagggactatccaatctccccacatttggcccctgcttctagttggtcacgtctacctccacatctcatttaagcgtgtctgcttaatagaaatttggtcacatggaaaatcctgctatgaaggagcctggaaaatgaatatttaactttctagattctacctctaaacacaagaagggaagcttcaagggtcttgcatggcatgtagtgagcaaatctaccacagtgtgcaagaatgtcagaatgtggtggggtatatcattagacttacccctctctcctgtggggctagatgatgcattgatgctactccatggggaaaaaattgccaagggtaatcttgcattagaactgttgagtacaccattgtacagagagttgggtctctcctcactggaattaccagtcactttttattttctgcgggaataattgatctgcaaacaaggaagaaagttggaaaacagagtctgtctctgctaacggctttgtataaactgtcagagcaggccgggcacagtggctcacacctgtaatcccagcactttgggaggctgaggtgggcggatcacgaggtcaagagatcgagaccatcctggccaacatggtgaaaccccatctctaataaaaatacaaaaattagatgggcgtggtggtgcatacctgtagtcccagctacttgggaggctgaggcaggagaatcgcttgaacccaggaggcagacgttgcagtgagtcaagatcgtgccactgcactctagcctggcgacagagaactcttcagaggtcaaataactcttctccaagccacacgtgtttttcagtggtccccttagatgatggctcactatggaattagaagatggcaagaacaagcatccctgccggatggacccgtccgtgggggtgctgtggctctataggcagtcctgtctgtgtgggtcaggggacggtgcagcccatggagcaggcttctggtatttgtcactggagtgcagagccaagctaaagcaggggctggggcttgtgtgggaggctccagtgagagctgagaggttccttcaggccacaggtgatattgcctaatgatcatcttggaacattctagtatcttgggttattgttcacctggcaattattagttgttactttttaaatcagatgcataaatgaagggtgttgtgaagccctttttagtacagataagccagctaccaagtttatctggaaaaggggaattctcagattgtttttgggactggcagagatgggcacacagggagagatgtctatgctacaggtgagtcagggaatgaatgtcagtccctcctgctgtccataccaagccacacgctgctgttaccagatccttgttcaattttcctgctctcgataacctcaattctttttcttcctttccagctatttctgaaagttttgccatcttgctgctcttttttggaaagccgcctagccctctcttgtgtttgacaattcatctttaaagatcaaaagaacagaaactgtttaagtgcaagactcaactgtgtgcaggacacagcttttggcagctgattattaaatgggaaaaaaggggtcaggaaagtgatattcccagcattctcaattctctccccagctaaatagattcttttgttagttcttttaaagataaaagaagttccccccaacatttctgtctatgttctgggctctgacatccctcaggagtgagcatggcaacactgtatggatgggctttgctaggctgggagacttttaactgtgttgagagaggtgagggggcagaatcccaccacaggctggcctgggactggctccctcccctcgaaggccccctgaagaggttgatgattactgcccttgtacttggccagaagaggcagcatggggtaccctgtgggaattctgttcctcttgatcagaggaaaacacttgtactccgttgggtctcaagtttttatttcttttttattctgcttgtgaaaacatctttcaacacctatgttttattttccatccatgataccgtactagaagtggggagatctaactctatccttttcttagtagaatgatacctattttgtcttctctaaattagagttgacagtgaatataccataggatcgttataaagacaaaatgaagcactgtaagtaagaatgcttggtaaatatgcagtattttaaagactatttcctttcttccaaatgaatttcttgaagtaggtgttttaccctcagcaccttttcaggcaaaaggagaattatggtgattacaacaaaagtgattatagtttatatttacggagagcttagtgtgttttgagtaaagtttagtgcattgctcacacagggtgtcatttaatattcacaaaactctgtgaaatagttactgttatatttatttttacatacaaggaaactgaggctatagagaatttagataatgatatggctctgtttcccgacacaaatctcatctccaattttaactcctaggtgttgaaggagggacctggtgggaggtgattgtatcatgggggtggtttccctcttgccgttctcctgatagtgagtgagttctcacgagagttgatggttttaaagtgtggcacttccttgctctcgctgtctctcctgctgccatgtaaaatgtaccttgttttcccttcgccttcagccatgattgtaagtttcctgagacctctccagccatgcagaactgtgagtcaattaaacctcttttgtttatgtattacccagtctcaggtaatgtctttatagcagtgtgaaaatgaactaatacatatacctagcacaaggttataccactaatatgcagaggacttaaatgcaaggcagtcgactctagagctcctgcagcatgcacagctccttcttctgtgtcattccatacaggtatctaagtttcttacctaagaaagtgaatgaattttagacccaccctgactccttagcaggctgtcttgctcgtgtatcttcctggctgggcacttgcctgatctttctctagacattgcttacaaactttgccccagccataccaaactcccaaactccaggagacagcagactgggccatgatttcttatgtgtccatttctttgcatctgtagttcttgaaacctggaactgttttccttcttcttttctttcatacatttctactgttctttcagcaaatattttagcgagcaagtgctatgtgctctagttagcaccagggataaattaatgaccttactggtcttacagtgtagtaggagaagcagagggataaattccagtgtaccacatagagtggcaaatgctatgagacagagaagtggagagtcctttagcattgtttctaatgtattcatgtttttataaaatctattaagagcctgcaatggagcacacagtatgttaagtgctagtgatattagacaaacacggttccttccctctgactgctgtgttctactggtggtggtggtgggtggacaatgaaggaaaaagagaaataaataataattaaatcagtaaatacctcttggcataagtgaccttaaaaactaaacagaaccaagtgatagagtgatgggaaaggagtacgtgagatagagtaatcggggaaagcctctcggacaaggtaacttttgaacttggtttggaagagagagaaggggctagccatactggtgttctaaacgaaacaagcagaagttcaaagtccttcaggccaaagagagcttgttttgctcaatgactagaaaagggatcagtgttaaaacttgccagacttcccttcccaaatattaagtcacggtctcctctgagaggacatgtcactcctgtgataaggcatccattatgctgtaccgagggcatgtttccctctcctaacaggcaaactcttcgtatactacaacttattcacttttgaaaattatatcatatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaagggaaacatcacactctggggactgttgtggggtgggaggaggggggagggatagcactgggagatatacctaatgctagatgacgagttagtgggtgcagcgcaccagcacgtcacatgtatacatgtgtaactaacctgcacattgtgcacatgtaccctaaaacttaaagtataataataaataaataaataaataaataaataaataaataaaaaagaaaattacatcttatagtccctagcccatgagaaaactcaaggaagaatactgacttgaatgaatgaatgatgtatccaactaaattgtcctggtctagctcactaggctacatcattcacactggcttcaaaaatgtgtagagaaatcactgtgaaggcacaatgagctcacttgggatcagagtcatttgtgtgttttactccccctccttattgaagaatttttggtcctaattgctggggcagctgtgagaactagcagctataaatatttgtaggtttacttcaaactgtgtgtctgctttcatctccctgggcacattccatgctcagagggtcattagctgtgtactcacaaaacagctatagagtaattagtactaaggaaagctgcatattagttattgggtttcgggacctcctttttgcttcctgaagcttttgcatttctgtcttctaacttccaaattgaggctttctgcttgtgttttaagttgtacctgttgttatttattgagtattgtaaaagtgtatcctatttattgagtatttatgatatgacaggcattatactaagccgttagcctgcattgtctcactcaagctgcatggcagctaaagtagttttatttgtattttacaaaataacacactaaggttgcaacttgcacaaagttacccagacagtgaatgatcagtcttgaacttgaagtcaggacagtctgtttccagagttcttttccattgtaccagtgcttcccaaaccaagtgatcactgccggatctctttaggtattctaaaagaaattaataatttgttttttgtttccatgataatcctaaacattcgtataagcatattcagagttatttatgactgattgagccctgttggataatttctggcctgagcttgtctttgtataaaaattactctgaaaacaaatgatcactcttagtgctgcattttcaatctagggttctttaaagcagctatgttccttgagagtaagggcgaacagcaaggtgacttgttaacccagagctctcccaggctgggccctggcctggattcatgattgtcttccctccgctatgacattcctagcaattctggtgcttcaccacaatttgagggatggctgtcctggtaactggaactgctggtggggacacttggcacactcccagtctgctctgcttctcactgatgcaaacctacagggaaatcagagcaagcttgttgttgttcagtgcacagaggccatgaaaataaaataataaagactttttctagaggagtaaacaatatttgtagaagaactcatcaggaatccaaagagcaagaaggaagtaaaattgttctagcgtcctagtgttcatgcatgcaggcggcaaggcccacagatattgatggcaggttaacacattcatgatcctttctcttgctaggctttcaaaaattatttttactcttacagaaaatagaaaaaaacattttcagatcttcacctagatgtacaagagtaataaattaagctgctctgaaggctgctgtctaaaaacatgtaaagtatagagaaagatcttcagatctaccttttgctgctgctgctatagacagattgctgggtcttttggggcagaagaaatcacgtggtggggaatagctcacctgcttacagctgggaggacatgtttgaaggggggtgaaagaattaatgcagtaagatttgtgaaatcactggtgagcataaaaccttatattgcttagcacctaagttacatatttaaatgacttaaaatttaaaaattatttaattctggaggacaaatttaaaaataacaataaactaacatcctatttttcacctctacagctagtgaatatgctctgaaggatacacaaaaatgaaatatagtctgaaatcgaattcgcggatgcattagtctgctagggctgtcgtgacaaagtaccatagactcagtagattaaatataactttattttctcatagttctggagtctgaaagtctgagatcaaggtattgtcagggttggtgccctatgaggcccctcttcctggtttatagacagctgtcttttccttgtgtcctcactatatgtgtctgtgttcaaatttcctcttcttgtaaatgcaccagtcatattggattagggtctatccgaatgccctcattttaatttaattgcctctgtaaagactatctctaaaatatgttctcactctgagatacaagggttaggagttcagtatgaattttcaggagggatgcaagtcaggccataataactgattctatttaactatatctatatctataattttttgaaccaaaagaaagatttatttggtaatgaataggaaaaacatttatgggactgtacctactaaaattttaaatatactggagttcaaactttgcccttttttcacagattaaaatttgatttcctagtagtactggctatattatattaaacattagatatgatcatagaaaataatgattagctaagtgtgaactacttattactgtttataatactacatttcatttctaatttacaatagtttataataaggcaaattttctacctctgccctcattattgcagaaataagctcctcattattgcagaaataagctcttaaatatttaaatgtcatattagagataaatcgttcttttgtgtttaggtatagaggtcgatgaatctgtggtgtgggatggtcactgtcaagaagtataaaatcttgagagtggtctacagatagaggaagggcagaggcttttgctaaacaaaagaaactcggcattaaatccacatctgtggttttctctctctctgtctgtgtatgtgtatgtgtgtctgtaaataacaaataaggatggtatacatgttttgagctaaaactaggagtttaaatgacaattttctacttggtatacatgtatgtatgggtcagatcagggactgatcccaacacgctcatgtgtggctgattcccccacccctgactctactgtgtaaagaaagtgcatcctgaatgggccctttatgatttggagaagctatagatatctcaattccttcttatagagaagggaaaatggagacacaggagtggggagagtttgagaagatggtagagaggagtgtttgggtgaagggagatggattcgtctactgatgcaactggtgagttgatttgaaaaataactgacatattggggacttttattaattttgttctgcatggttgatgaagtaatttcatcttcactaaaccttctattaaatctactttattcactagtgctttcatagctaaactttctgtttttaggagatgcagttaaatgctgagccgcctcccaaagtgagtgggggggacaaaacaggttcctgaaattgtctagatgtgtttagtctgcatctagacacaaatatatgtactatcttttattcacgtatacttgatatcagaaagcaaatgagtgcagaagagcagatagttgagcaggagtagaaggagtagaaggtattgctatgaaatagagttgatgaatgaagaggaaggtggacagtgagggaaagaagaggtgtggatgaagcaaagtatcagcatgtgggtagcactgaggggcagtatgcatgtacacatgttttccacacatatcgtagaagtaaatgcattgagtccataaaagaggaaatgaaacaattgatgctacaaaataggaaatcaaagaagaaacaacaaaattattgcataggcattggactgaactacatctgtgaataacacattaagcaaatgtttaaaagatgatacttttgatttttaacagaaatatgtttctgtattttgccacttaatttatgctactcatttaaactgaaatatttggaaattgaatgaacagtgccacgttaggcagcctagccaaccagtacctggattttagttcctgaatcactgagctgtatgttcacaattcgacaagccttgttatcagttctgaggcatagctgacgtggggcgagggattaggtagttctagatgactaggcagttaattcttaagcacaggtgagttactttaaatcggttcacaaagcattaaaaggatcttggtgatatgcaggcttttgaacatatttacgttgcgatggtactgtttgacagggatatgatcctttttctgtgataagtccttgtgatttattgaacaagtctccaaaagtgaactttcagtggtcttgatggtatgcctccaactgttccttttcagctgtctctcttgacctctgcaatgtgcatttctgaatgattttagcttcttttagctaaaatgaattctatctcttagaaggtgcacattttgtatttctattctaatcaatacttcctcccactgctttaataacccaaagacactttatttaagtcagcagcgaacagggcctgagtcactttagttaaaatctgggctcccctcaatctgaaatcatttcatctcctaatttcctttttagtttttctgtatacacagcaggccatctgaaaataagtaatcaaagcaagaccttttactgagaaaatgagataagcttatttcagaattctcaactttctcacttcttgaaaaacatgtccccttaaggtctttgaacaatctttaaacagatgtctttctcttaaggcccacttccaatctgatttctcccagattttcttaatattgaaagtggggagttgatgtttacttataccaactacatggcaattctatttccaaaaggcttgtgaaaagatagaaaacagatgatgcttgttgtctgattatttgcctttcaagagtaactttgctgtgatagactcatataaattgctgataagaatttaaattactacttcctttcaaaaaataaatttcccgacacatatctggagtttttaaaatgtcctgcccttggatccagtacatccttttctaataatctatactaaggcaaaatttaagcattcgatgatttgtgaacaaaatcagcattgcatcattatttataataacaagaggtcagaactatccaactgatgtacaaaagatgaaaggttacaaaatatatggagtaggataatataaaggaatattacttggtcacatttcaaagtatatgcaatgacatggaaaatagatacaattgaatttttagcataaaatactatatcaactgtcaatatattcctaagtaaagtcatagaaagaaaacataaatagaactcgttaaaagtgttgtttctacattgtgaagttatgagtaatctctctctctctatgtatgtgtgtgtgtatatatatacatatatatgtatatgtatacgtgtacatatacatatatatgtatacatatatacatatatgtatgtgtgtgtgtgtgtgtgtgtttctttggtttttatatgagtctgtaatactttttaaatgagacaagtaattaatattttttaagaagaatgaaataaccccaagaggagaaaccctccttttccttcagggtaaatctactgtaggtatactctttctttctagtaattcattctccttgtggctgctctatttttcacaacacatgtctctggattgtagtagtaaattagcaacaagaaaaccaggtctcaaaaccataaaaatagctgccacatacccatgatctttaatataaatatgtactttaaagcactttacaattttgaaagactctcccataaagccaccttgaaagtgttgtttgtaatgtcagctgtgtgaaggcagagttttgtcttgttcacctttataccctagcgtctaaaacagtggagatggagtgcatatttgctgaatcaataaattaatgtgttttgaacattagtggtaagatgagattgcagaggacataatctcacatgatactaacactggccctctgaggaggatataggttttattatccccagtttataggaaacagaggcagaatgattgatctgcacaagatcacagagctggtaagtggcaaacatctatttgaaccaattctctagattagggcttagttcttagtatgattctaacaaaacttcatgattttttcattgtctcaccgtacctaaaggccatggtgtcacttaatacgttagcatttatcaagattttgttttctattcagcatagaaaaaaacacatgggctcagaattgtaacacggctcatattaatttctactcattcttctcactgcatttactgtattagcccattctcgtgctgctatgaagaaatacccagaactgggtaatctataaagaaaagaggtttaattccctcacagttccacatagctggggagacctcaggaaacatacaatcatggcggaaggcacctcttcacagggtggcaggaaagagaatgaatgcaagcaggggagatgccagacacttataaaaccatcaactctcataagactcactcactatcacagaatagcatgggggaaactgccgccatgatccaattacctccatctggtcctgcccttgacacatggggattatggggattacaattcaaggtgagatttgggtggggacacagagtcaaaccatatcactgcctgtcttctttcttatcaggagttgttatgcattcaaagaatttccttggataaattctgagttttctagattgaatatggtgaacatggccctttggatcctatgattcatagcaatgtaagaagcctgaatcctttctagagtactttttcttagtaaagccttaggactttctgaacactttcaaacgtatcttaaaacaatgtatttgtatttaaaaaccccccacaaagttacaaaaatacacacctactattttttctcatctctgtatcccaattattatgagtactagcctctatcaactcaaaaactggccaaagaaaggatgaaagtttgaaaacccaggaagttaaaatctacccagggcactgctgtgagattccagtgcagtgatgtcctggtaggaacagaacaagtcacctttcaggcaggtgccctttactttcacatgttgacaatggctcattctctgtttatatccatttctgctttgcagcctcaatccaggcagggacaagggacatgtggcccggggtgttatttgatgtgtggtgtatgtgtacttccttctcttgatttggctctgttcaatgtgaactaaagtgccctactgttcacatcagggtaggaatcctattggctctcagaaccttctagagtagccgctatatgacttcaataaaaaagcacttggctttaactaattatagccctgctccaggctaatttgtgacccacatctcatagtaaacatttctctctaaccttgaaaggcgactaaactgggacagttttacccacagagtttaatcaggtctctattctaaagacaaagttttaagaaacctggataaatttcatatacgtatgtttgtaagttttcttcttcataaaatatttgtctttaaagatagactgaaatttgacaagattctaattggatttacactccttactttccttgagaaatactcttttctatatagtaatgggttgaactatttcccattcaagtattcatttatccactccgcatgcaacaagtatttcatgaatgcttgttatatctcaggcacagaatatacagttgcaacatacagatagggtctctattgtcataggaaaggaaaaacacataccaaataattagagacaaaattaatagttcaattctagttttggaaaaatcaatgggaggcacaatgagagtgtctgtgcacggaatctgcttatctgagagctcttggagggcttccctgagaaaatgcagttgaggctaagattttaaggatgactaggtgctgactgtgcaaattggggtagtaggagaaggaacactcaggccaagaggaaataatatgaaaaggataagatggaaagaagcaaagaaaagtcaaagaaccgtcataaggaagatgggtgagacatattatcaccatgttatggatccatttattttcactaaagctttactaatcagcttttacacacaaggccctgtgccatgggttggaggtacaacagagagtagaaactgcaccctctcgcagcttgtattttggtggcagttacaatgctagagataggtgctctaacaagagcaggaaagagaaacaacttctaactcacactgcgaggtcagcaaactagaagtgatgtcaatgctggtacctgaaggatgggaggcattaatgagacatgtcgtagtggaagtgtggggttgatgaaatgaagagtgaatttgaaggccagagactagagagaaaaacagacaaagagaaaagatgtatttggggaactaaaataagcataagtatgaagatggaagtaaagaggggcaatgtgaatgtttcagtttcttcatctattacgtaagggcgttggaccacgttctttctaggtcatagattttgtgatactattttaaacccatcatgtatactaggtaaagattgagaggttgttaataagtttttgaggccacagagataagcagtgacaaagctcatttagtctttcagttgaatgtacataaaagtcacaaaaaactgctttcgattggaagcaatattactgacctgattttttttcacaaaaatttgaacactttgttatgtaaaaaactaaactgaccttattgcaaatatgaattcttccctccttccactactttttactgaagactctttatttttctctttagattgagcccagagtagactcaagttctgcagggtgtccggacagtaccatgattacttgccacttgtgtcagaagaataagttgattgacattgtacagatttaataagcaaattgttgatttcctggtatttagcaagttgtcaattaaggaataagacaccaatgtcaggttcagggttacctaagaatgtgctcttgcctttaccaagaagaatttggtgacagattcctattcccaaagtgttctttgaaatggacaaccttacattaacagatcaaatagtgtccaatgttcagaataattttaagttttatgaaacttttatacaaaaacctggttagtatgtcatctgctcagacttatgtatgaaataggaacatgttagccaaaatatgaaaattgctacttagatatccactctactggagacctagaagataacaagttcctgagggttttccaggaagggacatgaggaaactgagagagggaaaaccagagttaggtctcagttgaaatcctacattgttctctgaagataccatcctaatatacagctgttgcctaaaatgttgaccaaaaattgggaattattacattttcagacactgaataatttttcggaaattacacataatgtctcctttgatctaaaatgtatctttcacttggaaattctggtcattacacctctcatagggtgaaagaaagatatttgagaaaacaaacaaaaatagagagcgtgaaaagttaaatttctttagtatagaaatggggcaaacttgggaagtcatgaatggaatgaatacaattatggacaacaatttagcctgggtttagaaactgctgacccacttgcatatagtgtacccttgaagtttgagtaaaggaagattaggacaattacattgaacagaaatactactagtgtgtaatggactttggaacctacttgaagaggtcatgaagatagtatatagaaatggaaaagtttccagctctacttaagtatgagctgagaaatatacaatatttctagttggcatcatatcatatcttctgtcttcataagtcttatggtcctcttggacacaggctgtatgctccagtgaacaatgacctcatccctgttggtcattgtttttgtcccagtgaccctatgttgcttagcacattcattgacctgctcaatcaatatgccttgataatgattaaggattttaattatacagggtaatgatctcttgttcttgctctattatcaccctaatgataaatgctaaccttaattgagcacatgctattgtatcatgttctgttctcagtagattttatagaacaggtttaatttggatataaaccgtatgcttactatcatatgctatggtacttttcatatgcctatttaaagatgagtaatctaagaaacaaatacattaagtaactttctcagtgtctcacagtaacttaatgatgtggccaggatttaaacttcagcagtctgactccagagcctgtacttaaccagtatatttctgccactactatggaccaaattggagaagtggctcagaaatatttagcaatatcccctcacttgctaacccagtgattctgaccatttttgtctttggagccaaattagatgtgttctattctacattgcattctcctgttaggaaaagagaagtggaaagatggttgaatggaaaagaatggagtcttttgattgaaatcctcaatgttttactttcctacagcctatgttgacacattccatttgttttaccccaaactaggagttcctgtaggcaaagctccagagagagtacatatggtttatagccggttctttttacatagatagctggccaaatatataagcagagggccgacctggagtggaaccactttgcaattgtttgctcagaaaatatactatcaaagagtcctacggaaagggaatgggggaaatgaggggctaagcagagctcttgtagttttccattgagcagtgacctgggtaatttactaagagatgtctgctgtatttctattttctaagcaggaccccaagtcaatatcttgcctatcaaacaaaggcaaccagtaagataacaggcatttgtagaattaacacagaagcaggctatgttcctcctgcccactctcacaggcactcttttgtcaaaagcagacagacagacagacagacacacacacacacatgcacatacacatagtgttttctcagtttaccaagagaactaccaagagcaaacaacttgtgtatcagtctggtcaattataagaaatgtggctatttcttccctgcaatttagtaacttgacatttttctctttctctctttctgtctctcttttttgtaatcacagcagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaatcaaggtgatgctgaa

SEQ ID NO: 37246 - DNA, 116452 bp, Homo sapiens; identical to SEQ ID NO: 37245
